United States Patent 7,868,149 (PLANT GENOME SEQUENCE AND USES THEREOF) - sequence listing, part 68

SEQ ID NO: 37480 - DNA, 8156 bp, Oryza sativa
  unsure (1)..(8156): unsure at all n locations
aggtggacgagatcggcgaggatgcggcgaagccgaaggagacggcgccgagctggnagcgggtccggggcgatgacagcggcggaccggagctcggcggcgacggcggagagagagagcgacgtcgcgagctcaaatccggcgagaagaaaggccggcgagaggcgaaaacgtacgaagnaggtgcgggggagggtttaaatagggttggaaggggagagagcggccggaggggaaggaaaccggcgcggcgctctcgggctccatcaatggtgccggcgggattaggggagggtttccaaacgaatccaagggagagagggagggaaaattggggggaaagggagaggggatcacggggagtgattccccccactttattgcacgcgaggacggcgggaggtggcgggattcgcggcggcggcggcgctagggcgcgtggaaggcggcgggagcggcggaagaaaggggatgacgggtgggccccacccgtcagtgagggtggcggacgggcccgcccgtcagcggcgcgcgcgcggggagggaggccgaatgggccgcgggggagaggagagagagagggggagggagatgggtcgaactcggcccattagagagaaggagggattttagggtttttctttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatatattttagggtcgttttgggacgtgacagcatctctatggtgggaccacttccagctacgcagccagagggacagcctatcacctgggcccatttcaccgccgccttccggaggacccatgtgcccgccggagtcatggcccttaagaagagggaatttcgggagttgaaacaaggcaaccgctccgtgatggagtatttgcacgagttcaataatttggcccggtacgccccagaggatgttcgtgaagatgaggagaagcaggagaaattcctggcagggatggaccctgagctatctgttcgtttggtctccggggactatcctgatttccagccctggtggacaagagcatccgcctggaagccaagcacaaggaattggagtcgcacaagcgtcgcttggcgaatttccgcaaccaacagggggctaaccaaaggatccgctacaccaatccctatccagggggatcctcctcgcagccgcagcagcaaccccgctccgcgctccgacctcaattcgtggtgcgcgtcccacagccgcagcagcagcagaatcagcaaggggcccatgcaccccgccctcctgcaccagccgtgcagcctggacaaggccgcagggatgctcaaggtcaacagtgtctgtgcttcaactgcttcaagcccgggcactttgcggataaatgcccaaagccgaggcgacagcaaggccaagcgcctccccgccccaacaacggtggtaaggatgtcactcggggccgtgtgaaccacgtgactgccgaggatgtgctgagaactccagacatcatcgttggtacgttcctcattcattccatccctgctaccattttgttcgactctggagcttcccactcgtttatatctgtgccattcatggggagaaatcagctgggggtagaaaggcttaggaaccctctgctcatcaccacccctggaggggttatgacagcaaagtattatagccctgccgttcctatagaaatccagggaattgctttcccctcggatttgattcttctagacaccaagaacttggatgtgatcctcgggatgaattggttggctcaattccaaggagtagtggattgcgcaaggcgcactgtcactgtgtatcggggccctgatcaaccggttgttttctttgcacccccaacttccgccggcagttcagtacttcatcagctaggattgccagaaatacccatcgtcagtgagttcggagatgtgtttccggaagaactacccggtatgccgcccaagcgagagattgagttccagatagatcttgctccaggaaccgctcctctgtacaagcgaccctaccgtatggcggcaaatgaactggccgaagtcaagagatagttggaagagttgaaagaaaaggggtatatacagccgagcacttccccctggggtgctcccgtgatttttgtggagaagaaagagaagacaaagaggatgtgtgtcgactacagagctctcaatgaagttactatcaaaaagaagtaccctcttccccggatcgatgatctgttcgatcagcttaaaggtgccactgtattctccaagattgatcttcgttccggatatcaccagttgcgcatccgtgaagaggatatcccgaagaccgcattcaccacgcaatacggactgtatgaattcacggtaatgttgttcggtctaaccaatgctcctgccttcttcatgaacttaatgaacaaagtgttcatggaatacctggataagtttgttgtggtctttattgacgacatactggtgtactcacaatcagaggaagaccatcagcagcatctccgtttagtgttgggaaagctccgggaacaccaattgtatgccaagctcagcaagtgtgagttctggttgcccgaagtcaagttcttagggcacgtgatatctgctaaaggagttgttgtggatcccgaaacggtgaccgccgtcactgattggaagcaacccaagacagtcacttaggttcgcagttttttgggtttggcaggatactaccgaagattcatcgagaatttctccaaaattgccagacccatgatgcagttgctgaagaaggaagaaaaatttgtgtggagccctcaatgcgagaaagcattccaaactctcaaagaaaagctggtttccttgctagtgttaatcttaccggatactcgcaaggacttcctggtgtactgtgacgcttcgcgccaaggattggggtgcgtattaatgcagaaaggtcatgtggtagcctatgcctcacgccagctacggccctatgaaggcaactatcctacccatgatttggagttagccgctgtggttcatgctctaaaaatccggcggcagtatctcattggaaatcgctgcgaaatatataccgatcataagagtttgaaatacatcttcactcagtcggatctgaatcttcggcaaagaaggtggttagagctcatcaaggattatgatgtgggaatccactatcatcctggtaaggccaacgtggtcgccgacactctaagtcgaaaaagccattgcaacactcttggcatccgtggcattccaccggaacttaatcaacagatggaagccctgaacctaagcatagttggtcgtggattcttggctacgctggaagccaagcctaccttgctcgatcgaatccgcgaggctcagaagaatgatccagatatacatgggatcctcaagaatatgaaacagcgtaaagctgctggtttcacagaagatgaacacggaaccctatggaacggaaatcgtgtatgcgtaccggacgacaaggaacttaaacggttgatacttcaggaagctcacgaaagtccttattccatccaccctggcagcacgaagatgtacttagacttgaaagagaaatactggtgggttagtatgaagcggtaaattgcagagttcgtggccctttgtgatgtgtgccagcgtgtcaaagcagagcaccaacgaccggccggacttctccaacctctccaagtaccagaatggaaatgggatgaaattgggatggatttcatcaccggacttccaaaaacccaaggcggatatgattctatatgggtagtcgtggaccgactaaccaaggtagctcggtttattcctctgaagaccacctatggagggaacaaattagttgaactctacttcgctaggatcgtgagtctccatggcgttcctaagaaaattgtatctgatcggggaagccaattcacctctcatgtcacatcctgatttttgtttcaggatttataaattattattagaatttatattaaatgttcattaatttacaagtgaagttaaatgtgggaaataaaatttcctaaatataaagcatggatggatttattttttattaaattatccatggttaattatactctctggaatattctcggatttttcggagctcaattcctaatttttaatcatacaaagagcatttcagtaattacccacatattaaattaatcattaaatggtctaattataatttttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattccattccttcctcttctctccctcctcgcgcgcgtgctgtgcagcccacgctggcccaacctgagccgcctcctctcctctcagcccagccggaaaagtctacttttcgtccctgcgctactgttcatcttccagctcaggcagagcctgagccagccgtgccgtgcacagtgccgccgcatcctccttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccaaaaccgagtttttgatttcccggatcgatttcttgcgggaggagtccaatctcttcaatccaaggctataaataggaccccctagtcctcctctttcgtttgcccctctcccgtggtctcccgtgccccgtatcctctccgccgccgccgccaagttcgccgccgccgccggccgaacttcggccgtgtcgcgccgtcgcctccgccgttgccgtcggtctccgtcaccgccgtaaggtgcgccgaggtgtgggcaagctcggccgctccctccccgctgtcgccggtcaccggagccccgtcgccgccgtcgaccgaagccgcgccgcggctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctttttatctaatagattaaatcttcggaaattcataactaaatcatcgtaacttgtattcgactggttcaagttgctaaattcatctaaaatcgagatctacatgttaaaaatatccacatgtactgtttatgcttgtttttgtactgtttatttggttttattagtttttttcttcgttttgtgtgttagcttgtcgtttctgtcgttgcgaaggttcgtgagtgcgtcgggagtgttcagaagattaattgaagaccgattattgcaaggcaagtcacacagatcctaaacacaatcctttgagcatgttgatcctatatttaaattctctatgtatttcaagtgtgcatttattttcgaatgtcactaggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtatctcacgatggttaatcgtgttatgataattaattggtaattaaaatatgattaatggtgggttgtgagcacatggttttgaaggtcgtactcatggcaattaaggaccggttcgcgagctactgttgtgaaacattaaccgtgccaaccacaagccagcgtgggcaacggctttaccttttgtatagcatggttcattgcggagcaccagactgagaagtggcggagataagcccacgggggtcactggggagtccaagccttgttttataagggggtgattatgatccaggaatggtgcactatggtgagttgtgttgtgcagagggtattgtcacagcctctattcgggtactttctagtatcgcgatgcatggtagacatgatgttgaggctgtgtcttgtgggtacagtggtacacctctggccagagtaaaactattcgaatagccgtgcccaagttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgttgttcagtgttgattaaagtttctgattaattactctactgttttactactcttaactctttgctaaatgctgctttcgcaaatgagactatattgtgccatcctttggtatccttgtgtatttgcatatttgctgtgtggcttgttgagtatgtcatatgctcattcttgcaataatcaatcaacctcagttgaagacaagttgcgaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatacacagataagtttgtgtaccgtcgccgtccccgtccaccccctcgtcgatctcgccgaccgccggagcgccgccgtccccgtcgacccgagccgtgccgccacctttcttcgctccggccgcctttttcatcgtcgccatcgacctaaggtgagccgagccgtgccgccaccgtggaccgcgtggggcccggccgtcagcccgccgcgccctcgggtgcggctgacgcgtggggcccacggcgccggccggtgtgagcccgggtgcacccgatccaccgtggatcgtgaggctgccgcatgggccccacttccgtggacccggtccgcgcgccccttccccttgggtgacgcaataaaccctttttaaattaaaatttaaatgaagaaattcgcaaatattcatttaaagagcatataaacttcaaatggccataacttggccatttgaactcggaattggatcatttaagtctctaatttttccttaagaagtcaagaacccatttttgtgctttgttcttgctagttatatggagtttattagagtaaaatcattttcttttccgatggtcgtgtagatgctgcagcttcggaagatccgctcttcgtggaggttgaagccgacgtttgggaaagtgagcaaggcaagtcacatcatccttgagcatattgaatcccagtttataaaattattttgatttaaattattgcattaccactttacttaaattcccgcgttatcactgttttatttagccatgcctatttacctttgttatgaccttattattattgttattgatattaataccttgttcaccctagaataaacaaaaccccaactagtgggcactctactcatggtaaccactagtatgaatttaggtagatgcttcgctggttaattaggcaacattaggtggttttacaactctacactttgggaatattctcatcacctgaacatggaatggatggattattatggaattggattcacacctccccctctattcaaaatcctcaaaatggttttaggctgggctcggggtgcatggttttgatagtagcacctcggccatataaggaccggtcttcgggcctctgttgcaaagcactaccgtacttccac

SEQ ID NO: 37481 - DNA, 2886 bp, Oryza sativa
atcatcgtaggccttgggttaaggcaggttcgtgtgggttcacggccttgattaataacattgtataactctaggatcgtatttacaaaatatctttgggcaactaagtgtcttttaatgctgtttactgcaaaccctaacccttatattataacccccttgtactcccttgcatttattctgcacttgtgggtgtgtcttgttgagtacggtggttgtactcagtcttgcttaattttttcccaaacccagaaaaggagttcctggaagatgaaggcgttggtgtttagctcgtgcctccgtcaagcgcctgtggtcgtcgccctagtcttccgctgtttcccgtttgtctttgtgtgtgctgggccttcgccgcccatgtaataaattaattatttacgcttccgcttggtaaactctgaaatgtatcaacttttggtgtaccttgcatcctgggcaaaaaaataatacacgcacgtaaggaacgcccgttgggttactttcggtcgtgacactcaagatgcccaagccattgaagaagtcgaacaaattaggcaaagagctatttcggctatccagcagtacttgtctcaataacttttgtgtaataggacttaaaaattcttgtaatcggctaagatacgttaataccctgttgttttaacaatcctttgtgccgattaacataacttctaattttcactttcatttttggtatatatgtgccccccaattttataatgtcaacagcattgataaaattagaaaaacaactaagggcgatacaatatcggccgttatatatcggcaaaccataaccgattacaattggaaaaacgactaagggcgatataccaatatcagccatctcaagacgatgtaaaacacatcggctgtcatgcatcagcaacacgagtcgatcatgcgtcaacccaaacacttgggtaatacttcttcaagtatttgccattgagcgctcgtccacaaacctcaccatcaagcccttgcaacatatatgcccctttagacacaaccttatagatttgaaacggtccttcccaatttggtgaccacttgccgaacttgttatcccgagttccaatcgacaaaatcaacttccatacaagttcaccttccaaaaaatccttaggcactactttcttgttataatgcctagcaactcgttccttatctttggtaaccttagcaagggctcataaacgcgattgaaccaagtcctccctctcatcggccataagattataatactcatcgactgtcaaaccgtcttgcaattctatccttctatagccgattctaacttcccatggcaaaacagcttcatgtctataaacaagcttataaggaggaacttgaattgatccatgacaagccatccgataagaccacaatgcttcggccaaccgggtatgccattgccgaggataataagaaatcttctgcttaattaattagatcaagctcttgttagatgcctcggcctgcccattagcttgtgcataatatggtgaagaattcaacaatttgatacccacgctgtcggcaaactgaacaaactcatcggacatgaagattgaaccttgatcagtcataatagtttaaggaataccaaatcggtagattatatgttcttgaacaaattgagttgtatccccagaatcaactttcttcaaaggaatggcctccacccacttggtgaaataatcagtcgccaccaatataaacttatgtcctttacttgatggtgggtttatcataccgatcatatcaattccccaacctctgaaatggccatggcttaagaataggattcatagtcgatgccggagctcgctgaattgccccaacttctgacaatcttgacaccccctataatatctgtaacaatcctccagcattcttggccaaaaataccctgcacgccgaagtaaccacttcatcttatgagccgattgatgagtaccaaaatttcttcatgaacttcgctgactgcaactttagcctgatcggcagtcaaacacttaagtaacactccatcaatcgtccgataataaagctcatcatccaacagagtatactttaatgccttatatctcaatttcctagaagccgattgagacggattatgcaaatactgatgcacatcatacctccaatcatcggctgtcattgctgcaatttcaaccttaacatctttgatcatgagcttataccctgatgccccttgggccaaatcattagcttcaatattttgttctcgagagacatgctttaaagtaactagccgaaactccttcattaggtggtggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatggtataagcaaactcgaaacatgccccctaggggaatttctgagccgatattatcaaaatgcaatgcaaattttttgaggcaaattttttgagcgaatttcaaagtcatattaatcggcacaaaggattgtcaagacagtaaagtactagagcatcttagctgattacaaaaaatttctaagtcctattacacaaaagttattgagacaagtatcataggatagccaaaatagccctttgcctaatttgttctacttctacaatagcatgggcatcttgagcatcagttccagagatgactttcagggacttggttaggtcagcaacatttttgatagccgatttgagccttgctttttgttcttcaattgatt

SEQ ID NO: 37482 - DNA, 522 bp, Oryza sativa
tgttttgccatgggaagttagaatcggctatagaaggatagaattgcaagacggtttgacagtcgatgagtattataatcttatggccgatgagagggaggacttggttcaatcgcgtttatgagcccttgctaaggtaccaaagataaggaacgagttgctaggcattataacaagaaagtagtgcctaaggattttttggaaggtgaacttgtatggaagttgattttgtcgattggaactcgggataacaagttcggcaagtggtcaccaaattgggaaggaccgtttcaaatctataaggttgtgtctaaaggggcatatatgttgcaagggcttgatggtgaaggttttgttgggggaaccgggaaaacccggggccccttgcaaaaatggccaaattaaaccctttttttggaaaaaaaagggtaagaagggttattttttaaaacccccccccaaaaaaggtttttggggtttcgggtgacgcatgatcgactcggttgctgatgcatgacagcc

SEQ ID NO: 37483 - DNA, 909 bp, Oryza sativa
taacatatgctaatcacttgtgttttttttttgaaacggtagacggctggagggctaccggttatattagaaggagaaacaagtgaaacaagagttattacaacgtaataagggagcattggggataatacaactcagggataggcagaaggggaagggaggctagttatgggggcttgaaaacaaaattccgtaaatctatgtcttccttgattagcgttgctacatccacaaaggaattggatgtttgtttgaaaattgttgtatttctttggttccaaatatgccatcaagttgagatcagggcattgaattttgctttgctttgtgttgcatttgccgaagatgtaagaggggcaatccactcaggaactgatccccgtggggtagtaggtagaccaagcattgttgagattgactcccaaacctgtcttgtgaaggtacaatccctaaaaaggtgaacagtgtcctctaatgcccgtcagcagagagagcaaatgcaattacaaggttagtgtcttatgagtagattgtggttgtaagtgctttttgatgtaagattagccatccgtgaaaatgttgtttaggctacgcatgagcagaccaaatgatcttgaaagaggggttcatcactgatcctagaaaatgtacttggtaagcacttcttgttgaaaaacatcttgaagaattcaaggatgatgatatgtcatcttcagtgttttcctccagagtgattagagagagcattgttcctagttggacaagttcatgaatggactccacatttgtgatctgcctgaaagaggttaaccaagagtttttagagagttatgttgcaacagttctgctcttccgttgcactagtgagaaaagatctggcaaaatatcttttggacattggtcttgaag

SEQ ID NO: 37484 - DNA, 436 bp, Oryza sativa
aacaaattattcctaattaatagataaactgacatgccgcatcctctttaaactcggtcacttaaggataaacttcatttagtagattgattttcttaaccgaatatagcaggaatccgactattggcgactttataactcccatcggctgattccgagatgctgcagccgataatgattctaagccgatgacgtctttgccgattaccaaatttcactgttaacacgcgccccgccccgggggggtgggggggtgctgttcgccgattagctttttcgctttgcagatcctaaaattccttcgaaccgaaaaccctaactgagtacggagctggaacgtactccctcagtcccaaaaagaccaacctagtacaacgaatcaatgtgaccctttctaataaaatgaatcaatgtggcccctcctagtacaacgatg

SEQ ID NO: 37485 - DNA, 350 bp, Oryza sativa
caggcacaaaccaaagccgccttgctgacgaggaaacgcctttcgttccgtggacagaactaccaccattgcgcccgtgctcgatactgaggtcgtcatgcaagcccctacacacatcttgttggatcggaggccccgacgactgaatggctgacgaacgggaagtaactgtcgcctctcgtcgagccctcccgctggattacacggacccccggggagcatgcccagactccttgttgggggcggactgctcaccccggcctaggctctgctgttccgaaatgactaactcagcctggtgatccagcccagattgctatggagtttcttgatcttccacgacgggcggt

SEQ ID NO: 37486 - DNA, 458 bp, Oryza sativa
cataagcaagcagctaaccatctatttcctcctttttgcggtgtttttgtttcgctgtgttattgtaattgcttgatttggaataacaggtgtgagttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaactacgaaatgattgagttgctaggcttattttgcagatgcatgcttaaagcaatgttgcttcattgaaacggatctt

SEQ ID NO: 37487 - DNA, 460 bp, Oryza sativa
ccgttggcatgctagctttatctgttcgggcaatacgatgccggttgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccattctcatgccaaattctattg

SEQ ID NO: 37488 - DNA, 620 bp, Oryza sativa
  unsure (1)..(620): unsure at all n locations
ccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37489 - DNA, 655 bp, Oryza sativa
cgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatgctgatgcataataacaaggttgcttggtcttcttgtgtgatcatttctgcttagtttttcttgtgtaatcattttctcctttgagaaatatttgccgatgactgttcattcggatcatgtaagattgttctaccagaaaatctttagattgggggtgaaatgttaaattaccggtaactttcgtgatgctgcttctgttcctgtttgatctcattcccgtgtcgttcatgctgtctcttgattcagtgcttatgtaacaatggacaatttttaggtcgggtacaggtttggcaaaaccaaccaagttgggtgggttcagatgttt

SEQ ID NO: 37490 - DNA, 53392 bp, Oryza sativa
  unsure (1)..(53392): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaacttatgaaataatctgctagatggttgatggattgttgttattactgtcttcccatcctgcaacatgtcaaaaggttaaagatgaattgaactagttgccagctaatgtgtaatactctcatgtcacctcagctatatcatgtagaagttgaattatcctgagagctgtagttgaatccaatccagatgttggttcatcgagaaagagtaaagatggatttattatgatctcatttccaatgcaaactcttttcctttcaccccctgaaaccccacggacgaaagatccaccaatcatcgtgtcctggcaccttcaaacatcatcagataattaattaagctaatttctaagaataggtgcatgctaccatacaggaagtggagcgtttttcaaactacctttcaaggccaagttcatatatgatgtctattgttcgttcttccttttcttgcctcgtcattgttcttgggagacgaagcagtgctgcataagtcaatgtctcctttacagtaagatgagtaaaaagaacatcatcttgagtcacaaatccaatcctgaaaaacgagtataaaaccaatcattcactatactcttggacaaactttgaattagtttgtccatacaggctcaagctcaactttggtgctctgacgatccaaaccattggtacaagcagatgttttgcatataaaaccttgtagaatgttgagggtagttagtctagtcagacagtgcgaaaattgctaacaataaggaaccaggatatctctcagttcgaattgtttgccgaattggaagcggaaaaaggagaatactacatggtttttaattggcgattctactaaagtggtgttatgtttgagtgtctaaccaacttagtagctaggttacaccaacacaatttaaaggactaagcagaagaacaggtggaggtagaggcagaagcagaggcaatcctggtgacaaagacaagcatccaaaggaattgcgggacagagaccctggtgcagtggtgttcaagacgaagtggacctctaaacaccggagacctgtaagctcagactactgtaggcctcaggtgatgcaagtgttcactgacgtgaaacgtgtgcttactaatactacctccagcatcggtcaggagatacatcgaacagcttatcggcaggaagggcatgactggaacctcacctcaccagagcacgctacgacatggcgcagacatgcgatcgagaacaacgggcaggcgactccctgaacgtcccgaccgtgctccgccgcacaagccgccggagtttccatgagacgacgacgacgacgaggcgtcgccgcgcggcgcgcccaagcagacgagaccgtgagagacacaggtgaccaggcgacagccatagccgcgggcaagagccgaccaaaggcatcacggcccatgcgccgggacgcacgattgggccacccaattcggcccaaaaagaacatgtcggctgctcggcgtcggcaaggcccaattctggcgccgcccattagacagaataataatgacaggtgcgcggtacgtgccagaatcggcacgtcagatgtgcagttcccctgcggccaaggcagagggaagctggaagaagaagacagtagacagtacaactgtagcagcgatgaacaggtagccagatttagcgagataaccgtgagccttgccttgctaatctctcctttattatagccagccacacagcctatgcatgcagtatggtactatgctgtgctctgtagctgcaagcaacagctgatcgatctcatctcattcttatcactttcgttccccagctagtgacccatcgaccaatgagaaatttacaattagtggctccatcagttgggctaataacccaaagaaaaaaaccaaaatttaaattttaaaaattaattttgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaattcaatttttataagttgtaataaaaatgacaaatataactacgaaaggtacgataaccatatgtgcatgcagttaggatcagtaggagtgattggatgcatactgttgtcgtcgtcgctgaagggatggagctcggcggaggacatggtgtcctggggaggaggggtgaagccggtgaaggtgaaggagaagccgaggctggcgctggaggcgcggctgagggcggcgccgctggagacgaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggnnnnnnnnnnnnnnnnnnnnctgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcactctaatgctccatttattacgaaatattgacgagatatttaaaaaaaacatactctcttcattctaaaatataactacacctataattatttcaaaatataacaatttatataccaacattttcttttcaaccaatcacaacccttcactattaatttttctcgccaaccaccacttcttaatcaataataatatatttatatttaattttatctatttttttaaataattatgtgcaactctaaaacttttatattctaacggatatagtaattaacgaaagttagctcgaaccttaagcgataaacatgcagccttcccattttatccgtgaggatttctttccggttcattcttgtttcctacccgcagtttagattggccttttatctcctgttacggttatttttttgggatacatggcgtcataattctagcaatccccttcctttttatcctcgtgttgcctgcgcgttaactttcatgaaatttgtttccaatttaaatttgtagcctgagattgcaatcttacaacataacaatttttaaaattcacattgcatcttttgaaatttatcgtgtaaatatggaacatataatgtcaaatacatattaaaaaattaaatattttttatgaaaaatatgacactaaacatattttttttttattttccaattggcgagcccgctcgtgtatttattactttgtcttgttcttgcatgctaccgcaatgcaatgcttgctttctccgtgtgttcttgcatgtataaacagttcggtctgtctatgcctattgtcaatggttaatatggatatactgtttatctttcatttcaatttaaatacatgcaacgggcaggtatgtagagttctagcgtgaggtcaatcacacgtgggtgcggtgcgtctcctcctcgcttcttagggcacctacatgggtttcaaacgaattaagaaatataagtttgaaaaactattttaaaaaactaaccaaaggaaaacaaattctaatcaaagtatttgtgtgtataatattcgtgcgtataaaccttttatatataaatgtatacattgaaatatataaatgtatatatatacattgaaactttatagcacatataaactttgtatgcaaaaacttttaatatagcaacattatgtataaaacatttgatccaaatctgaatcaagcaaataaactttcaatgtataaaattttttatatacaaaaggaaaaaaagtgtggtgtgaaaaaggaaggaggtggtgcacaggtgcatgatcatccacgcgaaagccgtttcgggtagacattaaccaaaagcgagtgaacagtgagtttttatatcactttgagtacagctttttcagaaaaaaaaactattaggagatgcctaactttgaattaaggtgtggccaaaatacccacgacgaaacactacatgcctttaccttcaaattgatattgccatagtcaagcattacatataggaaaaggaaataataaaattcaacaggttacattcgtataagtgcacggaagaaatagtaggttctttctttcgccacgtataagctttttcacgaaacatatcgtttagtagtttaaaaaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctgatcacctgcccttgctaagctgatcgaaagtattagcagctgagatgggtgttaggtggtgtttacatccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatataatataattacagtgttattaaattatatcataatataatttatattaattttttaaaaatctcatggtacacgctatttttcacgaggtaaagttcacaagacgtaatctcctcccgagcacgtgctatgatttttttctaacaatttaaaattatgtgaaagttgcatacaagtttagttttttttaagtagttatatacaagttatatcataactacatagaagttataatataattacattttaattataatgtatttatattaatcgagaaatacttttatagcaaataaatctttcgtggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaaggcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatccccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgaatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcaggttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttactgccaagcttgaaataaagtgtctgaagtttgcactaggaaataactctagaagaaaatcaccaggagatgttccaaaggcatgaactgatgctgagatgtgcatgtcatgttttgcttacaaaatattaacaaatagggatttgcgaaagagatggtaatcatcttaattgatgataatgcttgcatataaggttttcttttttgtaaacatgtgatgtttgacatgagtgaaaaggtttcgacctgtagtaagtgtgataacagtgcaaacccgttatacttagaaccatgaaaccatgactgtttgatatgaaatcatggttaatcgtgtactgaagtgtacattaacgaaaggtcattggcattaacaccaatccctcttttcttgtgccttaactgacaacccagttccttgtcctcgctttgttattcaaacttctttatccgtactctaagctagtctgatttgcagggagctaagttggccggtacaaacttggaatgtgcaaatcttcagcgagcctacttgcgagaagttgatttgcgcgaaactgtatgttgtcctgcttgctgcttgcttcttcttttttttcctctctctcttttcagtctaactaaatagtgaacagtgaaagaatctaaacttacttcttaaactatgttttactttgacttacagcatttaactggtgctaagcttggaggtgcaaatctgcttggagctatcagataataccaagggaagaagcttatatcttctacatttacaattaaactgaaactggtgctttggtacctcgaacattatcttgcctgcaccaacggtttgttcatgagtaaatagtttcttgctaccgattctgcagatagtcatacagctttagtcggcggttgtacatatacccttgtcacattcctctgattcgaaaattcggtgatgaactgttggatacagctagttgcttagtatcatcatggatagaagctgttctagtaggaaaatttcctgcatactttgggatattgttgtgaacaatgactgaaaattttagtgggaaatatatcttcgttaatgtgcatacaattttcttttcatcatatttactcttcctttaagctttcagtaaaaccgggctcaaaagcgaggaaaatcatattttactcttgttcatgaacctatggaacttttgatgatgtagaaattaccacttgtataggctgcagagatcgatcatagatacaattaactgcaaatcaaatttgtttcggttataatttgcgtgcacagaacacttgcgtttccacacgtattccgaaaggaaacgttggcaataggtagcaatatgtacaaggtgaaggtatcgaacgtgtaagctacgtgcaggcttccgaaacttgcacgtcgtcgttcaggggggctcacgcatgcaggatcacttcagtgtgtcagacgcgcatggcgatcaatggtcggagaagccgatgagaccatgtccgccgtccgccgccgacggatccatcatcagcctgtacttggcgtagaagccggcggcggccaccaacgccagcacgacggcgaggaccaccctccacggcgtcttcctccggccggtcaccaaggcggtgccacccgccgccgccccgtcgttggccgcgccatcgtcatcttcttcttccttgtcctccttctcttgatctgctggtgcagcggtttgctgcgcctgcgcggcgccatgatcggcgggtgcggcggcggcggcggccttgggctcctcttccgccggcgacagcttgggcatggtgatgtggaggacgcggtccctggagtcgaacctggcgcggacgtcgccggcgttgcagtcatcggggacctggaaatccttgtggaagcggctccaccggttgccggagacctgccgctcgccgcttatccgcagcttcccgtggttgtcgatctgcactctcagctgctccttcttgaaccctgcaattgcacccgccatccaaaatgacacatatcaaaccttgcattgcatgaactgagcaataaaaaacaatttgtattcggtctaaaagttggtgttgaaaaacagaatgcgacgaaaaacctctaaaatcaaactgcagttcccaaaattgaaatttaattttgttgcggctcataagcgaagaggtgggaaggaataatgctcttgcctgcggcagataggttgatttgaaggaccttcttgccggcctcctcgaccagctggtgcggcggaacgaagtcggtgtagttgcgcggcgaggtggcggcagcagcggcggcggccatggctgcaggtggtcgatcactgaccggtgatcaggtgctcaggctatgatcactatcaggtgtcgattgatcagttgcaggtgtggtcgagttgatttgagaggaagccggtgttcgtgcacatatatagtgtgtggattcagggttgtttggagtgcgatgcaggaggaaggattgcttcattggacggcgtctgcagggggccggccgcgggaatgaagctaccttgcttaattaatttggttgcgctccctcggtgatataccttgtctagccttcgccaacgcatacagatttcccccacaaggaatctgaaccgtgctgttgttacttgttcttgttctcacagtataagtatttcctgcgattttctgtggtttgttctgggcggcactgtcgggatgtcggcagtcggcacggtaaaagaaaaaaagaaagaagaaaaaaatgtgcgtgaaacaccgccttgtcaagccatctcccgttctccattgggccgggcccggcccactggccgagtgaaactgtacagtagacttgcagttccaggttattgaggtcagacgggtcgttgaaccggcgaggacctcaatgaatgaaccaacggtccaaacggtcaaaccaattaactatcgaaccgagggccgccggttcaacgactggtccgatctcaataactatattctgagctgctacagactcacatgcacctgtccagcggttcggtgccgatttttttatcggtcttaagcggttttctcaaaatctatgtgtctagccggtttttaccggttcacttgcgtagacggtcttttaactggatcagaccgacgaaagctttggttccgatccaaccgctgctccggtccggtcctatggttccagccgagccgagccgagccgacgagaagctctagaagagtggcgttggggacgtggacggcgagagcaggtgacgcgttcccgcgcgacgcgggccgaggtggcgagctgcatgcgcctcatgcacgcacaccaacgcaccaaccagcgagttcactctcccatactactagtaccactctactagactccgttcgctgacacgccccgtccactcttgtccacgctgcgccgcgcagtgtcgcgcacaccccaaaaccccaaccaaccaaacaacccgacccgcggccatggatgcggcggcgggcggcggcggcgagccttcgccggcgccgggagtgggcggccggaagcacctctcctccatcgccaaccacgtgctccgccaatgctccctgtgcgtactttctctaatcctaaatcctaatcaaaccctgttgatggttgatttctccatcgtgtagaaactgtgttgttgttgttgttgttgttgttgttgttgttgtgtgtgtagaaactgttgctatcaattcgaaagaaactggcagtgttttccttgtagcagactcatgtgctttgatcttgtacgaacagaacatattggtatgaagcttcactacttgaaatgaagccggattacatgtttgggcattttatttgaccgcacaaactgcttccaaattaaacctctagcgcgtcagttattcattagtaactataccctgtatttgctaaacgtctctagttctctgatccatatgtccaaaacaatctgaatactataatttctaaccatgtcactgtaaccatgtcctgataccattagtaatatattatagcaattattctattcggtgcatgattcatacgtaatccttatagctcgtcgggagtcaggactcaggactagaaatggcaagagtaactaatacggggtcatggcttaattacaggacattggacagaagtgttgatgaattagttgcagactttgagctcggtttgaagactgctgcggtggataactattcaagaagacttgtcgagttctgtatccttcaggcgctgcaagttgttacatctgttgatctaggagacaagatccatgatggatcgcttagtcggttcacatttgatatgatgctggcttgggagacacccactccttcagatcaacaagttaccatggtttgtgatttttttatatttgtgtgaaattgtgtgtttgtgttcttctgaaatctgatctaaactgaccaatatggtgacattacaggagagcatagctaaagaaagagaggataagaaggagccgctcggagcaaatgaagctgtcatgggcgatgagacctcactgttctattcagatatcatgcctcttctcgtatgttaacacatagctgattaaattcctttccgtaaaatttcttcaagctattcatcggtaatgatgtttcaggtgaatgaagaaccaacagttggagaagatgcatatgtgtggtttggatctgtatttcctttggcgtgcgatgttatcaatgctcgattcacctttgaagccctgactgctacaaccgctaataggcttcattatcctgcttacgacaaattcctgaaagaaatggacaagtatgcaaccacttcacagttagatcttttttgcaaacataagcaacattgcatttcctctgttttttaatggataactccattgacttttgatgtgatatttgactattcgtcttattcaaaacagtagtgcaaatatgcaaaaaaatttaagtcaaccttaaaagtttttaatgataaaacaaatcataacaaaataaacgatactgatataatatttttgaataagacaaatagtcaaatggaatgccaaaagtcaacactttcatacctccctgctagatgtcgttcttcttctttttttttaacaaactggtagaactgcaaattatactgataaagcatgagaaaatgatacaaaatatagaacactgaccaccagtccaccacatcctgatggatgccatgtgaaattgacttttttttaggtcttccgaattcttgcagaaggtgtcaactccaaccggaactgaacttgctgaagatgaattcatcttgcacatcgagggaacagcaggaacacaaagggtggtgcggcacattggaaccactagttggccaggtcatcaatctgatcaagagttatattatttctggtttcttcaggtcttagcattttacgttgatgctttggtaacattttcttatgaatgctacattggttgtatactatacaggcaggctgactctgacaaacaaggcattgtattttgaggcttctgggaaaatttcatacgaacctgctttcaaagtcgaacttacaggcagtgaaataggaaaacaagttaaaactacttcaactggtccttttggtgcaccattgtttgacaaaggcatcgaatttgaactgtgagttccctcttgcatttcttatttttgtgttcatatggacaacctacacggatcaattctttttgttattaaaattatcactttgccccttttgcaaagaatatcgacagtaaccattcatctatgcagaccagaacctttggttttggagtttcctgagatgaccagctcaacaaggcgcaatatgtggcttaccctgataagggaagtaatattccttcaccgattcatatcaatgtacagcatagactcccccattcacaaatgggaggtgcattcgagaatcatattgggggtgataaggcttcatgctgcaagagagatgctaaggatgtcgccaccgcctccttctagcttcctagtattctcgctttacgatgagcttcctaaaggtgattttgtgcttgaacaactagcaaataatctgaaagagacgtcaacgataactccgctcagtgcatcccatgtgttcaagggtttgagcaagtcgcatcgggtagctttaagtgcggagatagcaaaagagcatgacaaggactcaaatagccatgaacagcccttggcatcacttgaaaacactatcggtcaagtaagagacgaggctcgggaagtcaccgtcgctaacgttgctatcgaaggaatgaaggaggaaggtatcactgatagccttcttgtactggtggtatgtacatttcttttatattctctttggtattttatctgctcaaatcatttttatttaagccggattgatttaatcaaacttccattcaacggttctaagttctaactgttttttatgcaggggttagtaagccccatgagcaaattgtttccagtgatccaaaagataatctcatgggagaaaccacttgtgactatcagtgtccttgccatgatggtgttaaccatatacaggttagatttatacaccgcatttaatttcaacatacattttactcttggaaacgatcagggaacatgagatgcaaggtccctttttttttcaacatgatgcagagagtgggtcggttttgcgttagcggcatccttgatactggcagcaggattcatggtttgggctagacaaagaaaaatcggtgcactatgctcagaggtgatcatcgacacttcatcggacaagacgacgatggaaagcctagtggaagcacagcaaagcctgaaaagagtgcacgagtacatcaagacagcaaatgtcgtgatcctccgagtatcgtcgatcgcgttagcgaggtcaccaaaggtatcaatatcatcagagttcatcacacacgttctccgatcaccgaatcgttccaccgttgcgattcatttccatgtcatgttaacgcgttccttcatcatcatggtgtggaactctggataattttctgagtttgcagcatacagaaacggtgatatggatgctgacagggttggcgctggcgctggccgtgatcccgttcaaatacgtcctgatcggggtgatggccggcggcttcatgtcgaacacgaggatcgcgagagccatgtcgaacccgcagggaagccggcggtggagggagtggtgggagagcatacctgccgtcccagttcgggcggttgacgggggtggtctgtgaagtgttcgacgaaatgccggcagaaaaatcctcggtattgttcagctataagcttaagtgttcatgtatgttttttgctcagagatgtgccatactgccatcatctttatcacctgtcagctggtgtataccagaaaagaaaaatggcagagcacttaacacggaacactttgttggatgtactaacggttaaataactgtcaatgtgtgttgataaataaaggaatacgtcatatattcaatattcaatattgtggtgccgagtttttgtcagtgacatatggatttagaagaacgtattggcagcggaaatactgctactaatgaaatagataaagtttctgtgtttgttccgaactttcactctgaaacttccgaaccaaaatcaccatctgaattgtcaacttcccagcacgcgattaggccatctgtaatctgttatctccagaacaacatgagagtgaatgggtgatcatgcttatatctgaaattcagaggcaaattgaaaaaactaaaatattgaaacatggataaatgtggttttcgagtgctattattagccccgtcgattagggaacatatttgatataacaaaccttttggtgcacacattatgcacaccaactattttttttaaaaaaaatcttcgcgtatatatcatacacactaactaatatattttttaaaaaatatataaaaaaggtgtacgatagtattacacttatatataaagtcgtaactacaattcatttcattgtattttagctgtaacaaaataaataaaaaaataactatttcaagagtataaatgtattaatttttgtttttttatatatagagtgagtttgaagataagatttacacatagatgtaatactagttgtataaaatatcttagaaatttttagtgatagtttttagttaatgtgcacggtggatacacgaaaagattttgtgcgtacgatattccagtcagattaacagctcaacactagcattgcaattgggacacagtgctaggagcctccgcgcctttccgaagccgaccgccgctccatccgccgagctccttacattcccgggcgcttgtttcgtagcgagtcttgacccagacagacgacgccgggaatgcgccggccattgagagcgccgccgtggataccagccgtttgacgtgagatgaagacgtggggctttgccgtcgccgtgttgccggcttttgccgccatgccgtggcgctgtgcttttgctgttcgttcaacgtgttaaagcgcggccattgttgcagggcgaggtgccgacgttttcttcaaggactgacttagcaattctcttcattctttgggtttaattattccatagttcatcactagaacagcttgacaaatgtgtactgtatgtagcaaccaaaatcttcatgtttgtcgtcttcagagttcagacaaaatggcgtccggtttttgttttgcaatcgattcaaccaaaccttgtcgaaacgatgaaacgatcttaccatgtcaaggaagacaaggaaaaaaccagcaaaaacgtttgctatctgccattaagaacttgacagctagatgagtcctcagatgaatcatgatggcattatcagcggtatcgagtcgtttggctgaacacacaccgtgccaacttggttaacccttttgtttggtagcgcaaacaacagttaaaaaaaaagtactacttcaatttacagattttttttcccagtctatccatccaattaaccaacttaacgaccattgcatgtagtcatgttcagattcggacaacgcacatcgagaaaacgtttgctttgcatcagatatgctaaaattgcccccacacacgcctaacttgttggagatatttacccgtcgagctgtcccaatccaaacgaactctcatagtatatgatggatgagatggatgcatagatggattggggaaaaaagttgagttgcgcatgaacaatccatgaacttggcgaaggaaaaggccacatccatccactaatcccctcatccaccattccacccacacgccgagcgcgaggcggaggcggccgcgtctataaaaccagaggcgcgcctcgccgcgccgcgccgcgttctcttcctccccggagtagaaaccgcccgccatttggatccccccaattcccctcctcgcccaaaaccctagccgcacccccgccgcgcgccctccgcctccgcctccgccgcggcgtgcgggctccgtcgtccgtcggctcctcgccactggcgtcgcgaggcgtcgtcaccggaggtagcgggagctcaggggacacgatctcgaaggcgcgcgccaggacgaacagctcgagcgcgccgcggggggccttcggttctgagataaatcaccccgtccgcatcatcgacgcctccctccccgcgcttggcgccagctcgttctagggggggaagatctcggcgacgagcagcttgggcgcgttcgcctcgatggacgagttcaaaggcccaggggagaaggagaaggaggaggaggccggggacaaggccgcggcggaggaggcgggggacggattccaggtggtgcgcggtaagaagaagaagcggcccaatggtggttcggcttcgggtgctgggtcggggacgatgatggccaaggacaaggcggcggcggcggcggccgcggagccgtggacgaaggcgaaggtgtctttccacgatcccaacattccgcggccgcaggatgtgtacgcaatcagagtgaacaactacaacgtgccgttcgaccatgtctggctagagcgcaccgaagatggcagccgccctatccaccctctggttagtgttctatttcgtcttttagtacctagtttttgcttttgagtcttttcctttttctgttgcttggtgtgtttagaatgaggagctaggaagcccttgatcaaatttcaagccatgacatgaccaaacattgttttacctttttttttgtggtgtttttatttgtcaatcaaatattgatgtttcttggctaaagatcgagccttgtatgggtaagaaatgttttggggatggcctacatctactttggagtatgatcttaagacaagaatgcttgggtattgttgaaaaactataagatggcatgtgcagagagaagcggggaaagacaaagatttcttgaatttttttttcggataatcaatgtgttatttttattattatgttgaaactatcaaaaagtaagcatttacatgttgactcaggcctaattggttaacagaattagtaggaatgctgtattttgtttttcgtaatcatatagagttattcaagatttgttggttttcttatgtccttattaatcaatagtggaaggattgacttttttgcatattcaattatccatgcatgggatctgatgtaatatactctcgccttgcaggaaaaactgccaatggagcagtttattgacagaaatgttcctgaaagtgaacctgtaaagccagctgatttggaggataccccatttacgctagttgaagataagaatggtttagcagacttagctaaaaagttgaagagtgtaaatgaatttgctgtaagcatttgtaattaagttttatttaactttcaaatgaatatatatcatactttgtttccacttgcattgtattatttattaactttcaactgctagagtattttgtcttatgtagatatccccctgaaaaaaattgtaagcatgcttccctggcatgagttcctaatactggattttaaaatatgcaaacaaatcttgtcagtaattatctataaaatgtagtgaaacatagctgtagttgttgggaagtagcttttctttattgggtgggcagtaccttttatgatctggtacattgattttgacacatattgtgtactgagtttattttggttagagcagtaggactctactatttctagaactgttagaccattagctccttaaatgttttcattttacctatcatcataaggctccagtcattaacccaattagcgctgataccctgtaaggattaaaccattttatgtccaatatattgtagccttttgacttaggattcaaatgaaattgatatatgctttattctgaatgacatactgttgcctgtattgtttccctttctttgccttgtctgacaacaccattcactttctgcactaacggcattgcataactttactggattcttgaaaaagaacatattccatactttctttctgttgccttctcggtcttttacatttcattcatgttatgggcatctgttatggaataaaacaacttctgaggccttgcagtgttaggaacttaagctttatttcggttcgtctgttgttttcaggttgacttggagcacaatcaatataggtcatttcagggtttgacctgcttgatgcagatttcaacaagaacagaggattttgttgtagacacccttaaacttcgcatatacattggtctctacttgaaagaacattttaaagatccaaccaagagaaaggtttcttctgcgttctccaattgtttatcattttattgaggggaaattgtttatcattgtgaactcaaatttctgtttacttggtttcttcttgtgcaaaaaggtaatgcatggggctgatcgtgatattatgtggctccaacgggatttccacatatatgtttgcaatctttttgacacaggacaggtattttgattaataggctaataatactaaatactaaaactgtgattcttgattgcacctttaatttacctctttcttcattctccttcaaaatcctcattttcatgtcttataaactgaaccttggattttcctttctaactccaaacaggcttcaagggttttacagatggagcgaaacagcctagagcacctattgcgtcacttttgtggagtcacagcaaataaagagtactgctcatttacaccaacacaattttcaagtatccatggtgacctacctaattatctacaatgagtatttatgaccaaaacataccccttttgtagatatcaaaacgctgattggaggtcaaggccactttctgatgaaatgataaagtgtttaacctatagaccctatctttcatttattttggtttagtcttgcctcgtttttgtcctacatgttttactatttcatccagttttacccacttgcaaataactcctgtacaggtatgctagagaagatacacactatctgttgtatatgtatgacttgatgaggttgagactgcaaaaggagtcgacatctgacaatgatcttcttctagaggtaaaaccttagttcactagtttttccttttgttctgatctgatttttaagtctgtatgagtgaacattattttggtatatcctttttttccccttgaatgaagtatcgctttagaacaaactgcatgtagatcttacaaagtaaccattgtgcgatcctgttcacataaatttacaatctgtttgttagtcatgattcctgaatatatgtgattttcattagtactgacaaagagtatcaaaatagacattctgatcaccagttttcggttatttcaggtgcaaaagcgcagtaatgaaatttgtttacagttgtatgaaaaggaactgctgacagatacatcttatctccacatatacgggtctgtagctctgtatgatgttctctcaattagttcatttcattctatcattcagaaatgcacttttgctaacctcgaagttattttgttcacatttataatttgcgtgaatcccattaacacgtgtattattacaggttgcaagaacatgacctggatgcaaaacagctggctgttgtatatgtaagagaacatcttgttatttgtttacttcattatgatcattctgtctcgaactcgaatagagctaacatgtgtaacatggcattgttcctagaaatgtatttgtagttgctattactattggctgttggcgacagtttctcattttggctatgttcataactttattgacttaaagtttctgaaagcccatatgtccatgccatgtttccaaataacaacttatattttttctaccaattcgggttatttaatttatgtgtgtaataaatatctcacatatctttttgcaggctctacatcaatggagagattatatagctcgtgaagtagatgagagcactggttatgtgttaccaaataaggctttaattgagataggtactgctgatttatttttgtttttacggcacaggacttgatgtattagtttggctaactaactctttcatttccaccccctattgaattcaaaagcaaagaagatgcctacagatactgcagagttaaaaagaatggtgaaatcaaaatatccatttgttgatgaaaatctggaccaagtcgtaggcatcatatggaatgcaactgaatcttcttatgcctttgaaagcagagctgaacaactaaagaaggaacgtctggagcaggtatgtttaggttgatcttctgtgtatttcatatcttatttgtttgcttttgaggatggtggggagaggatcacagaatgcgatttcttatgtgccaattattagcattgacgtttaagcacctttggttgtatccagctaacggacagggttcagactatatcatcacctgagatgaagacatctatgaacttatcaggccagattagatcaatggataaggaaatactgagcgataacatacatcagcaggtaagagataatttcagtgtctgtagtttttgttcgcccctgtatttatgtagttgcattttgcaggtggcacaggctacttttcaagaactgaagagacctatggctttgggagcagtagggaattcaacatccgggggacagagagatttctttggagggttttcaaataaggtataagcgagtgcttgatctgaacaatgaaaacatttaagtgttcatttaaatgcatgcatgtcattttccttttgaattgttgatgagttattggtatagtacattcttggtcatatactgtaaaatgtttaaataatccttttggtttagttctgaatgttttgtctttacaatagttttttgaaaggaaaatgtttgaagaaccttcaatttttgcaatagttatgtcatatgccaccattttacctttttccttcatgatttaagctatgctttcctggaaatgtttttagatttcccagttagcttcatgtaggaattgtagacttatgtttgttatcatgcaattgcaacttatcaataatttacggaattgcagtctgagaagatggagaaggctaaatcctatccagccttttactacccccagcttccacaatatagccctgaagttgggtacggctttcaatcaataaaccgaactatggcgggaacagcacagtctcctactggcaataaggagagggatctccagaaccctagaagacgtcaatctttcccaccttccggtaacataagtgatacacaccagtaattgctctgatgtatgccttcaaattcatccttctgtgcagaaaatagctgtagagaaatggaaactgggctgtttttatccgtgccccctaatatgagaaactatgcctccctcagatttttttggctagactaacagaaatatgagaatagcccatatcattgacattagatgcagagcatgggaaatgccaatgtggattggcttgtgtgtaacaactgacaaacatgtgctgtgcaattgtgaatactggagttgtacaagtggtatactgtaatactgttatagcatagcatcagaatacaaagacagaaatgaacacatagcatcgatgtctcttttctttatttttttctttggacagcatgccttgaattatttgccataatgtctccgtcccgctggcttcatcacaccttctttgctgggtttagtttcagttcatcgtttggattagctgtttatgaatagagatgctgtttctgtctatgttcactctcagggatgaacatagggcctgcactgtctatgttcaaactcagagaggaacattgggcctgcactgcagcggtgaaatggatccgtgtgttcgcgccaccagaatgagcttggggcgcaatggaacatgtgatgtcagttaaagttgcaggtaaggcagtcaccggtcaaatcacggcactcgccaaccaggccggagcatatcggctctgccgtttgtttgctcctatctgtacgtagcacgagctgttttccattggcaacgcctgatcgatcaaggcgttctactcccctcagcacatgacgccaacgggttgcatctgctgacgacaaatcgctacgcagactccagattttacagctgtgttctgcatcaaccatggggaattggcgacccaaagtgccaaaccatcacacgcaagttgccatgatcgatgcgtgaaccggaaattgatcctctaacttgtccccataatttatgagcctacgtatgagtaacccatagcatagtatcagagaacagtaagtcagataagccttttcgatctgcgaccatcaaaatcgaacaaacggcagcacattttagccgaaacgaatcagagatctgccccagatttgcaacctacacacttgacaatctcaacttggctgcctgcaatctgccattccccttccactgcaacatggagatagccccacccaccaacgcagccaccctacggaaaagcacaccgtaacgccgcccaccaacccccctccgaatctcctccgatcccgacgcctatagatgaataaatctcctccctcttctcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcttacatatacaatctactgccgcacgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatgctgatgcataataacaaggttgcttggtcttcttgtgtgatcatttctgcttagtttttcttgtgtaatcattttctcctttgagaaatatttgccgatgactgttcattcggatcatgtaagattgttctaccagaaaatctttagattgggggtgaaatgttaaattaccggtaactttcgtgatgctgcttctgttcctgtttgatctcattcccgtgtcgttcatgctgtctcttgattcagtgcttatgtaacaatgtacaatttttagctcggttacagttctgtcaaaacaaacaagtttggttggttctgatgttttatcatttccttatagagacttatcgacaatcattcattcggtttatgtaagattcttccagcagaaaattcttcagattgggatgcaatatccaggttgttgttagtattcatggtctggaggttggtgagcaagttcttgagtttggtggcgaagagtatttttacttgttgctgtgtctcagtctggagtggactggactcactcagagatgagtgcgacagcttcttgttgcaagccaacaaattctaaacaaaaatgtcatttaacttcgaaatttcaaaccgcacgtttggtaaatctgccttaaagccaggagtaccaaaggtgactacgatcaaatcacaaagaaagtgtatttgactttgttctgtcaatacttaagcagagcagcaacaatcctttttgaatacctcgatatgtcaaacttgtactgtactagtttgtcatccttgttcatttgattatgttttctagttgtgtttctacaataaagctgtaagctgtttagttccagtcccatgttgatcggttgatgcatctttctttatagagacgtgaggaatcccaaatgcattggttgcctttctgaatcttcggcgttttcaagtgagaggatcactggggtatactagtaccacttggtaatcatatgacgtcatcgatgattaatcccccgtttggactcttcgtttggtattgctaatctattcggccgagtggatatttctgtggcacctttctgaatttctaatataattttggatcttttgttaattcttttacgtgttttgagccagaataagttcaggaattttgtgagtcaccaattacccctggaatagctgccatcagaaagcaaatgctctgcttgcttagtatcactgtcagaagtatgtagtatttagatggatattaggataggattaatctgtattgggtccttttaacaagagaaggttatactccaataataagaagcaaaaggtctaagaaatacttactatcgaaatatagtaatctagtattcaattagacaatgttcagattcataaaataattagacaatgttcagatttataaaattgtttagattcgtaatactatatataatgcctaggaccgcagaagtaagaagagcacctgctagctagctgttcatgctgatttctgaatcttcagaaatcaattaatccagtcgtgatagaaaatttttaattcggcccaaaatgaatggcacattgaatcgtaggcccaaatatcaaaggaataagttcacctgaggtcccttaacttgttaacgaatccaattttcgtccttcaaccggaaaaccagatacgacaggtccctcaactatcaaaaccggtgcagatgaggtccctcagcggttttgatggcggttttagctgacgtggcgcctatgtggctaatttgactcggtattcgtcccacgtggcattgacgtggcgcttacatggcaattctatccccgaaaaataataaaaactatgggcccacatgtcagttaaaaaaagtgggcccccacaagtcagtgctctctctctctctctcacactcttctcatctggacccttgccgtcgacttcacttcgaggcgttcgggctgccgccgctcgtcccgtccctcgacccggccgtcaacatgagcagccttgccgctggcgcatgcttcgcctccgccggcgccggctacgacaatgccacctctgatctttttgttagccttccattagagcaaaacgatagctagcttagctacattttcatggtgttcttaggtgacatcacacatgacatccatggagtaattttgtgaggtcgcgtcgtgcatcggtgctgccgatgtggaaggagctggactacttcaaggagtacgcggcgaggcttcaaagcttccggggggacgacgacgcggcggcggcggcaacgctgtcggaggcgctctacatcgtcagcatgggcaccaacgacttcctcgagaactactacgccatggcgcgcgcccaagcggcggagtactccacggcggcggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgtcggcctccaggacatgatcgcgaggctcaacgacgagctcggcgacggcgagatgatcgtgtacggcgacgtgtacaggccggtggccgccggcggcgtacggggtggagaacgtaggcaacagcaccgtgcccacgcgggtcaaccggcggcggctcacctgtgccatctgcttcgacatgttcgcccccggtaggatgaggtcggcggggtgctcccacagtcccactacaactgcatcgcttcggtgcccggacccgtcctgctcagtcgccggcggaggcgagcgcggcgaccgttcctgaggagggcgcgggggcggaagacggtgctggagaacggccaccggaggccgaggcaagggggaagcggcggcggcggcgggaacatgcggaggcggcggaggcaggcacggcaggtgacgaggagagggcagcggcagccggcggtaggcccatgggggcgggagtggaggaggccgcgcctcgacgctgtccgcatctccgccggtgagaggagagaggaaaggggagagatgtgaagataggtgagatggggagagaggaggaggaagaggaggggattgagataagaagagtgagtgagagagagctgacatgtgggacccacttggggcccaccagttttttttaactgacatgtgggcccatggttttttattattttcagtgatagaattgccacataagcgccacgtcaaatgccatgtaggtgccacgtcagccaaaaccaccatcaaaccgcggagggatctcatctgcaccggttttaatagttgagggacccgttgtatctggtttttcggttgaaggatgaaaatcagattcgttgacaagttaagggacctcagataagcttatgccaatatcaaaagataaggcccaaagtaccctaccctctaggcccaaatcttccgccataatgctccggcccactaaacgagacgcgggcttaccgcgacgcggtgtgcgtacatcgtaagcagcgggctcctccgcttaaaagctaagctccccaatataaaccgcagtcagggcgaaaaaaagaaagaaagaaaaaaaacaaacgcgaaccgactgcgagtagtaagtaaggctaagcatccgtctccccccttctcgattgttctcgatctgcggcggcggcggcggcgatggccgacggcgggaagcccccgacgccggagaagaagtcgtgggccgacgtagaggaggaggaggaggccaaggcgaaggcggccgcggcggcggaggcggcctcctcgtcttcgtcgaacgagccggcggtggacgcgcaggcgaagcagattgaggcgctgtctctctccgtgccggaggagcatggcggcagcggcggcggcggggacgaccagggcccgcctctcctcgacgactcggatgagtcccaaatccaagccgtaagttccgcgtcggcgctagtgctgggtggccaatctcggtggagtcgggagctgctttctagggtagtttggttgaccggccgattgatttcgaggtgttcctgctcaggtgacctcgggcggcacggtgtacgagtcggcggcggccttcgaggatctgaagctgacgccggagctgctcaaggggctccacgacgagatggggttcagccggccgagtaagatccaggcggtgaccctccccatgatcctcacgccgccatacaaggacctgatcgcgcaggcgcacaacggctccgggaagaccacctgcttcgtcctcggcatgctcagccgcgtcgaccctaaccggaaggtcacgcaggccatctgcatctgccccaccagggagcttgcccagcaggttgattgagcacacatacttctattatgtgctagtatgtggatttttttcttttcttgttatggatgtgcacactgtaatgtactctgtttgttttattgtgatttgcagaataaatcggtgcttatgagaatggggaagtttactggcattacctgtgcatgtgcgatcccaccggctcagaaagattatgtgccgatcgctaaaatgccaaagattactgaccaggtggtgatcggcacttctgggacacttatgaagtggattaatcataagaagatcttgacaaatgatatcaagatacttgtgtttgatgaggcagaccatatgcttgccgaggtatggatgagttctattgctgttcctctatccaaaacttgtgtatgcccattgcccaatgttgttttctattatttattttgttattattaggagaacgcctcgtgtttagttattagggacatttgggttagatattaatcttatggaaagagataattgattattgcaatttctaagctgtataggaattgggaacaatgaagcaaaaactgccataagctcgatttgttgtaagatttttttttttgacttaacaagaataatggtggcttcatgatgattgattttcttactcgaagtggcataccaaagattatctatggcctgtatacacagtacgtggtgtttccattgatattacagatcgggtctggttgggatgtaaaaaggcttaatgtttttttcaactactatatttgccactggtttgtgcagcattgcattatattcattattaagaaaaatgaaaaaaataataatgtattggtccattgttgctacagtatggttctgattcgaacggaaaattgcttcatgtttttcagtagatcaaatgatattagcctttcctaatagaaaaatattttggtatttgcatatgtattatctagattagaagagattcattcatatggttatgttttacatttggtaagacataatccctcacatgactaaacatttgtttaaaattgatgttgctcgtatgtttcatacttcatatctgcttatgcactcgatgagtttatgtattatgagttgaatagctttattttcacgcaatctaacttcacattataaatttcataaagtccaattccttataatggtgaatgcattctcgcaggatggcttcaggagtgattctgaaaggattatgagggatatacaaagaagcgctggtggctgtcaggtaacatttttctggtcacttttaacttcctttgcttgagtaggtccgtcacatgaaacagcttgaatgctccttatagaaggcgatctggatacagtttgaaatcagatatgaggttaatatgtccattctgtgttaagaggatgttttaggagaagcattttcctatagtctgcaagtatacatgtaaatatgcaattgcttattcaagaactccaaccaatgcttatgatgtaattggagaactcctttgcttgcttgcaagtagtggaaagagggtctaattttaaattttttggccattgatgatttttttttttgaccaagggcagccattgatgattttatctggtttgttcagcaattttgcaagatcattcagatgatcccaaatataccttttgagttttaaactagtcttttccatgtcatgtgatcatgtgtggagttgattgtccaatgtgtggagttgttatttattatttgaactgatggctgtcaggtgcttctcttttctgcgacattcaatgagagagttaaagattttgttacaagggtcattaaggatgggaatcaaatatttgtgaagaaggaagagcttactttggaaaaagtcaagcaatataaagttcaagtccctgatgaaagggcaaaaatagcagtcataaaggacaagatttttgagtttggacaaaaagttggacaggttatcatttttgttagaacaaagcaaagtactaaggatgtccacaatgctttgacattagaggactatgtatgctcctcgattcaaggatcccttgaccaatcagagagggaaaagataatacaggaattcaaaaatgggtacaccaaggttcttatatcaactgatgttcttgctcgaggtttcgaccaagcacaggtactatttgtgtttgttgactttatacttgagcaagtgtaaatcttttctaacattcttcctttgaaaggttaacctcgtcatcaattatgacatgccaatcaagtttggcacaagagatgaacctgattatgaagtgtacctgcacagaattggcagagctggtcgctttggccgaaaaggtgaaattatttctttggttctcttttgtccaaaaaggaaaaaaaaatgtcgtggttataattcaatgtttagtaagtcttcgattaataaataatgagaaatagtcaatatcagaggtggcctttataaggtatgttgaattgctgatcaacaatttcggctgatggatccaagttctaagaggtcttagctgagcaaacctgtcttgtggtgctgacaaatcttgcctatgtctagtcgaatacttaacataatgtatgtgtcttagactgtaagttgagcctgagcttttcagctgttttctgtggataagatagaatgtaagtggcttggtcaattataccaggtcatctttctatgatgggcaatgatgtgtcttctggtgcttataatcaaatttttctggacttatttcatggtttatgtgtttaacattgatagggcttgtagaccaagtgatgctaggccaaccaaacacctattcaaattcagcccttctatattttagtacatattctgtagcttatattcttaactttgtcattgctggtgcaggagctgttttcaacttgctatgcggcgaaacagataacactgtgatgagaaagattgagacctacttccagcacaatgttcctgaggtgtgtaactgcaagatgcatatgccagtatcttgtgctcctaagcattagcttattgtgttctgttcatttgtaggttcgtaattggcaaagcgaggaagattttgaaagagctctgaaggatgccggcttggttgagtaacaccattggaaatatggcatcagatgcgctcttcacttgtgacgaacaggcgcgtgatatttaccagctgaaacagcttctaaagcaaagcaatcgagcttcttgagctcatccttggttattatgtcgagagctgtgaattctgttaaagggactcatccaaacaattttgatgctatgagcttatatgaagcaaaggtgttccttcgctatttcgtgggaacttgttgccaggactagatctacacttgcattatactctgttacttcgtgtacttaactgggaacctgttttggtttttatggctttgtcgtcgagatgcggtcaccggtgtacgttacgcccttgtgaaaaaactggaaacctctttctgggtcagtgtacttgtacacttgcgccattgtttagttgcatgtacgatgtttctttctgcgtcagctgtaagtgtacacttgatttattgtttagttccatgtaccatgttctttttcctgttctctgtacacttggccacgctgatacatgagatgcaccactatctcttcctgcatgctatcgctttcagcgtgtttcttgtttcaaagaacaattcgtgtataaattggtcgcctttttcactgtcgtaataatgaaaaaaaaatagagaagaagttacaggttgtcgtgctcgatgacctgcgccgccctccactcctcgccggggttgacgaccaccggcaccagcatggacgccgtcccggtgcacaggaagtagtccttgccgaacttcctgtacatctcccccgggctgcacaggtacatgtcctcgtaccccatcctcaccaccctgaaccccagcccgctattctgcaaacgcatcaacaaattcaaagatcaaattcagttcaatttcaaccaagcctttgatgatctttttttcaattctcagaagaaacaaagttcttgacgatccatgaagatttcttggtgctatgatttttcttcaaaaaggaaaaaggctttgtctttttatgatactctccatttcaaaaattaacaactaatgcctccttcaaatgtttgacgtttgaaccaaccaacatcgaacaaaaaaagaatagagggaatatgttatgtcaaatacggattgagatcctctgactttacgtcagaggaacgtggtgactggtatgtggaccccaccgctctcgggcctacctactagtgaccacatcagggataactttacgtcagaagatccctcaacatcaaatacaatactagtctgttatattttgggaaagaagaattatacgaacatatgaacatttcttggtggtgattttggttgtttacctgatcaatggtggtgaatttggagggcgccgtgctgtagatgcgcttcttcctctcctccggcggggccgcgtacaccctgctcaccttcttcttgaggatggtgtagaggttgtcctccacggtccacaccccctgccggggctcctcgccgccgccgccgccgaaccatccgccgtcctcccgcttcatggcctccgccggggtgaggagcgcgaagccggcggccggcggcgggtgggagcagtaggggcatccccggagcccctccaccgccgtgccccgccgcttgtcgaacttgatgtggctcagcatcgcgctcgtcagcgacaccggcttcttgccgttgttcttcaccatcaccgccgtcgccatgctcagcgggtacagcgtcaccacgtacgtcacctccagcgtcccgctccccttggtgcaccccagctcaacctgcaaatcttagacaaattttaccccagatttgaagtggatttgtttgcctcggaacgcaaacaagattcttcaggtttgcaaacatttgcaatgccaacatgtaacatattaaggtacatagatttttttttttacctacatgtaatcgcaccatgtttggcacagctttggattaagatttcttagagctggatatttctagctccacaaatccattaaccaatatatgtttatgttgatataatattattttttttgactgaaaaaggtagagagactctaccttataaccattgtattaatggtagtcaaggtgatatataaagaggtacaaaagaaccggataaagagggaggaagaagagaaaataagaaggagaaaagaagaagaagaagaagaagaagaagaagaagaaatacagaaaacaggagaaagcatggaagaactagaaaagctagctacgctagtaagtctatccatctgcatattggaggtcgacattgtggcttaatgtgattttcccataattgtagacattctctgatttgatgtgtcacatttgccgtggtaagatctcgctgctggaatgttctatggttgcgtgctttccataagttgtgtgtgcaggcgccaaagcatattggccatccagatttgagatgtgagggcgtaattgtcaggacctgatcaacgaagtggagaacgtctgtgctttgagttgcctgttcatagatgttgagtttcttccaaaccttagaagctagtcggcagcgcaatatgatatggtctgctgtctcaatggtagggcagacagcacaatgtggatcagatgcccagcatttctgtaccctattgtcatttgtgttcagtcttcctcgaaaggccagccaaagaaaaattttacatgtgttcggtattgctttgatccatatgaaaggagctgggcgccatagaatgccatgatatgttataagcctgtagtatgctgctgttgttaatccaaccgggcttagtgtacagcttcttacgtcttgttcagtatgctgtagttgctgagaagctagaatcgtcatgagcgaatccagctcagtttgggcttggcgagagagcacagggtgaagatccagtacccaattatcattaaccagctgagaggaggcggtgcagttgatgtcgcgggcaaacgaggccagggttggaaaggtgaagcaatgatgaattatattgtttatattttagataaaatataaaattttaactactataaagtttaacttacaaacttgagttatgtcaaacaggacctaagctaaattggttttgcatgtacattcattcttgcgtgttcttgttttgaattttgtaaatttcccaaaattcgttcacaaagaaattcgcatttgcaaacatttgggaatcgcgatgtgaaccagcaacataggaaattgaatattcaagactcgaatgcagtcgtttccttctcattcctcaaatatcaatcgaatatgatcttgcacgttcatgttttgaatttttttttattgtagagtccgtaaaattcgttcaaaaatcattatgaaacgattttagaatgggaagtgtacctgcactgcatcgtaggagtcggagtcggcgtccacgacggaccactcggagccgacgaggagcgactcggcggcgccggaggaggacacctcgctgagcgcgagcccgacgccgcccttgacctcgccgccggcgccggcgccggcgacggtgtggagcacctccctgcacccgtcgtccttccagtacaccttgggccggtacgaggtgaccagcccgtcggcgagccggagctgcagcgagctgccgttccgcacgctgagctcggcggtgggcgcgccggtggccgggtcggcggcgaaccggaggcccttccgtccgaacgactcctccagcgactgcggcgtcggggccgccgccgccgtcgcggcggcggaggccttgacggcggacggcctcgtggggaggtggagggggagcagcgaggaggtggccatgggtgggttggagtggagtggagaggcgggggcttgggctttcactgcagcctcatatccgcgaggcttcaggatagatagttttttttctcattgtctgcttgtttgcgttgctcccgcgcgttttttggcgctttttttgcacaggagatattggaggggtggtgcgcacgcgtacctgcagtctgcagtgctgcggggaagtatccaactatgcaactcctataaatggacgtccgagattcattcacgtcaccatgagttaaaaaatttaactcccagtaaattttaactcatgagtgaatctgcgagttaaattttaactctcggacgtccatttctcgatccaacggtgtaagatgagagttgcatagttgcactgaattagatgactacacctgatacttccccgcagtactgcagggtttagccagcgatttcattttcataaaacaaagtttactatctcgattagtctaattgtaaatgtaaatacgagcattcgtattaaatctagaacttgattacttgaatgtgtttaggtgaactagtgaatgagttcaagtaaactagttacaccgtaatgaatctaaccaattgaactacggatcacttcgtgattgaccaacaaatttcaattgtttttgtggtcgatttacaactagacattcgagctggacatgctcgaaactcgccgagattgtgaacacactgcagcgacgaagtaggctggtggtcatgaacggtaagaattcacaagtactatttgctgggtggttcaaaataaaaaagcttagaaaatgatggtgaatcatatcgggaagattagacttaaaataatatgttagtaacattttagcacaaaggtcaggatggccgagtggtctaaggcgccagactcaagttctggtcctctaacgagggcgtgggttcaaatcccacttctgacaatattttcgatcatttttttgaaacttttgctttaactttattatagcctggacactaatctttttcaaacagcacgatatatcgtgtctttcacaaacaaaaatagtttctcagttttttttttaaacttttgctttaactttactatagcctgaacacttatcttttccgaagagcacgatgtatcgtgtttttcacaaagaaaaacagttttaatttgttatagcctggccaccaatcttccccgaacagcatgatgtacagtatcaagttttcagtaagacagcttgcgaatgttaaagcatccgaaacctgtgcgtcctgcagccagttaaatgcaacgctatggacgacgtgtttgtttacttgcacagcatggttagcgcgcgtcggtgcacaagcaaagtctggttcgcacgcgcgagcgcataggcgaatggtgtttggttgccaacacgactactacattcatcccataaaaaaataaaataatatcagatgtgacacattccagtattacaactctgtacatatctatattcagattcgtttgtactaaaaaaaatgtcacattcagttctagattcatttttttaggaggagggtatatctcactacgttggatctagtcatttgtgacggatccaaatcctcatctttaacaggtatactcttcgttattgataagtggtcagtgatgactaaacttattaggatctcacttgtgacagacctaaatcttcatctgaaataggcatacttctcgtcattgatgattcaaccttaacaggaccttacttgtgaccggcctaaatcttcgtctgtaacatactaacatgtatacttttcatcactgataagtaaagcaaacgcaaaacagccgtccgagttaggtaagagggaaacgcgagaaactactctatgtaccaaaatataagaacctattcgatgtttcttatatcttggcaaacatcttatatttaggcatggagagagtagctgtagctccgatcctcgaccagactgacaccatgcaacacttgagcgggaggcgagaccggcacgcactgcaaccatgcaacatctcagaaaaacggtctcacgaatcacgatccctctcaccttccaaccctgaccgcacttgagcagcatatcgtctactcctagttggcccatgggcaccacatgccgatgaaaccacagttcctttctcatcgtaccaagtagcaacaatcacagtggtcaccgtattatactagtactcctttttcagcaacaggtagtagtagtagtactgcagtctgtacctacacttgatcggttcatcaagcagaagcgatagcagcactgcactgcagtctgcagttaaagtgcttggtagtaccatccatccgcttagctatagttaacaaataaagggccctgaaatgataatactactagcactactcatcaagcaaccaaatggaatgatgcaagcaatgccccagctttagaacagccgcgaaaagcagtgagtcagcttcgcaatagctgcttagtggagcacttagaggcgagaccctgcatcatcagatgtatataaagcaagattcttttaagtaaaataaatagcaccaatctaacccacttccagaaccactcaacaacgggattatagtactccaccccccactgaataagcgcgaaacgcaacgcaccaaagccagacatggtctttgcaacttgttgtctttgccgctaggtttttttctggcattttcgacgatactataaacggagtcttagagcgagctaaaaaaaagcaaaccgaaaacgggaatacggcaaaagaaaactaggcaaaactaactagccaactgctccccagtagcagccaagcagcaggatcttgggcccgtgctgccagtttcacagataagagttttccagaccatcagttccttgggaccacatgcctgttgagttcttcaggaccgtcttgttcttcatggctagctagggaacatggggtatgtgatccagttaactagctttgacggtgccgttggcaagggcaggcttctcagtcgctgctgtttgggcgaccttcgctgcataggtaacgactggagctgtgccgttctctgcaggaaccttcagttctccattgacgccatttggtagctttggcttcgcagtagcagcatcctgctgcttctctccagtgacagaacttggagccctactgtcccagacctaaaatgatagaaccgaccattagagttaccaaagaggcataagagaaaccaaggtgcacagattgacaaaagacaaggctcaggcttatatatacctgcttttggatctgctgttgtttcaccctcttttcctgcatcaacttctgacggttctcatagaaagcaaagtcatccaagatggaggtcttactgacatgctccttgaatatcttaagcatttgaatgccttggtcaaggtttacctgaaatttaaacaagcaggtcaaataagataaccgcatggtgtggctttttggaagtcaagaactaatttggacaaatataaggtacctcttgtgtgtcacggctatttgtcactggcttgttctcattgttctctaggatgatgtgcttgagaatattgttgggcacatctttgacaatgtgccacttgagagataaggaaccattccacttatcttgttgccagtactccaaggtcttctcaaaatcaacagcgccagtcatttcagcaacaccaacaaactgcccactagtattaaccttaagttcacagcaacaaagacaaaattaggaaaaagaaaccatgattaacattcacaaatgaatacaagacacaaataacttaccgagaaaaacaagaatattgggcatttggagctcttagcctgagcttcctgataagcagcatcaagcttcttgtttccattagtggtacttgcccacacattgtactttatgctcttatggatatcatcctcactgtatgatttaatgacaaagaactttgcatcatcatattggacagggaagtcatctcggttgaactgtgttctatcaggtacatcagtagcattcatgctgtcacttgtaggaaggctctgccctttcacagcaatagtgacagtatggccaaacaatttctggttcttgaaacggcctgatctaggacctctgttcaactcaattgttccatcctgactctcattgccaaaaccatagtacccgttaccacggcctcttggcttgtacctgttatccatactaagaccccaccgaccatatagcctggaatcataaccattactaccatagccattacttccataaccatttgtgctgtacgaaagaccagttttgtatgagtttccatactggctgtaagaccgggtgctcgggtacatcctattcggatatgtaggagcagctgatcctgttgtagttgtaggtcttctgttattcatgccctgcattacagagaagccaaataattcagttcacaatcaaagccgtagcggatcaggacagtgcattcatacggagaaaaaaagaacatgttttcgtaagactcaccatctgctgaggtgtggagcccttgttttgagtccttgcagaagagccattactgaatgttgaagacgacatgtgattggttgtagttgttctctgctgtccatttgtataagcagaaccatcataccatgcaaagtgtgctcctgtgctgtcatacccatatgtagagtccaggtaaccagcagaaggaactccacctagcaagggtgccctataagttccatcaggggtcagtgatgaattttgctggcttgatccaaggggtacagttccactgttactgtgaacagtaccattaggagcaccatttgtggttgttttagctggatctgccttagctgttggcttgtcaggattggcagaaggctgcaggtcgccttgagtggtagaaggaactggtgtaggaggctgataatacgaagttggatactgatagtgctggccaaacatttggccatcaaccgttggaactggggaactagcaggggagtatgcaccataaggagcatacccatatccataaatatctccatatactgcctgtgaaattccaaaggccaatcagaatagttgatagcacagcacgcaagattctcatgacaggatatttagtggcagacaaataacagtgaacacaaaagattcacagagaagcaatagtgcacagagcataagcaataagaagaagaaccacagataaccaaaccatagccaaataagtgagtgcatagcattccacttattacatccaacaagatttgacaggacagctcccaacagacaataatagcaaatatttggaccatttctacattaagtatatgacacatggtgcaatttatggtcagcaatatcacatggaaaggaaaaggtaatattatctaagattaacttactggggtaatctccactccatctggatttacatatctaggataatcatcccactcgctcacagatccgtcgtaacctggtaattttgcaaaccagcacaattctgtaagcataggagaaaccatgaaagaagctaatgtcctataaatagccacagggcttatcacagcgctaacaaataggaatgaacaagaaaaaaaaagacatgtcagccattcaaaatagctgtactcaatgatcaccataagaatttttccatggttcctcacctccatagtagtatgctggcaggtagaacatgttgggatccataaaatcctgaagcactggcgtgatggaccgctcaggaggaatcgccacgctaagaggctggctggctgcaggcccctgctggattaacagtcaaaaatcaccagaaccacacgtattagaatcacatatcaccgacagaaaaccaagagcatacacgcaaacatcaaggatccatcatttccactgttttatccaataccttcttagcgccggcgggctcggtggccgcatccaccgccttgggctgcgaatccaaagacaacttctgcagcagatccgtggtttcttccaacagcaaaacaatgaattaaggagaaaacagattcattcagatcccaaaatccaatccttcgaactaagccctactaaacatcatgataattatttgtgtatgaataaataaataaacaattattcgatttcacaatcaacagaaggctaaaaacagtaaacacagcccgatctggagaagtcaaccctagcacgaccacgctgagacccccgggcggtagacggccgccgtacagcctcaaagcaacacccagcccaaccaaccctcaagccaaaaccaaatccccaaacccaaaccccaaaaacctagaaataaaataatcaaaagtcacaacccaaaggatacgatccgcgacgggggcagcggtggcggcggcggcaggagccggggcaggaggagcagcagcagcagcgggcgccggcgcgacgaccgggacctgaggcggcgcgacggcggccatggctttggctcacgagatagatcccaagcagagaacacccggaggcggcggcggcggctgtagatccggcgagacgagcgagcgagcgagcgcgcgcgcacccggccccttctcctcccttcctagagatagctaggcgcggcggcgcgggtagagaggaggatgaggcggcggcggcggcggtggcggcgggatgggtggagaggcggagccggagcagcgaggcggctagcaaaccggcagtacggtgtgaaaggggaaaagaggagggttttgggtgagggtcgggggctcatataggataggggaggggggagaaatggagcggaccactggaccacgtctcactggacgccacccgcattggattccactcctctccagtttccccctgattttttttctccctttttagtgataccgattaaaaacttttttttcttgggttttttttcttttttttttaacgtggatggagaatgggtggttagttatttggcttatggcctaatggcttgtcatatgcattctgttcacttcgtaggtttgcatttgctcttaaaaaagaataagactacgaagcaagtaagcgtatctcaactggttagctagatttcttgtggtggaaatagctcgctcagattcaaatgttcgtgataacttcgtcaaattcaagttatgtcggttcagttttcgggagatgctaattagtcttttagtggtgacttcttgaatctcaagatatgctacgtgtatgcgtttagaatagtgagtgtgtgtacgttgtgagtgtctgtgttttgtactgtgtttcataaaaagttttgtatttgcttactggctaagtaaaatggtttgacatgttataatcacgttaattgcatggcttaatgcccttgataaattttgaaatgtttaagttgttttaaaattattctatatatttttatcattttttcaatcttggtttatcacttaaagtagaaacataaaaccctgactcaaattattttatattatcttatttatgtctctacggtttatcaactgaagccaaccagcttgaatatatgatttttttatccaataaactcatagtgcatactgcacaaggagatggcgatttacttgtcatcaattttttagatagggaagaaatcaatacatggatgttttagagaggggaaaagtcaatacatgcctatgtagtaaactgctaagcaccgtgcctaacaacaaccgcgtgagtccaatgactccaccccaccaccgattgcttgtctccatttgcacccgctccagaaacccctacccctttccaagcccctatacaacacacacaaaaagaaaaaggaaagaaaaacaaaacaaaacaaaaaaaattataaaaaaaaacgcgttcagcttggaggaggaaccacggcgcactggacgcgtccagtgatcccacgcggccacgctatgcacgcgacgcccacatccaccacactaccacagccacagccgcagccttcctttctttttcttctcttttttttctttccttcgcggcggccacagccagcagcgaacagctttttttttcctttttccttttttttcttctcccctcgcatataaaacaaaccaggataagatctcgcacgtgccgtgcctgctcctccctcctcctgtgcagccatcaaacgcggggtcgtacgaactgagatgcgaaaaaacgcgaggaaatcacgccaaaaaccgtagcaaatcccgtccccgaaatggatccgtgtgccgtgagattctcccacacaaattccatacttcccctccacggccgcacccccaagtccgtgagatctataccctgaaatcccactgtttcttcgcaaagatcgcgtaattttgttgttgttgttgttgtagatgccgcgtgtgtatcgtcctgatctgggcgtgctacggccgtgcaaccctatactggcttgtggcctcgtcgccggggaagtagggcggtggacgtcgtcgtcgtcgtcggagaggacgacgtggaggaagccggaggtggggtggatgaagctcaacttcgacgggtcgcgcaacgacgcgaccggggcggcgagcatcggcggcgcgttccgcgaccacgagggcgcgttcgtggccggctacgcggagcggatgatcgtcggcggcgcgtcgagcttcaccgcggagctcgccgcgctgcggcgagggctcgagctggcggcgaggtacgggtggcggcgcgtctgggcggagggggactcgagggcggtggtcgacgtggtgcacgggcgcgccggggtgcggtcggaggaggaccggaggcagtgcggggagatcgccgcgctgctcccggcgctcgacggcgtcgccgtgtcgcacctgtgccgcgacgagaacaaggtggcgcacgggttcgccaagctcggccacaaggcgcggcgccgccgggtgtggcacgtcgtgccacccaacgaggtactcgtgttcctgcaacgtgatgctgatagagggtaaaagtacaaggaccgaacaacacaacgttagtcgttgatcgatgtgatctttctctgtaaaaaagaaagttaactgagaattaaacaccatctaaccgaatctgaacacgaggttatcggtaacattagtcattaatcgatatgatctctatctattgattgataatgatctctctctgaaaaaaaaaattaacctaaatgagattttaacataatataaaataacaaatctgaaacatgaggttgtcctaggtggtaatgttagttgttgatcgatgtgacctctctaacattgctactctattaaaaaaagcctatctaaatgaaaatttaacaccacctaggacaataaatatgaacatgagatttcttagagtggtatcaaattctcatttagattggtttattgtgatatggaagaattacttcagctttgggggatttataatgagatacaattccttgtcattacttcgctctgataaaatcacttttatataaatgcggtagctcatattttgttgatttgcgctggacagcttaaaataatgaatgacgaagaatttgtaggcacagtacagtagtgcgtgcgtagtcggattcagtgtcatcttgcccttttttttcttgggtaatgggatattatctgacgtaacgatggattatgcagcataatttcgttttctaattacgcacggctgaggcctggatgcacacgtgtcacacctagcgaggaggagtctgcgtcagatgtcatcctggacaaggaccttatgatagatttatggatcatgtgcatgattggtttaactgtttccatcgtaccctacgtataagattcttgaaattgcccaatttgtgtacccctacagattttttcatagggtcaaccagagttgttggtcaagtactactggagtagtagccggcaacggcagtgaaaatgacgtgccaagaatgaggccaggatgggacatgcagctcactcactaatgcaagggcattcagagtgcatctagctaggagtcaaaacgaatcgggttcgatctgatctcactattttataatcggaattgggtcgaacacggatagcgccgaatacggatacaaactcgaatagtatcgggtaaaaatacggaacgaatacgtaccaaagtagatacgtatattatcggttacgaatatttatttggatatcaagtcgaaataacaatcttatatatcatataaacaataaccatttaataattacatatatccataatacgattatattagaccattaggaccttaggtaataaatatggtacaatatatcatagtaaaatcaatacatagtaccagaaagtacctcacaaaaacataatacggataatatccgtataattatccaggtaacacccagattttttaacggataattcatttccgtcgggtactacgttcccgaacatctcatatccgtaaaaaaaagacccgtatttgaacccgatatatgtgaaaagtcccgggtacccgaatttgtctcgaaataatatgtccgagcgggcggacgagaaatacccgctctgttttcacccctacatatagttgtcattcagtccaagccttccacatcatggatatcacgccatgcctgcttcaaggtgccaaatgaagaatgcggaaccaaataaagacccgcacagagcagggcaatctttgcgcgttgttgctgccgtcgaagcttcacacgtggcagatgaggagaagggaggaagaggagatggcggcgatcgagctgttgccaccgagacgttgtctatgagcttccgctgcctgaggtcgatccaaagctggccaaccgcctccctcggtccgtaacggccaaggttgacccagagcagacgagcccgatcagctccgtcgaggttgatccagagccgccttcctcgatccgcgccaccgatgccatttcaccgatgagagctcaacagcggccggagggatgggggaggggaggggaccaagggaggtgaggatgtcgctggcttcgttaggctcaccgctgtagaatcaaggaggccgactagagggggggtgaataggcggttttaaaacttaatggcacttaaacaaaactaacctaagttgctaggcaaggtaaggtgcaaggttaactaagcaactaagttaagttttgcaaacctaggtgtcggtgacatgggaccgggggtatcttgactagaggtttggggcagccgcggtcacccacgtggcctgaccccctcgggggggtcgggcccgagggtgatgtggccgcccctccctttgtctccccgaggggtcgggccgctcccgtttcggctccgagggctagggcgccccgaccccctgtgggtttggcgccacgtgtgtgggttaggtgagcacagcggcgctcacctaaccgcgtttattgcgggttggacgagcgtcccacaccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctttaggcactgtccctagacggaaccgg

SEQ ID NO: 37491 - DNA, 13549 bp, Oryza sativa
  unsure (1)..(13549): unsure at all n locations
ctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccccggccgaaccggcaaaggggggcccgcgcggtctcccggtgaggagccccacgctccgtcatctggcgcgccaggtagggggcgcgtgtgtttttctaagctctcgtcctctttcgtgtgcgccaagcttctcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatgaagaaggacggcgagacggggagcgtcgcctcctcgtctacggcgatggcagcacgccccagggcgcgctccaagctgcgggcgcgctcttgcgtcacccgcccgtcgtccccgatccagagactccagcccgatgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccgttacctgccgttcgtcagccattccctcgtcaacgcctccgacccaagaagatgtgcgtagggggtcggatgcccgcctcagtatcgagcgccggcgcaatggtcgtcgtgctgcccacgcaacggaaggcgtttcctcgtccggagcgccacttcggttcgggcgcgggggccagccccccgtgcccccggttggtggtgtcggctgtcgagcctttgtggcgagtcttcggaacgtccgttggcccccaaggttccggcccaccatcaccgaaaaatatgacggaagcgtcaaccccgccgagtttctccaggtctacacgaccgggatcgaggccgccgggggtgacgacagggtcatggcgaacttcttccccatggccctgaagggacaggcgcggggttggctaatgaacttgccgcccgcgtcggtccactcttgggaggatttgtgctagcagttcaccatgaacttccaaggcacatatccgcgcccaggtgaagaagcggacttgcatgcggtacagcgaagggacgatgagtctcttcgctcgtacattcagcggttctgtcaagtccgcaacaccataccatgcatccccgcacacgcggtaatctacgcgttcaggggggcgtgcggcacaaccgcatgctcgaaaagatcgcctccaaggagccccagaccactgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacgagggacacgtcctcgccatcgagggcgcttcgcgggccacccaaaagaggaggcctgcgagcgacaaaaaaaaggaggccggcggtcccagcagggagcgcccgaccggcaagtggtgcaccgtgcacaacacctccctccacgacctcgcggactgccacgcggtcaaaagtttggctgagcggacaaggaagtgggaggaggagaggaggcaggagcgccgtgagggcaaggccccggcggctccctccggcaaccggcgaagtgaggccaagcagaaggcccccgccgaggacatcgacgatggcgacgatgacctagagttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacggggctgcagccctcaacatcctttcccccgcagcctttgacgccatcaaggccccggggatggtgcttcggccgtcccagccgattataggtgtgacgccggggcacacttggccgctaggtcatatcgacctcccggtcaccttcggtggatccgccaacttccgcacggagcgggtgaacttcgatgtggcagacctcagtctgccctacaacgcggtcctggggaggcccgcgttggtgaagttcatggcggcggtccactacgcctacctccagatgaagatgccgggcccctgtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcatgtgcgacgaggtcccggtcaaggaggttgccctgggcgacggctcgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatattctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccaaataggacgtaatgttgaggcctatgttgatgacttggttgttaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcgctacccctatttaagctcctcaaatgctccgggccgtttatctggacggaggaggctgagcgggccttcactcagttgaaggcgtacctcagttctcccccagtcctggtcgccccggagccagatgagccgttgctactctacctggcggcaaccccgcaagtggtcagcgcggcgttggttgtggagcgcgacgaggacaaccctcaccccgcgcatccccaccctgtgtcgactcgacccgggagagagcagggaggagaggcccccgagccgaacggcggccaaaggcccccgacggccggagctggccctccgcctgcttgtccgacggcgctaggcgcccccgacccccaggatggccccggggccactgcgggaaggccgctcctgtcgccctccgaccccgaggtcgtcggcacagaagccgagtgcgccccgtgcggcctctcggacgaagagcgccctggagatgcggcccctagcgaagaggatcggccccgccgaaaggtgtagcggcccgtctacttcgttagcgaggccctccgggacgctaagaccagataccctcaggcccagaagatgctttacactattctgatggcttcgaggaagttgcgccattattttcaggcgcatcgggtcacggtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccggcccctgagcccgtctccgcccccgaggccagctcgggcccctcgcagctgcctcacaccgtcaactgggtgatgcagttcgacggctccttgtctcttcaaggcgccggtgcgggggtcacgttgacctcgccgagcggagacgtcctcagatacctggtccgcctcgattttcgggcgaccaacaacatggcggagtacgagggactccttgcgggactcagggtggcagctggactggggatccgccgcctcctggtgttaggcgactcccagctggtcgttaaccaggtctataaggagtaccggtgctctgacccgcagatggacgcttacgtgcgccaagtgcggcatatggagcgccattttgacgggatagagcttcggcacgtgcccaggcgggataacgcggtcgccgacgagctctcaaggatcgcttcctcgcgagcccagaccccaccgggcgcctttgaagaaaggcttgcccagccgtcggcgcgacccgacccgctaggggagacggacacgcctgaacggcccccgaggcccgtcggagtccaggcctcgggacccgaggggagcgttcccggctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaaatgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaatccatcagccggcccaggccctgcagaccatacctctttcatggccgtttgctgtctgggggctcgatatcctgggtccgtttaggcgagccccgggcgggttcgagtatctgtatgtcgctgttgacaagttcactaagtggcccgaggcttacccggtcatcaagatcgataagcactccgcgcttaaattcatcaggggcattactgctcggtttggggtgcctaatcgtatcattacggataaaggcacccagttcactagtgaactcttcggtgactactgcgaagatatgggcatcaagctctgcttcgcctctcccgcccaccccagaagcaatggccaagtggagcgcgctaacacagaaatcctcaagggcctcaaaaccaaaaccttcaacatcctcaagaagcacggcgactcgtggatcgaggagttgccagcggtgctctgggcgaaccgaaccacgccaagccgagcaaccggggaaacgcctttcttcctcgtctacggcgcgtaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccatcagcgccacgtccgggcccgatcactctgcgtcgacgacctcgtcctacgccgcatccaaacgcgtgctgaacttagcaagctctcaccaatgtgggagggtccgtatcgagtgatcggtgtcccccggccgggctccgttcggctggccacgggcgacggcgcagagctgcctaacccgtggaacatcgaacaccttcatcgcttctacccctagtgggggtcgggtgtcaggtctcgggctcgggccaaccccgcgccccccaggcgtgcagggttggccgggggctaccacatgcataagcttatattttttctcttccgtatttcaataaaggcattttcgatttcctaaggactgtgtctgagccatcgtttccttttgaagaatcttggcttgaattagcatgctcgtgcccgaccccgccctcggtggcccgggccggctaaaatcgccaaacggggcccagaaccgagccgtgccccggggcgttgtgaactccgggggggaatcggcaaaggcccacaatcgggtcatccataaccctcggtcaccacgttcccggccaggccagtctcgacacgcggatctccccaggcactagccccgacccgcgccgcttgaggttgggacctgggcacgagccctcgttcaagccaagacacagaaggaccgcgacacaaaccatcctcgtctcatacacacaacaaacagagttgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcagagtcgagggcaaacgcgagccgaggggctgtaccctcgaagctgtggacgatgtggtcggcggcgtcccggacctgtgcgcgcgcgccatcctcggttccaggagggaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtatttcgcggtccgcccgccccagaggcccgcctgccgcccggcacggtctagacgggagacggcgtcccgaagcatgccgggccctacctcgcccatcaagcggagggcttcgacctccccggcggacgagtccagcgcgccctgcagctcggcgatggtgtgttcggcggttgcgaggcgggcggctaggtcgccgtcgcccgtggccgccccgccgctgcgcgctcttgcgtccagctccttcgcccgcgcctcgaattcagcggcccgctgatccagtgcggccctctcggcgcgggcgccttccagattgaggcgcgccttctcctcccgcagctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcaggcgcgcttctccagcaccgtggcgcgagcctcaagggcctcttcgcgctgccgggacgcgtcgagcttcttctctagctccactgcccggctcccgtattggaggcagaggtcgtcccgcgccgcgttgaacacggcggtggcaatgagggcagtctcccgctcctcctccacctccctggcgatctccgccaggaccctacgacgggcctcgagctctgaggcgtgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggctctgcgctcagtgaagcagcggaaggcagaggggagagccgcctcggtgtgggcgccgcgcggctcggcccgccgatcgacgtgccgaactcgggggcgtcccccgaagcgggctcgtcccgaacgtcgcccgaggggtcgggcccgagcggcgcgcccgcggcctcgtcgtgggtggcctcggaagtcgttgtcgcctcgggtggagtcgggtcgggggcttggcaggccgcccggcgtgcgtgcgccgcctccgtctcccggacggactcctcggcccggcggagtctggcctcttcccaaacggcttcctcagcctggcgagcccggacggcctcctaggcagcttcttcggcttcccggaggcggtctgcggcttctcgccggtcagcttcccgcctccgggcctccgcggtcgccgtctcctcggcctcagaccggccggacttggaatggcgagaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccctatcttgcggagccgcttcttttttcgctccccctcgggccgcgacgtcggcacagcaccctccgggcgcctgctgctggcacggaccgccctgccccctcggggaggagatggggagggggtatcctcctgtttcctcttcccccgggcgtcggcagggcggctgccccccgggcccccgacacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgatgtcttcagggacccagtcccatttgaccccctggtgggtcctcatgtagtcctcggacccggtgtactcccaagcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacactggctgtacggtgaagaaccaccggaacagccggagagatgggcgcaccccgatgaacatctcgcacaggtgcacgaagatggccaacgtcattaccgcgttgggggtgaggtgcgccatctggagatcataaagctccagaacatccatgaagaaagaagagaatggcgggaccagccctgccattgcaaaggaaaggaagaagacggaccgccccgggtagtgtggcgccgggcgtccctcgcccagcgcgaccacctcccggccggtggcagattccggcataaatcggcgcggtagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcgaaggcaagggggagagtggcgagaggaaggaaacaaatcccgtccttggcgtctttgtacccttgccaacgctatgcccggctcctcgcttcccgcgcccactacctcgccccctcgtctctcgcgcccgcgcctccactaaccacactcgcccgtttgcggcgcacgcggtagatgtgcggccgtggcgttttagatggggcagatcgtgcgcgcattaaccgcgctcgccaaccgcgaaaaacgccatcatcatgtccccaggcgaaacaaaccggctcgtcccgattcgcgcgctgctcgagtagtgtagcggtcttgaagaggccgctcattattgtcgatcggtttcacccttgccgatgcgcgcgatttgcaaccgttgggtttctgcccgcctgtagggaccatccccacctgtcaccaggcctaaggagtggcgtcacgcccgagcactttcctcgaggagggcaatcgccctggcataacgccgggggctactgtcggtgacatgggaccgggggtatcttgactagaggtttggggcagccgcggtcacccacttggcctgaccccctcgggggggtcgggcccgagggtgatgtggccgcccctccctttgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgtcccacgccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagacggagccggcgtgctaactcctggagttagcacgtcagtcccggctagattcataccaggcttcatcgcaaccattacaaggaagtcattttatgaagaagggctgacgcgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtagcagggaaatccccggtgtcaggcgagtgatgacgctaggcctcactcaaagacaagctgtgatttagcttccaggcgaaggcgcaagccagttttttttgggagatagggtgagtccccacccaaaagaagagtaggtagaagtggtgtatgtgggatccccttgagatataaaaggaggaccttgcccacttaagaaaaaaggggaaaaaaaggaggaaggagggaggagggagctggtaaaaggaagagcggagctcgtagaggagaggaggagtgagagggtctctagagtttgaactctcttgctctccagctctttgtaactccttcatacacagatccaccagaacataggagtagggtattacgcttctcagcggcccgaacctgtctacatcgcccgtgtcttgcgcatttgctctctcgcgaaacatttcacagatcgagggcttagaacctcacctagcgcccccggtcgaaccggcaaaggggggcccgcgcggtctcccggtgaggagccccacgctccgtcactaggtgatatgggctcaaatatgtctctatgaatgtaaatagcacaaatgtaaatgcaacaaataaatgagacaagagacaaggaatttttcatcgaggttcggaaactcgccggtttcctaatccccgttgaggtgagcccaactccacccgcccaaccacgaagccaccgcacgcccccttcgtcaaggggtgggcaaggcgggagccggcccacggagaggactacccaagcctcgatcactcggggtagttcttccttcactccaaaggtggtgaactccaaaccactcacaaacggtgccgggcctcctccacaatctcctcggagaggtcaccgggcaacacctacacaagccgtttaagaggcggcaacctccaagagtaacaagtctaggatgcttgccgaggatgatcaagtgccacactaactataacaatgaagcaatgcacttggattggcttaactcactctctatcacctcactagataaactaagtgcacaagggtgtgagagctcttgcaagggttcaagataatgtaatggagtgccaaaaccttacccttgctgctggggagtgggtatatatacccccaaccaccaaaactagccattggaaccgaaatccccaactttgtgctctgccggtcagaccgccattgtgaggccggtcagaccggactactttgtaacggctagaaaactagccgttacagggcaatcatggagcccactcaacctggccggtctgaccgcagtgtagtggccggtcagaccgtccacggctcggtcagaccgccgtcggctcggtctgaccggttgcggctctggcggctctgtatcgccaccaaaaaccagaccagtgcaacagaccagtggggccggtcagaccggccttaccacgccggtcagaccggcctaaggcccacggtcagaccgcaggtcacttttcagctcaaccgaccgttagtaaaacggcgatatctcttgactcgggtctcggaatttggcgtttttggactctatggaaagcttattcaaagggccatccaacccatgaaaaatccatccaagaaacacaacttaatcaaggataaagggctcacactccaaaggatatccaccggacatacccacaagatgtcactcactcctattggacatgcccacttctctcttggtttaggacttgagaaaactcatcacacttggttagacaagcccaaaaaatgcacctacatgcatatgaactaatatggcacaagattatccacaagctcgcttcatagacccctcttgatagtacggcgcctatctagcaaatccggtctacaccaaacacaaagaccgggaaaagactaagaaaacactcttagctacattatatctttgccttgcgccatccatcttgggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37492 - DNA, 39509 bp, Oryza sativa
agtacgaatgtactcaattcccaattgttgttgtttgtcgtccattctgagtcgaggttgaagataacgaagattagggtatcatccctagactaaagtctttgccgtggattggtaatctagctacgctaagtttcacatttgttgtttttgattgagggttgtatttcaggagaaatttgtatatgtaccaacataaaaaacagcttcactaaaatgccatcactggaacgggcttggataaaattccacccttaagcagagcgtcttcaccatcctgtggactattttgccattaggatgcatgcttcttcctcactccaacgcctcttctttttgcccttccagtgctcaccagtgaccatggtgtttgcccattgtaggagacgcaacatttctgaggtggctactggtgagacatgtagttgggatccatcggcagcagcaatggcaaggcgagggatggcgtccgtgccgggatgtgcagcggcgaggcaagggatgggtctgacatccgcagtggcggccacaaagcagtgctggcaccaagatggatactgattgtgaatattttgtgttcttgttgttcgtcttctataatggggattaggggagcatgatctcagaggggaccgctcaaagcatgggctcaattcatcaagccaatgctttgagcagctcccttttttttggacttgggggaacataccagttcttgttctaaacttcggcactagtgagtccccgtcatccatgctgaaaatccagagctggttggggaccctccattgggcccttcctaaccgggattgaccctctttgtagcttatagacatatgatcatatcagataaagatttgcagatcgatctatttttatgcatgcatggtgagagaaagtggacacgtagtaaaccaataaaatatattctcgataacaatatatatagcaggttttacatattacaatctcacaaaaaaaccagcttaattacaacaatcatgtgattcaaggttgatacaaatgcagatcgattagcaaacagacatgatcatatcaaatacgaatctataaatcgatctttttttatgcgtgcagggctgagagaaaacgaacatgtaagccattaaaattatctcgagataacaatatatataatggattttagaaagaaaaaacgacttacaacaatcaaattaaagtgattcaaggatgataaaaccgcacatcaatctgcaaacccgacaagagacttactcacggggaacaatagccaacaaccacaatagcgaacaaccacaccaaattaaactctggaatattataactgtgccgcttagcaggtgaaatcggtcggataggtcttgccacacttgttgaggatgagtccgagatcaactgggagggttgaccctaatgccaagcacattggccttcacggcggtgcaaaggcagatggcagcatcgagatcggcgatccctgacagcaacgagcagcagtcatcggggccgtacccaatcttcacatcgaccagccctttagcacgttggcgcacactctcagcttcagggcgttgatcgggcaacgcccgtgatcactgtgcccaccagggtgcaatggcgccggcactgcttcgggtgcgtagggatgaccttctcactagagcagttgggtgtgcagccgtgtgcggtgacagcaaagaggaaagggcaaggaaagaagcaacgaccttggaagccataattttgtctgaaatcgaatgagccggtggtaatcagtcactcagtgttctagactgctctagcttgtgtcagtttgggatggtttgcttgtgggttttcgtctgatatttataggtgagctatagcttgctatagtttagttgcacgcaagttgcttgtgtaatagttcctttgttttcctggatggatttgcatgcaagcatggaccagtagttggtgggatatatgacaagttaaattcttaattcgatgaaatgaattatgcagtcatgcagagcaccaatcgaacaatcatgtccagtagtacattttacgcgatactagctagttgagtattcgtgctttgctatggataaaaaatatattataatatcacctgaaataaagaatatctacattctagccaaaggtctctatttagccagtttgcttcattgtgaaggcatagcatcgctctatacagtctccatttaatgacctgtaatcccacgggaaggtccatgcactctctcgctgcatgactcacggaaccacaatgaagccgatacactcgaaaacctaggcggtggcacagggttgcttggggacggtgacttggtctactcgtgggtgtgtggaactgatggcctagctgcacgggaactgattcaaggctctgttgtaagatgggcccaaatgttagtcttcttgggaacaaccatgtgtattgtgttctatagcatagctaaggtggtgtttggattcagggacttaactttagtccctatatttaaacactaatttagagtattaaatatagactacttacaaaattaattacataaataaaagctaatttgcgagataaattttttaagcctaattaatctataattagagaatatttactgtagcatcacataggctaatcatgaattaattaggctcaatagattcgtctcgcgaattagttcaagattatggatgggtttcattaatagtctacgtttaatatttattattagtgtccaaacatccgatgtttgatacgtggtctattccgagaagtgacacgaagtcacattctaagtggtcggctgtggaaactcctcgatagcccgggaaaggctattgtggcatttttataggcctgagggaggagacatgtcccatgggccttatgtcctcgtccgacgcggtgcactgccaagcctgacaatcgcatttgttacgaattacctcgagatgtcccgttgctacagtccttttctaaaagtcatattttcacactagctcagcaggaataacaagacttggcaagtgagcccggcgtaacgtcccacatatagttgcctcatcggctataccgatgcggggctcaaagggcaaaaagagtactcatgattgtaaatagtagattatgtcatgcagcggagaaatcaagagggcaacaggaggtatataagcctcaccgaagcttgatacataggttagactccagatccagaaggaactaaatttctccaggtagagaactttgtaatgcttgatcgacatagtgatacaaacatgaataggattgttattctccaagaggtctaagcctgtaaacattttctgtgttgacttagctccggagcaggtccaagcataccaaggatcccaaaacccctcctcgaccgggatcgtttgtttcccatgtttgtcaaattagtttgtttttccgacaaataataatatatattttccataaaatgtcttacctataattttactgcagagattattcatattaaatagattttatatgtggcaatctatttctatttcattgattttttaataataagtttaatgggtaatttgcacaactccaataggaataggtggtgtaggatattttctgttacaaccattaccttccaataggagtaggagtattttttttttcgtgaccagcattgtgttaatattattattcttttcacgtgcaccgtaccctctaaattttaatcctgttttcactactgctgcttgtctggttgtagcgtaagggatgaccttatggccgaactactgctcgcaaagctgcaatgcatccatctgaaccatctttttctgagggctagcttgagggaatgggaatgccaccaacgggctggacatacttgtgccgaaacgactacgtagttaggcctgaaccgctgtgataaaattcgaccggtcatatacattacaacaataattgcaggaccgtctatacttgggtgcaaggtcgacattggtgtgcacgacacagtttgaagacatgatcatatcatatacagatctacatatcaatctatttttttcatgcatgggtcaacatattttagttgcttacatttcatctttatctcacccatgtggacctattaatttgatctgttgatctttatcttcatatcgaccagcccgtttagcacgttgatgcacactctcagcttcagggcgttgatcgggcaacggccatgctcatcgtgctggccatggtgcgactgcactggcactgcaacgggtgttgccgggacagcctgctcgccggggcagttgggtgtgcaaccgtgtgctaccacagcaaagaggaggaggctaagggccagaaagggagcgacgaccgtggaagccattgagctgggatcgagtgagctactagtagtcagtgatcactcaagagctggcttatggctgctctatcttgtgtggcttaggaacggtttgcttctggtgtttgggtgtgcgtctgctatttatagatgagctagcttgctataggtagttgcttgcatgatgcatgcatgtgtgacatgacagtacgttgcttggttttcctggatggatttgcatgcatctgcctgcatgggtcggttggttcttcgagttggcaagataatttcttaattgcaacgttgaattttggcatgcagtcatgcagagcaccaattaaccaatcatctccaattcaccagttgtccattttatcacaatttcttaatatattacatgattacatagtaatatactcccttcattccaaattgatctgcttatagttttttttgagattattactaaatgatctatatatttgtgttcatttattaagtctattcgttatttgtgcattagagtaaatggacattgatgcatgcatccatgcacacaagtatttataacccacatgtaatatcttgatttgctattggctaggaaatagtggggatggtgcatatatggagtttgttgctaaagtaaatatagtataagagagttattagcttttcttggtctttgtgtacctgtgaaatatttagatcaatttggaatggagggagtattagctagtagtatttattttccgtagttacatggattacatagaagttgaaccaaactgcgatgtattatgctgacgagagtctactgattacgcagcaacttatctggcttccaagagatgagctacccagccaaacctcgtttcaatatgaatatcctatatgtcggtaaacttattttgtccactttcagactcaataaaagacacctcgtttcgactttcgagctaagagtaattgatattttattggaagctgcacaggtatcagatgttgcataagaatcagaaaagactccataaatgctccaccaagataacctcactaaggcctacctatgatgggcagaagtacctcgcctctaacgggctaaactaaagcccactctagataaggccccacgggcacagctcgtcacagctaagaacttaattgtgacgggcccatttgtgaacccgataaagaacacctctaacaagcccacatataggccatcataggtgacaacacacctgtaggggtttatagacataatccgtcgaagatgaggacagtcatctctaacggttcccttttttacccatcacagatgaaaaccaccgaacaatacccatatcactctcccacccactcattttcttctctctttcactctctctctctctccctctctccctctctctctcatttccttccaccaagatcggatccaatgcaccggccttagcctccaaccccgagctcctgtcgccaccgcgacctccacctccccctccccgagcacgggtcctcattgcttccatccacgagcgcccgtcactgtcgcctccacctctgcccccaacttctattgattgccgcctcaatccacgagcacccaccaccgcggactccacctccattcccaagctcgggctgcctccgcctccatacacgagcacctaccaccatggccttcacttctgccctcgagctccggtcatttccacttccatcaatgatcgtccgccactaaggcctagacctcttcccccaagatcaggtgaccgtcgcctccatccacaagtgccaaccccctctgcctctgcctccacccccacatccatccacaagcacccaccaccgtgccctcactacaacaaaacaacccaaaggagacatcttatttgtaagatagagacgttttatttcgtctcccacagataactgagacgcttttataaagcgtcgtaggatcgtctctgtttgcaccgtctcaaaattatggagacgctttttaaagcgtacctatattatttaagacgttgctagagacgtgtaaattgcatctctataaaatatagagacgcttttatataggcacgcacatcttaatatatttgatattaatgctttcatctgggctcgaacacaacacctgcaggttacaaagttcatgcactaaccaagtcattaacgtgacaatcttgaaggtaaatagatagttttttttatattgcaactctgcaaacatgcgtcctgtagcagttctcttcttttttaatctaagactgaatattaaatatttattttttttggtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatgtcctcaactaataaagcgtctcaaacatcgtccctattttaatttcatttataaaaaagagacgacttatagaatgacttaagtgaaacgtcttaaaacaatggttttgttgtagtgcctccccctccatccctgagctcaggtcatcgccgcctccatccacaagtgcacaccatcgagccatagtcattgcccccctctggtccgagcgtctaccgctgtctcttcatctcctccgcaaccgcgccagtcaccgcctcaaggacaagcatgacaagcatggtggaaggcgactcaccaccatggcaatggcactaagatccattgcttgcaagttctttttcacccaagtacttttgcatgtagttcacttgctgcttcatgtagttcatgttgttcacattgttgccgcagtgatgattccaatccctgtggttctatttgattgtggtgattgagattcaaggttttgttttttaattgggacaaatgcgatggggacgagagggattgtgatgatttttgtgatttgtgaatgcctaatgtgatctgtgatatcctgaatgagtgtgatagcatcctaggtggatgatattttcttttcccattttccacactagtgatgggtccttactataacctattatagataaaggtaccagtaacaggttaaaatatatagccgttagaaatgactctcacatatgacgggttttggttggggcccgttaaaggtaactcctaagtccgagagatcttcacctataacaggtgactcagtcatgactaaccactaatctcttactagggctaagcatgtcagaggtgatgatatgagcccaatggtgacctgacctgttgcatgtgtgcttgttttcacacccaactaggagcgttattcttagtagaactaccattatactctatccattagagaatatttgttcaattgaaaaactcatgtacgagagaatgctaaagactgcatattgtcttacatcctcttgggcctcctagttaatgcatttgcttgggcttgttgtgtggattagttaaatattatggttctgtgattgctcgtgtgatggatcgtagttcaggacgctttgggtcgttctcaccctcaccacttggtttacgccagtgctcctttcttacacttgctttaaacctactatcgtggagatcgggccaccccttgtgagtgagttcgtgttgtcttttgacaggtctactggttgcgatatagccatgtggaccatcttcttttgagggctatcgtgagtaactcattctggatagggtggaatgggaatctcaccaataggctgcacatacttgtgtcaaaatgacttttttgttaggcccgtatgtgggccagtttgatgaaattcgatcggtcacctcgtagaatttcaacatcgtcttttctcccagtaccagtaactggattagccctgccagctaaaaactgtatggaataaatgaaatacagtcagaaaaatggctcctaatgtgtcaacgataggaaatttccatcataactagctcgtcggagaaaaggaaatttgcctggtgcgtacacgtcaaggaaataattgtcctgacgtggaatggacagtctgcgatagttgcatatcactgataggtttggcggtcagagatattggaatatttttttatgggtacgaccatcaggaaaataagacaccacacctcgctagatagctgtatccatgtcactaaaagcagcggtcgtcagggcaaatctagtttctgatactgtgatcaggtgcatggtccatatcaatgtgcgtaatgcagtttaatttgaagatcgatcaatttttatgcttgcatgtgtgagagaaaacgaacatgtaagccattaaaatatctcagggtaacaatatataacgtgttttacatattacaatctctgaaaaagtaatcaacttacaacaatcaaattaaagtgattcatgtggatgataaaacaaccgcatatcaatctgcaaaacagacaggagacttattcacgaggaatcgtacaaacggccacaataaccaacaaccacaccaaattaaactctggaacattataactgtgtagcttagcaggtgaaatcggacgggcatgtcttgccacacttgttaaggatgaggctgaggtcgactggtaggttgaccctaataccaagtacgttggccttcacggcggtgcagaggcagacggcagcgtcgatatcggcgatccctgatagcagcgagcagcagtcgtcggggccgtgcccgatctccacatcgaccagccccttgagcacgttggcgcacactctcagcttcaaagcgtccatcgggcaacggccatgcccaccgttcttgccatgatgcgtgggcgtcgggacaacctgctcgccggggcagttgggtgtgcaaccgttagctatgacagcaaggaggaggaggctaagggcaatgaagggagcgaccaccttggaagccattgatctgagatcgagtgagctgctagtagttagtgattgcactcaagttgccttggacaatttgcttgggctgtttggacgcgcgcctgctagttataggtgagacagtatagttgcttagcttggtataggtagttgcatgcatgatgcatgtgcgatagtttgcttggttttcctggatggaattgcatgcattagcatgctagctgcataggccagttgttcagagttgacaagataatttcttaattccaacgttgaattgggtcatgcagagcaccaatcaacaaatcttgcccggttcacaagttgtccattttacgcgatatcacaatttctcaaccaattagtattgttttttcagtgttttctggatcctcagagtttaatctccattggttatatactcacacactacgaggacgttttggaacgatttatataattttatactccctcagtcatgcatgcaagcgtgtgcgacgagttgatcagctggctggaaaatttatacataatgcatgcaagtcatgaccgatctgaactgtttactctgagcaaatctgacgtctgaaagggagaaatgagaacaagctgccagatagctggaactccccaccgcggcattagacaaacatggcaagcgagcaatatgattttatctccatgttataatgcgctgagcatgcctttgaatcaaaggatttatgtaaggaatttcataagattcaaatcctataggaaaattttctatttggcacattgattcaaaggattaaaactttccaaatcatatgaaattcctatggaatgacacattgcatgtatattttggaggaaacttagcaagaggtctaacctcttgaaaatttcctttgagtctatctctcttatccgattcctgtgtttttcctatggtccaatcaaacgatcattcctgtgttttttcctatgttttgcaatcatctattttatactttaattcatgtcagaatcatgtatttttcctatttctctactttttttaaccctgggattcaaaagggccctaatgatgagacatagtcctgatctttcgatagatactgataagtcgtttgtggagaactcatcattgatgtaggatcgaacaacaagaactaaggtcctgtttgtttcagcttaggattattataatctggattattaagagtaagctgaaacaaacaagtagattattatgatagattattataatctataagccatattactataatctaataatctcctctggaggagcttttttcagattattgggtggctaaagaccaactaccattagatgccttcaataatccagagaaacaaatagctcacagcttattctatgtcagcttattataatccaacttagagtaatctgatttaataatctagattacaataatcttaagctgaaacaaacggggcctaagccaaccataagagggtgaatagttgtagtacccaaaaccaaaacttttagtggaattaaagataccctcgaatccaatgtagatcggtctgaccggggttaatccgccgtgcctatgctgctggtctaaccggtgttgatcgcccggtctaaccgccctacaattgcctctacctcctgtcgccgccgtcggtctgaccaccgtatacctaccggtttgaccggtgcgatgccatcggtctgaccaccggtgtcccgccggttggaccgtcgaacccgagcaaacacaaatcaaagatctcacaaagtagattgaaactttattacttctctctatgtttacaaagtgcaacaacagcactcctcacgaaaatattgactaaacatgaaacccaaacttttctctcaactcaactctctctaaaacgatatcgggaggccgcaccctctctctctatttatacccaaacttgtacaagaagtcctaatcccctaggaaaccttcccgtaaaagaaacaaactttacaaactccaattgtaccaaatttggactccctccaaattcgactccgtatcccatactcacacaatatctccatcgtatgacaaatggaatcttcaccaaccacgtgcattaatatttagcctaagcatcccgcacgatatcctgatcgtccggacgtcatattctcataaattgactcccgatccatcaccggcaacactctcccaaggcatgaagaccacctacacatgcatcaaccaagaaaccatatccgagcacaagttctcaccaacttgactcattgttaataaacaacaatactacatacacatagtatccatatagaagtcataaacatgaattatctacggatatccaacaaatcaacccgaatccgaaaccgacatagagttggccagtcagaccacgtgctggccgatctgaccacacgatacatgccggtctgaccggcaaccactacccggtctgaccggacccgctcaatcagtagtctttgttcatcacctgcaaatccaatcatctccaaaaccactttgccaataatctccaaatatcaaaaccaataatctcatatgccaattattcatcacaaaataagcattagcagggtcctttatgtatacaaagtttcgttagaatcaccgctatttagttcgatcttttttaccttgtactccctccgtcccaaaatataagaacgtaggatcggataggacatttcctagtagtacgaatttggacagacatctggtcctagattcttatacttcgggacggagggagtatttttttttcaatgcttttcattagttaaatgacatgtaagaaaatgagtaaacattccctccgtgggaaaaaaatccatatcctcttttaatgggcctatatatatatatgtccttttcctttggcgtcgttagtgtctatgatttctcttttgccctccttctataccaaatctaggtaattcatttggccattttcattcttagtggaaaatataaaacatttataaggcacaccttttgggtttagcctatgatataattacgaagtccaatacctaaaaactgactttgacgtggtttgtttagaaaattccaaacagcttaggaggaagaccgaagtgttcttcttaatcagcagctaagtctgtttgaagttaatgttgttaggagacccgaatctgactccaaaccatgtatctcttgccttctatggctcaataatggcatggtggtgttggagtagacttgaggaaggccgtgatttggtccccaaccaacttcactgatcataaatgtaaatgtattccatgaagacgctccccatttcttcacccatgcaagggtttcttcaaatgacaaaacataaaattcatggtgtacatagtatgttttgttcgaatattgtcagcgttctggatattggataccctatatatagtatttacctcgcaagaccactgtagaccaagtccaatacagaaacaaacctagataaagtctggaatagataaggaaggattcctagataataaatgaaatacataggcctacttgcgctgcttggactactcggatcatacttttttccctagttctacttggacaaacgggcaactgagggtataaataccaggcacgtaagtgaggagtaggacaagtcaaaacccatgagagaaactaagacaacatataacacctccgatctcgtcgagtcaacacccaaagaagtcgataacaactagtcgccaaccactatgcccaagctctgcaccgatatactagcatactagattaggttttttttcctcctcattattctcatgaggatgatatatataatacactagctccggtcaccaaaagttgggctattacccatcttggtgtgctggatcagtataaaaatccttgttgccttgcgttccattatctaaactaaattggatagagaattttgcatcataattagggttccaaagaatgatttatttgagaccgtcgcacaagatcatagatacacgcacagaaccagaaaaattttgacactagggtattattttgtaaaatagtttttgacaactaagctaaaacctggtgttacaaactcattaatattgtttttaaaaaaaatagacaataaggttctataaatatcatagtatttattgggttgtcttttcgttttttttcctcaataacaccgaatttcatggcagaaaactaatgtgataacgagcgggtagtaattaaggtcgtttttttttaaaaaaaagaactttaaggatgttctaacaaaatatcggctcattctgtctcgacgatgttcacagctaggggtggagatagtcactacaaaaccgtttttactcctagttgggaacccctatagtcccgattttccaaccggtgttgaaattattaacacataataatttaatttattccataaataaatcatgacattgcatatgtaaactagcatgaacatatcataagatctacatatgtaaactagatagtatagcataaacagatcaaatatgcgtaacatagtgagcacgtaccaagggtaccggaagaccagttgcacagcaggaattactcgcggttgcgggcgttgacaaaggcgtgcatcacgcgagcaaacagaaagacgagccgtcgtgaacgaatagggagcagtcgtgcgaagcgcttcccaaaaaccttattgccgccttctcccggtgcaggacgtggaaggcagaggttccggagacatgctatcccgatcgccgctgcatgccggcgagcggaatggagtagtctacaagcgacggcgcagtacagagtaggaggcaaaccctagattgatttcacgtgtgttgcgtggaggcggcggctcggtttatatagagaaaggtcgcttgatctccactccgcgtaaccgaaccggataagtcacgcgtaacttattcgaactccacgccgttttcacgcaacggatttttctaaatttcccgcagcaaaacaaaactgcaaaagaaggccgcatctgcgcaagggtgaggaaccaattttgtggaccattcgacgcgtacgttgtgccgcccgccccgccaggcgaggcgagcgagcacgcgtgtattccccctgttctctccacctcacatgcttcaagtggctaggagggcatcctcccttttaaggaggtcctcctctcctagaataagcaaggtgatactaaactcccatgcatgccatcccatgaggtgggcttttgtgattttcaaaataattaatcttcgagtgggataaggcccatctattaattccaacaaccgggactacgaatctgggactaaaaatgcgcatcttcagtccggggtgaaataaccgggagtaaagttcaatctttagtcccggttggtgttaccaaccgggactaaagagagcataggcagtccccgtcggtccccatttctttttttttcattgtttctttgctaattgaaagagttaatccctttattttctcccaaatcgagtgccatgcatatcctcaaagcaaaccccaaatccccaaatcaaagtaatatcccaaatcattcacatcacaaatccaaagttactttatacacataaatcaaatacatcacaaatcctaaaaaaattacacacaaatcaaatacatctaagatccatgcaatgaatcacaagttgtacaaaaaaagaaattatacatctcagggaatcacaaattatcaaaaaaaaaaagaatggacgctgtcggctgccatggccgccgcttgcggccccgtcgccgccgccgggcatgaccccgcttgccgccactcgccacacctgaccgcggccccacctgcccgccgctgccgatcgccggatgggaggggaggagggggaggagaagggaggaggaatgggaggaggggggaggaggaggaaggggatctgaggggttaggagcagagggggtgagatcgatccaatcttatctaaatatctcggtgaggaagaaagcccgtctgggacttaaccgatcagagatgggagagaaatatttactcccggttggtaacttcaaccgggactaaagatagatttttagtcctggttggtattactaactggaaataaagatctaaatgatctttactctcggttggtactaccagccaggactaaagtggtaatctttagtcccggttagtagtatcaaccaggattaaagatcctcagccccctgacacaagcctctgacaggggatgaaccggtacttaaaaaaaaaaaatttaaccgggactaaaaacaatatttagccccggttctttttagaaccggaaatattgtggaaatcagccgacccagcaaagatcatttctccagtagtgagtgtatattaatttggggggtgcccaggaacccggtcaagaaattttttagctatacccttaactattttcatcatgtatgcacccctcaatacaaatttaggcacccgcatcatcttaaactcgatctaaagtagagtaaattaagcaagtggcaccaccctctatttcgctctatctccacctcacagcagccccaaatgctgtatatacaaaggcggaaggggttactatactgttgtattggctacaattaattatcttaattcactacaccgaatcgttaagttatctctattctattaatttcaaatcaagtacgtattcatcccgtcccgtgcatgtattgacaaatgataaatcgtgtgctgaaaagcggcggaggcgcgggaggtaggcaccggcgccgcctcctctcgccaatcgatcgacgtacggcggccattcaccataaaatgattacacatgccgtactctagctacttgacacttcacctacccagggcaacgatgccgaatgggttgtccacttaatgcgcctaggctcattttcgtgatgggcctaggttcgtggaaattagggctgccagatgaatgtatttcaatttatgcatccatatttcgtactccctgggctccgttaaaaaaaacaacttttgtatatatctggattcatatatatagaagttggcattttttttgacgaaataaaagtactagtaacatatactaactaatagatataaaaagatatcgtaaatatatgcattttatgccacctatatattagttttcaaattcaatttcattgtgtttcagcagaaatcaacagggaaaaaataatatgatagttttaaaagtacaattttgctagatttttctctttttaggccagccatatctaatactccctccggttctatattaattgacgttttagacaaggttaaaatcaaagttttataactttgaccatcaataactttaaaaatatttagtttaaagaaactaaaacaatatatatagatttgtcttttaaagcactataataaaagtaaatatgcatttatttattatatatattatagtagaaaaataaggtcaaagagatatcttgtagaccatgtcattgttcaaaacgtcaattaaaatagaaccggagggagtaatgtgtcagtataacttattaggtatacctattgtacttggattcgtatctaccataatatactgcaaatccaatattatatggaaaatcatattaaaatagcctatcaacataatgaatctaagaggaatttttatagaagcttacacttacaagtaaaattatttttattttattactattattgtgacatttattagttagcacgtgtgataaatgtatcttaaacttgtgtacaaataatatttttgccggtaattatcgataagttctatctcaccatgatatagatacagccatacatataagtcgtgctttcctatgcgggcatggaaaacaaagaaattatatcaacgtgtgagccatgataatatgaatagactaaatttcacggaactacatatattttaatcaaattatcgtaaaactagatatttaagacgtggtatgataaactacaggtttagtgattaatttagtttttttttaaaaaataaatattcaagactaaatattatgaaattacatacttaatattgaagtgatcacaaactatatattctaaattttaaattcgtaccactatcttcacgcgttaaagctatcaacattctagttttgtgataaattggtacaaaaattataattttgtgataaattttctatttaatctttatttatgtgacacttcattctaaatctgtagttttgtgagaaatttcaagctaattaagtctgtagtagttttgcgatcctttaattaaatatatgtaattttgtgagatttactgataaaaacgatctaatatatataagatgggtattacaagttagaataaccaggtggtcaaggacggtagaactggacatacatcgatcgagtactgcctgcaaacagacgcgagacgcttattcaactcaacagcgtcaacagacagacattgcacgaaactaaactcgtcttattgagacacataaactctagtgaatattgttgcagctcaaataattagcaggtgaaaccggacgggtagttcttgccgcacttgttgaggatgatgctgaggtcgacgggcaggttgaggttgatgaggccgagcacgttagccttcagagcggtgcagaggcagacggcggcgtcgaggtcggcgataccggccagcagcgggcagcaatcgtctgggccgcgcccaatcttcacaccgatcagcccgttgagcaggttggcgcacaccctcagcttcagggcgtcgatcgggcagcggccgtgatcgtcgtgcgacggcggcgtcggggcaactggcttgccggtgcagttagttactgcacacccgaagaacaggatcaggagggtcagggcaagaaggggagcgatcttgttggaagccattgctcaagtggtgaagtgatctagctaagctagtaatggtgctagctagtggagtagacagtgcttcagcttgtgttggcgtgtgatggttatttatagatgattgctactccctctgtgttccatttttatacactacttaaaaaaaccctgataggtacctgctcatatatgccgatttatttaaaactgacacctattgaccatttctcaccttcacatgaggaaaaaatatgtaaccggcacttttgacaattataggtgtcaattctaaataaaaactggcacccggattttttcaaatacctataatatattatagataccagttcttcgaaaaccggcagttgaaaaaaattgagccgaaccgagccaccaattaactcccaccaaagtcatcatgcatccactccattcatatccgatccgcttgtgctctctctctctctctttctgtctcgcacttgtcctctcctccctctgcaacgtcctctcttccctctgcgccactgctctgtcgcctctagcaccacatccattgccactgccaatcgctacatccggcgccgccgcccattgtgccaccaggtctggcggcgatggcattggcatgcagagggcaatcgccggcgacctcggcaaggagagagaccttggcaaccggcaacagctacctccacaccgctcctccgatggcgacacatattgccaacgatggcgggaccggggagagtaagttcatcttgcttgtgtagttcttgatcttgtgttgttgttgatctgtaatctgtgataattgttgttgttgatatgtgatatgtgaaggatgggatgaggatttttgtagttgatatgtaatggatgggattaggggcagcttgaaagaatcgactcatcgagccgagccgatgcttggagctagcttctcttttcatttttttttcttttttgaatcggaaagagcacaaaggaaccggtaccaatgacctagtgtcattggtgccggataattggtcttggctatgaaaccaacacgtatgccaggtttgcaaccagcacctttaaggtgttatgctgtagtaatatgatgaactcaccaacgtcataaatttagggatagaggtaatataaattatatgtcgttttgacttttttaaagttattaattttttgttgaaagcttgatcaactttatataaaaataaagcaacacttatagcaccaaattagtctcattatatttaacattgaatatattttggtttcttttttattttgggttgaacttgatattctttatgaacttgatcaaacctaacaaaatttaactcaggaaaaaaaatcaaaactacttatactataatatactagtaatatggttgtgctaaaccctatggtacaattctatttgtctttaataatttttaaaacttcatgctagcaaaaaaaattttacatgacagggtgtcatagacataatgacggaatccttatatgacaagtgtgttgatgagcacggttttgtggactttgctcgaagtggcgggatgagcaatcaaaagcaatcaaagaaatttctccgcgccttaaacgagcagtgtgacttgtagaaaaaggattgcttttcaatgaatgtatgtgtcatggcaattatgcttcaaatgtcttttttgttgaagagttcttgtctcagttgtcacattatgcaaaatcacaccaggcaaataaattaaaatggaaaaatggacacaattcttattctgctctattgaagaaaatgttcctttgctacttcttgagcatttttgttcttttggtatgtggttgtcaagtgatagaagatatgcagttttcctgatttgtttacggtatatttagtcacaaacaaagcattgtaattagtaggttcttttttccttttacttttttctttttgtgttctttgatcgttccatcatgttctatcccttacctactggattaagatggatgaaacatttgattttttttctcgaatgtatgtgttgacaaaaatccaggaagaactccacaatctaacatgtctctaagtgtaaactggcatcaaagatagttaactaatgtaaattggacatgagcaaaaataactttatcacaatgataatcgagcataaaaaagggataattgctcatttgacgctctttttaagcataataactaccaaactaaccatatattttcaagtttgcttagttgaccctgttttctcaaatcgtattttccgtttgaccctgttttaactctaccgttagggtttcatatagaaaacagagaaaaaaatatttttaccaccccaaataaccaaaatacccttattacactcaaccatatccccaagcccccatccttatccagtcccaacccaaatcttggcaactatggcgtgcagcaccggagctcgccggcatgcagaggctggaggtcgggtggcggcggcgtacgcatgaagggagatggagcccagcatgtggagggcaggcggtgatagcgcgcgcgcggagggagggagcggcacaagcacggagggaggcggacgccggcacgtggacggctagtggtgacggcgtgcgtgcggaggaagggagagacgccctgtgtggcgagaacgactgacggcagaggggcgtgggcggagggaggcggaggccagcgcgtggatggcgggcagtgacagcatgcgcgcggaggaagggagcggtgccctgtgcggcatgggagctcgccggcgtgtgaagtctgggtagatagaaactaggtcaaatgagaagggtataaacgtctctttttccttttattaacaccgtttgcttggcttcacgaaatagggtcacatctgatgttcccttttagaaaatagggtcaaatgagtaaacttaaaaagtagggttaaattggtagttacgctttaaaatagagtcaaatgtgcaattgcctaaaaaaccacaatcaatgatataatcaacatataaagacggagaaaactagcaaacacaagggaggagcgagcgcaatattaatatatatccagattaagggaacaaaactcttaatagtactgttaaccaaagcaacagctgagaaggaacaattctcgattataaagcttgagttaccacggggattcccaacatagctaggatctttcctactcaaaacattcagagccttgacagtctagtccaaccttttgcctatcaaaagtaatctaagacctctgcttcttcttctccttgaagagtgcgagcagtgacactgcagacaccttcacaaccttcaacctgacacctggaatatctcccaaggcatgccctttccaaccgaatccaacaatcagcacctcatcctagagtatccaagatatcagaaaatccttgaaataccatcggcgagtacactaatcccagaaataccatcgacaagagcaactttctgaaaataccatcgtacaagcctttttctcccaaaaatgccatcaccgtcaacttaccgttgattccacaccgctacaaccattttttttcaaaaaatgaccagattgccctcagtccaaaatatacccctcccattctcccaattcacggtaaaagaaagaaaaagaaatgaaaaaaatgtcaccacccttcttgtcgaaacaagattttggcaatactaaaaaggggtggctatcaagctggaaaagtggatgggtttagagacaagaaattttatacaggttcaggccttcttaataagaagtaataccctacttctgttcgaggattgatccgccgagtgttttattgattgtatgatctgagagaaaaatcgtgccccaaaagacacccggacacctccttatatagggaaaggggtccgtattacaaagtacaacccatatccctaacggaataggtagttacagataagatacaatcgtaaccgactaggatcccgggtatttccttgacatagaagtttggaatttaacccgattccctttgaagatattctatctatacatggcaccccatacctaatcggatatacatgtcgtatgggtatggggtatccataatctccacagtagcccctgacacctttacagtcgatgaaatagtcttctctcgtaattcaaatgataatccgagtgcttcaacttcctctgtcttagtcttctgagtagatgcatctaattaggtgtagcccccgactatgtgattagttaaataaaaactaaacatatagtcaaagtgcatcaaaacatccatccgagtggttttacaaccgaatcacccaagggattatatggctaagcatgtgtggcatctgataaaacatccagccgactgctttagctttaatgcgccaaaaatgaggtatagaaaaggcccgagtgagaaacactctaaaggtctataaaccaacatacatgataaaaatccgagtaaaaactctcaaaaagactcatcaaatgtggtataaagcatgataaatgatgagtctaaatagcctaagctatgacccacgccattattaaggtaagcatataacatgctgagagaatgaccatttaaaattagtcatctcaataaggcccgaacagctttgtagcctaaaaaggccaacaaaattagtataacacttttctgttgggcacccttttatttgcattgtagtaattccaaagaattatctaactacgtcaaaaaggattttagcagcattgggctattctgtcgtgagcaacttttgccaaagcaaaaatatatacctaagtccctaaggatcacaaccagccacgctgataataaaattgggctgaaagtattgtttaggcccaggcccataagcatctcccgataccttagtgaaataaacgctaaaatagagcgccgtttcgtcttccccgccgcgatcctctccattttccccacttcccgctacaatgcaaatactgcgccggcggaaactagggttcgcaaatccgcaccattccacccctctcgaagctccgttctcttgcatagatcttccgtacatccatcgcaccaatatcctcttcattcgctgccgccctcgctccaaatctaatcatccatctcgctcccatggccgaggagagagaaagcttcgaaagtcaatgggctccctccgatgtaacggatgagaacttgaaggagatggtagcacatggcgttcttccggcaaaggagatcatcgggtggcgtccggcatgcggcgaagcatttctgacccctgacacacacgaggtcgtggtattttctcacttcttatatggtggttttcctctcccaacctcaaagttctttagggggattgtggagttttacggaattagcttgcatcacctaaaccccaattccatagttcacattgccaatttcatccatgtctgcgaagcttttctagggattaggccacattttgccttattccgccgattttttttcctaaacccccacccaaccaaaacacaacccgtccgtcgttggtagggggaccggttttaatttaaggggaaccttaacccaaaaatacttctccatgcccttcaaaacctcaaacaagggctggcatgcaaactggttttatgtgcaaaatcctgagctagcactccccgagtactcctgccttcctccaacatatcaagacacccggaactcgcttccaatgggagatgaggctgcccaagcactttctttgatggaacgcatgttgaaacttaaagagcagggtctgcaaggggaacaaatcacccggcatttcatcaagagccggctggcacctatcaaagagagatctcgcactgcctttgagtttgatggcaagaatgaccccaaccgtgaagatccagaatctcttgagtttaaaatcatgaaggagagaatgtacaaaatcttctcaaacgctatcgcggttagctgttcacacctgctgccagtggtgccatataatgctttcaaccctcctccaccggtatgtatcagacatctcggcctttcttatgacatccttttgtcttttgtaaggttggctgaaaacttgaaatatcatgcataggaattttctttaatgaaatctgatcctccaatcgctcaacgccgctcaccccgccggcaggctggtcaggccagtggagggccgaaaatccggtctgatgctcagccaagcatctcaaagccaactaaccagtcggactctcgcaaaaggaaattaattctgagtgacgacgagggtgacaatgttgaaaaagctggcaacaaagaggtgactggaaaacagccaaggcaagctaacccgaagaagaaaacatccagtcgtccaataccaaaaatcaggaagtcatccaggtacaagtcattaagcaatttcccctgtatcgccaaacatacaccatcgaagtagtgttaatagcatatctcaaatctgcaggaagccatctgacatcgatccttctaggaaagactaaaccgactagcatggagactggtcctacgacctccacagaaaccgggccgaccgccgaaaatcgcctgactagtagtcaaccagcgaccgataatatagaggccagcaatgagcccctgactggaaaccagtcggccgaagctgaagccagtgctgatcaggtgcccccgactggaaaccagtcgggtacagaacaaaatgaggacatcccggaaacagaggctcgagcaagcagccttccctaaaaagataccaacaccgacccgaagtccagttcatccgataaggtgcaagggccttctcgtcctcaaccaaagatcataacaggtaatcagctcttccaaattcattttgatttgacaaattctcttcgattgttttatcatcatcatctgtgaatacgtaaaggcccaatgatcggtgacgaagaagttcttcggatttagtcagctgaagattctcgccaacccatcttagttaaatggtgggatgatgaaatgcagccacaagggattataataaataagtagaaagaagacgaggaagtgtctttgcttgcaaagacgctcaattaggccactcgtctcgtaaatgtatgttttttgcacatagctttactcatcctgttggccacttcactgaatagagatgaatttgcaatgcacagaattcatcttaggaatgaagcaaaaactgcaaccctcgagaaactggttcctcaccatggaaccctggaagagacaagagcccaactccatgaaaccagggagcttgccaggaaaactgaacatgatcttagggaccgaatcgccaagctccaagattccaatttcgagctgagtggttcatccaaaggtaacattttttcctgtttgacttattccaagctgctatccgtatgtaattaatcaatggaaaatattatagtgcaagttgccaagatcaccgagctagaaaagcgaatcaaagctctggaaaaagacaagggtgaattgaccaaacagagggactcggctctgaaagacatcgaaggtatttgtagttaaaactccagaaccattcttgtcttcgtgcccagtcattgatgtgaaccatttatgcatattgcaaaattaaatctcaggctcaattcgacatcttggtcaacaaaattaagaagcttgaaggagccagggatgaagttgccaacgccgctacaccactcatccaagccatgtttttttaataataatggtctgagttcgttcgacgctattgaaacttcgacaagctgagagctgcttcggatacatactttaagaacatcaaagaagctggatgcatgggggcgagcatggcattggcaatgaccaagtccttgtacccgaagatcgatattgacgctgtcgacggctttgcagacgggaagcaaattgaattgataagaatcacactccattattattatagtagcccctgactgataactcaaggagcaacttgatgttagcaatcaaagagggaaagaagatacaaaagtaatgcctaagcataaaaacgatgaagatgctcaatattccaagagttgtcgacatgagtaccgtcttcacgcttgagtcgataagaacctggccgagtaactttagaaattatgaacggtccctcccataatggagataacttgtgccgatctcgtgtagtttgaattttcctcaaaacctggtctccgactaagaaaacccgcgatcaaacattgcggttgtgacaacgtcgcaacccttgtaaataccgagccgactgaattaaggctgccccacgggcttcttccagtcggttgagatcgtcaactcggtcttctccgtagcgctcctccttgaagttgcaaaatcgcaaagattcgaactctacctcgcttggcaacattgcttccgcaccatagaccagaaaaaacggtgactgacccgtggcccgactgggcgtagtatgcagagaccaaagtacggatggcagctgatctacccatttgccagcatagggatgcagtcggtcgaaaactcacgctttgattccttgaagtaccataccattggcacgttcgacttatccattgcttataggatgcgctacggaggcatagcaaattttgatgccgaagtcttcacaaaaatctttaaacacatcgccagtgaattgagtaccattatcggtaatgattcgattgggtaccccgaaccggtgcacgatgttgatgaaaaaatctctagccttgtccgctgtaatcgtgacgactagtttggcttcaatccactttgagaacttgtcaatagctacaaaaagataagtgaaaccaccagtagcccttttgaatgggccgaccatgtcgagcccccaaaccgcgaacggccaggataacgggatggtttgcaactcctgagatggtaaatgagtctgtcgggcaaaaaattgacaaccttcacatgttcgcacaatttaatcggcgtcggatacagtagtaggccagaaaaaaccctgccgataagccttgccaacaatggttcgtgcgacagcgtgattgccacagatgcccgagtgtatatcttttagcaattgccttccctcctccaaagacatagcattgcagaatccctgatggacttttcttgtacagctcggtctcatgtatgacataaagcatgctgcgcctggagatccgctccgcctcgtctttatcctgagggagttcttggtcaaaaacttgatgaggggctctctccagtcggcttcgatcatgcttacttcttgagtgtccacagcctcggttatttcctttcttggtatggtcggttcataaagatgttcaacaaacacatcagaagaagctgtttctcgtttcgaaccgaaattggccagtctgtcggctgcctcattgttatttcgaagaacatgggttagatcgaggccatcaaacttatcttctaacttgcgtacctcctgccgataagcagccatattatcatcgaggcaggaccactctttcatgacttgattaacaaccaactgagaatctccacaaactatcagacgccggatctccaaagatattgcgatccttaatacatgaagaagcgcctcatattctgccacattatgggacgtagaaaaatgtatccacaatacgtagctcagcctttctcaagtcggggaaatcaggacaactcctgctccggtgcctgaaagcctctttgacccgtcaaaatgcatagtccaatactccatcttttctataggcatgtcttcttggcactcagtccactcagcgataaaatctgctaaggcttgggacttgatcgaaattcgcggcttgaaggatagatccaaagacatcaactctaaagcccactttgcaatccgtccatttgcctcgcgattatgaagtatgtccccgagtagaaacgatgtgaccaccgtgaccgagtgaccttgaaaatagtgagataatttcctaacggtaattaaaacaccatataccaacttttgcacctgaggatatcttgtcttggagtcggctaaaaccttgctgacgaaataaattggtcgttggactttttcaacatggccatcttcttcacgctcgacaaccaggaccgtgctcacaacctgagatgttgccgacacatataacaacaatggctcttgcggatgtggtgaagttaagaccggtggagtggtgagaagtttcttgaggtcttcaaaggctttttgcacttcgggtccccactggaaattgtcggttttctttagcaacttgaaaaatggcatcctccgctcgccgagtcgtgagacaaaccggctgagcaccgccatgcatccagttagcttttgaacgtctttctgggaactcggcggtttcatgttgagaatggcgttgatcttctacgggttggcctgtatgcccctatgggatatcataaagccaagcaacttccctgacggtactccgaagatgcacttttcaggattaaacttcatcctgaaggcgcggatgcttgcaaaggtctcttctagatccgcgatcaaatcagccttctacttggtcttgacaactacgtcatcaacataagcttcaacgttgcgaccaatctgagttgaaaaatatctctggatcatgcgttggtaagttgctcccgcgttcttcaatccaaaaggcatggtgatgtagcactaagccccgaacggtgtgatgaatgaagtcttcaagtagtcggactcttttaatcggatctgatgataccctgagtagcaatccaggaaactgagtagctcgcagccggccgttgagtcaactacctggtcaatgcgaggtaacccgaagggatctttgggacaagatttgttgaggtcggtgtaatcaacacacatacgccattgcactgtcctcttccgaaccaggaccgggtttgccagccagtcgggatgtaggacttccttgatgaagcctgctgctaacagcttggtcaattcctccgtgatcgcatccttcctatcctgtgcaaaacggcggagtcgttgcttaatgggtttagcgtcttccttaatatgtaaagagtgctcaataacctctttaggaataccaggcatatcagatggtttccacgcaaagatatctttattattttgaagaaaggtgatgagcgcgctttcctatttacaatctaactcagcgcttattacagcagtcttagtgggatcagagggatctagaggaattttcttagtcttggcatcgccttctccgctctttgatatcttggatgcatgtcacaccctaaaaatcttaaatatataaattgttgtttaattggaattattagaattgattttaaaagcctagaagagaagatctaattttaaataataaattccaatataaaattgggccagataaaattttattaaaaattttgcttgattctatattccttgattttctgggatttatttgagccaaggaagtatttttaataaatggaattgaatttcatgaataatttaaattggaaaagttttaaaaagtcttcttttggctttgggccgaaagtcggcccaaatctctctctccctccctcggcccaagccgggcccgcaagcgagccgccgctcacgcgtgcgcgcgcatccgcccgctgacaggtggggcccaccagtcagggccgtcgtcaacctccagccgtcgcccgactgaaccctagccgagccgcgccaccgtctccttccaaattcgttcatccctttcccgatccggtgaaattgatagagggaaaatgatccccgagatccactctaccttttctcttttggaatcgtcggctaacatcgtttggaaattggtagattcgatctcgaatcggattcgtctctctccccgaaccctagactttccttcgggccgccggccgccgtgggccttcgccgccgccccctagccgctataaaaggaccctcgatgtctcctctctccgccgccaccctcgctttcgtctctcaccgccggtagagctctagcgccatgtagcctagcgccaccgtcaccgccgttcgtccagccgtgcgccaccgtcgctccggtcgtcgtcgtcgctcgggaaagccgccgtcgtgatcatcaagtcgtcgctgacctcgtccgcccctccgttgtcgctgtagatcgccggagccccgccgtcgtcgtcgagccgaaggtcgccgccgcttcttcctcatcgctgtcgccgtccgttgaccatctgctgccgttttggtcaccggtgagttcgccgcgtcgcccgcaacccgtaggtgccgtccgttcgcgccgccgtgccgtcatttgccggtgagcacgcgaggccgagccaccaccggtgatggcgtcaccgttgacgtcatcgatgccgtccgccatagacccgcggtagatcaagatgatctcggtcgttcattttggataggatcaatcccggccgttcgtttccgtgagtcaccgccgtgcacccggtccaccgtgaaccctagccgctgacgcaataatccccttttcctgttcaaaaataattcaatattgcgtcataattcaattaaaatctatataaatgatttaatccgattaaatctttgaaaattcataactaattcatcttagctcggatttagttggttcaagtctctaaatttttctaaaattgagatctacatgttaaaaatatccacatgtactgctcatgcttgtttatgtgctatttgggtgattttgttcttttctctttagattccgacgttcccggagagtccgaatttgcaggagaagactttgaagagttccaaggccagcaaggcaagtcacacagatcccaaacgatcctttgagcatgttgatcccgtttaaagctattgtttctattcaactattgcatttatttttgaatgtcattgggtggaaataacctattgttttgttatggcccttttgtccttgattactctattccttgataccttgggttattataattttactagttgagctttatatgttggttcagctagatattagacagaattgcttagccatgcttagagacactagctcatataaatgggataacttatgattcactattatttaatgatggcttaatgatagctcacgatggttgatcgtgattggttaattaatcaatttgccaaccaaaacctgataatggtgggttgtgagcatatggttttgatggttgtgctcatgacaattaaggaccggttcacgattttcggttgtgaaacatttaccgtgccaaccacaagccagcgttggcaacggctttactttctgtatagtatggttcatagtagagcaccagactgtgaagtggcggagataagcccacgggggtcgctggggagtccatgccttgtttaagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctttggccagagtttaaactattcgaatagtcgtgcccgcggttatgggcgggtctaacaatgtctttcgtgattagtctcacatttctcaccatattaatgttaataacttggttagctcctggtttggaatggttaattcctggtttggagttagaactgtgcagccggggttggttgttcagaatggttgggcctacgcaacagggtatgttgcatagcgttggattaatattgtttaattattatttaactgttttattaaattctgaaatatttgttaaatgctatttatgcaaatgagactatattatgccatcctttgctatcccgtgcacttgcatatttgctacgtggcttgctgaatatgtcatatactcaccttgcaatcattcatcagaggaggagttctacagtgatgctgttggtgtggatgattaggagtagccctggtcaagctgcctgtggagaggagtcgcctgcgctgtttcttttattttccgcttcttagaactttattgattgagaggaactatctacctctgtaatgacattttgttcgcttattaattagagtaataattgtactgtattatcaatttgttattgtgtgcctcggctgattcctggacgagggtttacatacatgtaagcgtttggaattttggatagaaattccgggcgtgacattgcaggcacttctccttcggttgctgttgatgcagccagtcggatctcctctcgagcgagcgtgatctcgcgagtctgggccatctcgcagctttccttgtcgcaggtgacggtttgcttgatgtcactccgcagggatatgactcctcgaggacctggcatcttcatcatcctgtagatatagtgtgggacaaccatgaacttggctaacgccgggcgtccgagtatagcgtggtacgctgtctcaaagtcagcaacttcaaagcaaatgttctctgtgcgaaagttctcccgagtgccgaaggtaaccagcaaagtgatctggccgagtggagtagaagatagcccggggatgaatctgtgaaagggcgcactactcggcttcagttctgtccgagggatctgcatgtcgtctagagtcttggcaaaaaggatattgagtgcgctgccaccatcgatgagagatcgtcggagcttgacgttgcgaaccactgggtctagcactagggggtaccaccccgggtggaccactcggtcaggatgatccgggtggaccactcggtcaggatgatccgagcggttaaacttgataactgtctctgaccaccgaagatattggggtgtatcgggctgaacaacattgttctcccgtttggtcagcttttgctttcgcttggattcataagccaggggtccgccaaagatgtcgttgagttccttgcgggagtcttgaaaaccagtcggggcatcatcttcatcatccttcttctttgacatgctttgatctccgtcagtcagcttgcgtgcattcttggcgtattgctctgcgaactgtttctagacgaagaaatatttggccgcatgatttgaattcggacgatgcgggcattgggagttcatgatcttgtcgaaagtgttgacgtgtgagcgctgtcgggaggatggtgtagtagttgccacaagttcctcgggcttacgcttgcgatccttgtgattggcacttccactcccccctgtagtcggcgcatctttctttggcttccaggtgctgcccgactgcttggatgcaatgacaacgtcttctactttggcatactcattggctttttcaaacatctgcttgacagtcttgggaggcttgcggccaaacttgccgactagttcatggcgaatgcccttagtgaaggcggcgatgataacgtcgtcagtgatatcagagatcttgttacgttgctcagagaaacatcggatgtaatctcgaagggattctccggacttctggataatgttgtaaagatcaaactgggtaccaggacattcaaaagtgccctggaagttggcgatgaagtggtcacgaagctccgcccaggagccgatcgtgtcacggggcagcccgtgaagccaggaccggacagagtccgctagggccacggacagataattagccatggctttgctatctcctcctgctgcacgaattgcgagaccgtagactgtgagccaagactcaggatttgtcgtgtcgtcatacttctcaattccagtcggtttgaagccggccagcaaatccactcggcgtaggtcacttgtgaaggcagcaactccatccacatcgtcgtcataacgatctggtgaatggtgggggatgtggcctctcgccgcacatcactggttgatagtatcgcgatgatcgacgggacgccttcgacgtggggagcgaggttgttcgacccgacgctccctgtgtcagtcggtgtgtcagtcgggaggcgagtgaatagatcgttcaccgtgatccctgctcctaaaaggaggtggctatcaagctggagaagtggatgggtttagagacaaggaaatttatacagattcaggccttcttaataagaagtaataccctactcctatccggggattgatctgccgagggttttattgatcgtatgatctgagagaaaaatcatgccccaagaggcacccggacccctccttatatagggaaaggggtccgtattacaaagtacagcccatatccctaacggaataggtagttacagataagatacaatcgtaaccgactaggatcccgggtatttcgttgacatacaagtttggaatttaacccgagtccctttgaagatattctatctatacatggcaccccatacctagtcggatatacatgccgtatgggtatggggtatccataatctccacacttctacaaccctaaaccagattcaggcgtctcttccgcccagcgacgacggcgaggcagcactccacggtggtggtgccgctatgcctgacgcagtagttccaggaggaggcgcgggcggtacatggcggtatcggcgcggcagtcgcaaggagcagtcaggagtccgaggcaatggcgcagggtccttaggcggcggcgatggcgctggctccacaggcggcggcgcggtggtcacatgcatcggcgcgggctccacaggcagcagcgctggcttcgtaggcagcggtgcggcggtcacaggcgacgacgaggagccgcaggcgccggcgcggaggtcgcgggctatatatgggtgattttcttcttcctcgccttcttctttagctaactcgtagcattgctgctgtttgtttgtggcttgctcttgccacgcagagattctgagattccagcaacagcggcggcgtggtgggatgtgttgttcatatgctttgcttgactttatatcatagacccgcaatattgttgcctgtatttttcctcttgttttcaagatcgacttttttagagttctgctagcctgtactgttctgagcatatagtggtgttcatatgagttcttgcctagctattttgtcattcagtttaattttggtggttcctgacattcaataaatttggacaaattttggtctacaactcgaaaatgagttcgtatatcatagtgcagatttcagttttaggaatagtaatcctaaaatttggacagtttcagttgtgtgaaaattgaaaatttcagtttaagttttaggaagaatattacctggtgcaaatattccaagaaaaaatccactctttaccaaagtactacctccgttccagtaaaaaagaaaagtactacctccatttcaggttataagactttttagcattgtccacattcatatagatattaatgaatctaggcacacatatatgtctagattcattaacatatatatgaatgtgggcaatgctagaaagtcttataatatgaaacgaaggaagtatcaggcagtagttttgccgatacattatccagccttcgcaagggcagaatggtctttacaccatgtccaatggagtagagctgacagagcagtgatggtgatggcatttctgagagaagttgattcgcacgatggcattttggaagttagattcgtcaatggcttttcttggattagaacactcgtcgatggcatttcatagattttcactttgacgtaataattcaatactcatgtggtattcctccgttagagaacatgtaagctttgaaatcagtcgagctttactgtggtctaaatcaactatgcaattctctgtagactcaagggttaattagctccttgccactacaaatataccaaattagaaaaatattactactattcacgatatcagcaacgtgtcactggaatttggggaaattggaactataccactccgttgcattttccatccacttttctatcatccccgttaattctatctgccaactacggtggctagccaacaacgactatgcagggtgctcaactgccgaaagctgtcggacaaggcgtgcgcgcacgaggcacagaatgagctcatcccgctccgtgtggtggtgcaggttctcttctttgagcatgcgcgcgcggtgttcaagattgccatgcatccgatgaagctggaggaggattgatgaggacatcccttccaacgatacaaccatgcctattgcacaacaaggaccaatgactagagctcgagctcgtgaacttaattatcaggtaaaaccattcctagctaatcatacaagttcttctcagaattgggtgctactaaatagttgttgtgatctacttgttgttaggaatatgggagaggaaccagatcgcaagcaacactagcaatgctgatttgatgaagtcaatgctcttcactccggagggcaaacggggcaaatgagtacttgttggaaatatctcatcgtctactttcagctatgtatggcctcaaatttgacccaggctgctcagaatgacgaaaataattcttcacatcagaaacttgggcttgggccttgtatctttacagcccattaggggtccacaaaacctagggtttgctcccacctcctctcctgatcattcctccacttatataaactcctagcagccaccattttgcactttgggttttgtttggatgtaagtttagctgcagctacttccttgtactcgcgtgtgtcggctagaccacccggatacttgtattcagaaccccattctggtttgtttcagtttcatcacttgacaagtgacgtgagttgtttccttgtcaacttgttcttgctagttcttcgattgcttgcaggttcaaggttgttcttggcacggtaagaacagcaacaacgtggagtcagtgtaccggttgctaaggcgcagcacctctgtggtagttgtagtcggatcgccaacgtcgtgtcctcccccaaatcgaagtttatcctcctcttatcgaaagatcgggaacccctgctgctgcatcaagtggtatcagagctcaagttgctaggtgagagattttatcacttctttgtttttacctacagcccaaaaaaaaccacaaaaataggtcagatccgaaatcaccaaaactagttgagcctttgtagttctacttagtctttgcttgctgagttttcgattgcatcgattggttgagttgttggttctagtagtttagtcttttagagtttcgggttctactcacgattttgtcaccacatacacttccaccatcacttcatttatcttcatcccgctgccaccatcaccaccatattcaccacgaaatccacctccaaccccaccaaatttcgtccaccacaaccagcagcaccctcatcaccacatcaaccacccccaaatgcatttattgctgcctccaccaacagccaacccttttgcaactttttgaagtgaatcagcccttcccaagaaagcatttaagtactctcacttttgacttgttggctgaatcatgtaactagccaaccaacccatcattacttcttgttttgatttgttggctgaagcttgtgaaatttcgaaaatgtttgggaaaaggttattttgctaaggcttgttttgacttgttggctgaagctttgagcttgctgtaaaaaaaagaaagaaatgaaaaaaaagaaagaaaaaaatcagaagtgaagagaaggaaaaaaaaggaaggaaagagaggaagttgttgttgctgctgttttgtttgtgttattttcgtgctattttgcgtggctacgcttgtgactaggctcgcgtctctaaagggttttgcctaggaccagcacaataccatcgttgagcgattattcaacttgcattgattaatgtggttctagttgtaccttgatattacttgcagccacctatagctccacaatttttatctactatatcacaggatcgtgcttgttgtcggctccggtactactaaccattgttgttgttcttgctggttgccaatgccttttacataacaaagtaagaacatgtaagaactcgtttgcacaagtttggtagaaatggagatggacaacacctagctccaatagttgataggacatatttcttgtgaattgtttcttcccattaaccatgacaggaggatcgagggagcacactcaactttcaccacgtacgagggacatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctttgaacacttctcttgcaggtatcttgaatacgttggagagaatgggccaagatggtcatgatggatcggctaggcgcaaccacaatggccatgatgctaatagcaacatcgcggcaagggaagaactggagtacgctactgacaccgagcatgatgaggagatacttggtcgtccacaaagacaacagtgccggcagcgccatggcatgggcgctccaccacgacgggaggtacgtgataatgatgattctttaggcacgatcaagtttaccattccttactttgatggaaaatatgaccctgatgcatatcttacttgggagttagctattgatcagaaatttgcttgccatgattttcctgagaataaacgtgttagggctgctaatagtgagttcactgattttgcatccatttggtggagtgaatttgttcgttccaatccaaataataacactccccaaacctgggatgcaattaaaagagtcatgcgagctagatttgttccttcatatcatgcacgtgatttgctgcacaaattgcaacaacttagacagggaaacaaatatgtagaagagtattatcaagctttgcaaacaggaatgcttcgttgtggattggtagaaaatgatgatgctggtatggctagattcatgggtgggctgaaccgagaaattcaggacattctagcctacaaagaatataattcaattaatcgtttgtttcatcttgcttgtaaagtg

SEQ ID NO: 37493 - DNA, 895 bp, Oryza sativa
catcagtggcatcatcagaaagaacaaaatatattcagtgcctacgctgcatgggctatggtcacgtgtgcaaggactgcccaagcactcgtgtaatgatcgtgaagagctgatggtaggtactcctccgctagtgatttagatgaagaaacctatgctttgcttgcaactaacaatgcaggggaaggtgacgcgccccacaaagatgagaaacacattggggctgaagctgcagagcactatgagagcctcgtggtgcagcgagtgctcagcgcacaaatagaaagggctgaacagaattagcaccacaccttgtttcaaaccaagtgtgtgatcaaggaacgctcttgccacgtgatcatagatggaacgtgatcatagatggaggaagctgcaataatttggctagtgctgaaatagtggagaaacttgcattgagcacacagccacatccgcagccctactatattcaatggcttaatagcagcggcaagataaaggtaacacgattggtaagagtacattttgccattggttcttatcatgattcaatcaactatgatgttgtgcctatgcaagcatgttctatgttattaggtaggccatttcagtttgataaagattctttacactttggcaaatccaatcaatactcctttatgtataatggaaaaaaacttgtgttacatcctatgtctcctgaagtaattttaaaggatgaacttgctgagctagcaaacaaaaaaatcaggagcatactaggagtgagcatcttattgcagctaatgaacttgagaagcataagaagaaacccaccaactctgttcaaaataataaaaaagagattaagctgaagggatcttgtttcattgcaacaaaatcagatttggatgaa

SEQ ID NO: 37494 - DNA, 41801 bp, Oryza sativa
  unsure (1)..(41801): unsure at all n locations
cactaatgcacccagtactttcatgagattaatgaatgaagttttatgtgctttcattggcagatttgtggtggtatattttgatgacattctcacatatagcagatcaatagaggatcatcatggtcatttgcgtgctgtttttgatgctctacgagatgcacgtttatttggtaaccttgagaagtgcacattttgcatagatcgagtctcttttcttggctatgttgtgactccgcagggaattgaagtagatcaagccaaggttgaagccatacatagctggccggttccaacaacgatcacacaagtgagaagctttctaggagttgctgggttctaccgccgctttgtgaaggattttagcaccattgcagccccactacatgagcttaccaagagaaatgtgacattcacttgggctgtagcacaaaggaatacattcgacactttgaaagataagttaacacacgctcctttattccaacttcctgatttcaacaaaacttttgagcttgaatgtgatgctagtgggattggattaggtggtgtattgttacaagaaggcaaacctgtagcatatttcagcgagaaattgagtgggcctagtttgaattattctacttatgataagaaattgtttgctctagtgcaaacattggaaacatggcagcattatttatggcccaaagaatttgttatacgctctgatcatgaatctttaaaacacattcgaagtcaagcaaaacttaaccataggcatgctaaatgggttgaatttattgaatcttttccatatgtcatcaaacataagaagggaaaagaaaatgtcattgctgatgctttgtctagacgttacacaatgctatcccaacttgacttcaaaatttttggcttggaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctctgtgcgtatgctattattgcaagaagcgcatggtggagggctgatgggacactttggtgtgaagaagacggaggatatccttgctgataatttcttttggcccaagatgaggagagacgtggagaggttcgttgctcgctgcacaacatgccaaaaagctaagtcacgccttaaccctcatggtttgtatatgcctttgcctgttcctagtgtgccttgggaggatatttctatggactttgttttagggctgcctagaacaaagaaggggagggacaatatctttgttgttgtagatagattttctaagatggcgcatttcataccttgtcataagagtcatgatgctacacatgttgctgatttgttctttcgtgagattgttcgcttgcatggagtgccaaacaccatagtttttgatcgcgatacaaaataccttagtcatttttggagaaccttgtgggctaagttggggactaaacttttattttctactacatgtcacccccaaactgatggacaaactaaggtggtgaatagaacattatctacaattcttagggctgttttgaaaaagaatactaaaaatgtgggaagaatgtttgcctcatgttgagtttgcttataatcgttcgcaacattctactactaagaagtgcccttttgagattgtttatggccttctgccccgtgctccaattgatcttttgccccacccaacttcagagagagtgaactttgatgcaaaacagcgcgctgatttgatgttaaaacggcatgagaccactaaggagaacatagagcgcatgaatattaagtataaacttgctgggagcaaaggaaagaaacatgttacttttgaacctggtgatttggtttggttgcatttgagaaagaataggttccctaatttgagaaaatctaagttgctacctagagctgatggtcctttcaaagtaatacaaaagattaatgataacgcatacaagcttgagctacctgccgattttggggttagccccacgtttaacattgcagatttaaagccatatttaggagaagaagatgagttagagttgaggacaactcaaatgcaagaaggggaggatgatgaggacatacgttccaacgatacaaccatgcctattgcacagcaaggaccaatgactagagctcgagctcgtgaacttaattatcaggtaaagtgattcctagctaatcatacaagttcttcttagaattgggtgctactaaatggttgttgtgatctacttgttgttaggaatatgggagaggaaccagatcgcaagtagcactagcagcgctgatttgatgaagtcaatgctcttcactccggagggcaaacgaggcaaatgagtacttgttggaaagatctcgtcgtctactttcagctatgtgtggcctcaaatttgacccaggctgctcagaatgacgaaaatagttcttcacatcagaaagggcttgggccttgtatctttatagcccattaggggtccacaaaacctagggtttgctcccacctcctctcctggtcattcctccacctatataaactcctagcagccaccattttgcactttgggttttgtttagatgtaagtttagctgcagctacttccttgtactcgcgtgtgtcggctagaccacccggatacttgtattcagaaccccattttggtttgtttcagtttcatcacttgacaagtgccgtgagctgtttccttgtcaacttgttcttgcttgttcttcgattgcttgcaggttcaaggttgttcatggcacggcaagaacagcaacaacgtggagtcggtgtaccggttgctaaggcacagcacccctgtggtagttgtagtcggaccgccaacgtcgtgtcctcccctaaatcgaagtttatcctcctctcatcgaaagatcgggatcccccgttgctgcatcaagcacgaccacaatggcagtggtgacgaggacgacgagttcgtgcgctggtaatagggtgcgcaaggatagaaattgacaggaatgatagaaaagtgtggatggaaaacacgacaaagtgacacggttttaatttccccattctagtggcacgttaccgatatcgtgaatagtagttgtatttttttaatttgtcatatctgtagtagcataaatccaaataaccctaaaataaattgcacaacctgatttcccaattaacttatccctctggttttccgcacgcgcgcttttcaaactattaacggtgtttcttttgtaagaattttctatacgaaagttgttttcaaaattatattaatccatttttttaaaaaaattaactaatacttaattaatcatgcgttaatacacacaccgttttgcgtatcggagaggaggggttcccaactcctcctcccgaacacagcctttagtgattaggatctccgtaggggagacggagggatctggcagcctataggctctttggcaggaaacaatctggaaataggtggtaatcctatcccagattcaatcgggtctccagtctttgcactctagggtgtcgagacggacggcagtagcgacctccgggtgtctgtgcagcaccagcaagagttgaggcagacagcagcgcgcagcaacctcccagggaagtggctgacaagcttgcgttggtgcgaaagcaacatgctccctccactatcagcgtccacatctggacgcgactcctaggagcatccatgtttggacgctatttgtagtagcgtccttattactttggttcatctttcctcttaattactaataatttaatttaagggattttaattattataaataaaaaagctggtgctccaccactgcttcctcctgctcctgggatggagccccatatccgatgcgaaaacccgctcccctgcttcctcctcctcgtccttcctgtcacgggctcgtggcgtgggatgcaacgtggtgctagtgtgctactaattgagacgactgagtaagtgtgttcctagcaagggagcgtggtaagtcttccatcccgtgccaccctgttagatgaggtaattggtgctatcgtcgttgcgcattagactccggtcaaaatttggatctatagcagaggagaaaagggaaatagttaggcaagctcgtcatccctgcacgcggaacgtatttcacactggagatggggctccactgcggcactgccccagctgatgagaagtagacaagggagggggagacgagagggggggaattaagcacttgaactagaggtagaagataggtgctgtaagattcatgcgcacacgtggtggtagataaacggagtctttccaaacgtgagaagtaccgaggtcctgtacagttttcttccattgagtaagatggcttttctgacacaattgattgtggggtccagttcgtccaagatggacgagaagaagcacaacacggatccaaacactcgaggattaaatcgaaagaaattcatcctaaatttttacgaatgactgttagcaattttgtatattgtaaatcatgcttgcacatatagccatcaatttgggcagaaccatactttcctcttactgttatatagcatctcgcatgaaacatgttgcattgcgttcaaggtatatattaggttaaacaacaacaatggtattatttccataccattatatgaatattgtaaaatcacatgatcgtcatgaccagatgaacgaaattaatattgtttgtacatgaccaactagagagctgttcagctaaatttgcaaaataataacacacagtacaaaattggccggtagctagctaggtttcgtctaactgccatgcaggcgaaccctagcgcgaggttgccagccaggggatccatcgcgtggtcgtgagcaaggctgcaataaccgaagctcgaggcaaaagcgtccgcaagagagggctgcaactctggtgccggccactactagaaaactcattttcggcgtcgtagggtatcaattttcgcaggcgggcatgtaattcggagccaaaaccccactggcaaaaaatgtacccggggtggagggcgcggtccgcctgcgaagatcgatctttgtaggcggaccatataagcgtcgcctgcgaagatcgatgttcgcaggcggcaaacgtcgtgcgcctgcgaagatcgatcttcacaggtgccacttatatggcctgcctgcaaagatgcccctatatagtcttcttcctacccaagccctattcattctccccgaagtttctctctcctaaagtgacttaaatataggggggaggttttgaacttcaaatcttcgggggatttttctacggtgcttagatctactcattttcacactaggtatgtaattttttaagcttttagacctcaatttctgatggatttatgcatgcaaaattgtgaaggaagagctctatgttttttaatttaatttcttttgatatgttgatgttagatgtatgtgtaatacttgatgcctcttgttgtagtgatttaatgtggtaacataaattctcaattttttttatttttgctatcacatccacctcctaattctagatctagatctagatcttgtcatatatagagagagaataaaatttttaatatctatttattcggtgcaatcaaaaaatagttatagtagtttgtaatatgccgatgatatgattttgttagattttcctaatgtactaatttggcaagtctgtgtaaaaaaaattgaaataaactttgtttttttattaatttacaattaacctttagttaattagttttgaatagcgataagttttttcagtaaaccctacaaatttggtattaattgtgcaaaattttatgtgcatttttttagagatatggaaagtcgggaatggatgtatcattggccgaggtttttgtctccatatagaaacgaagtgtctaaatttattgttattgccaaggcacacgctgaaaagaacaatatgaggaagataatttgtgaatgtgctgactgtaagaatgaaatagcctgggacttcaacgatgcttttaaagtaaaggagcacttagtaactcgtggatttatggacgagtacaaaatatggacacgtcatggcgaagaacaagtggacgggcctgaaaatgtagttccgacacaagttgaagacatggtgcgtgacgatggttctgttgaggacaaaatcgacctacaggaaatgttacgtcatgcagaacccgaggtgctgatggggtcggctagagggttaaataactttgaagctttacggaaggtagcaaagaaatttttgtacaatgagtcgaagggctgtgacagtgagttcacaacactacggtaagttctcgaacttatgaggttgaaggcgatacatggatggtctgatactagtttcgacagtctgttataacttctgtagaaaatgctcccgaggcctaactcactaccatccagcacatatcaagcaaagaaactcatatgtcccctttcacttggtgtggaaaagattcatgtgtgcgtaaatcactgcatactgtacaggaaagagtacgcttctttagatgaatgtccaacatgtggtgctagccggtacaaatcgaatagcaataatggcctagaaccgtctgatacaactgagggacgacagagaaaaatcccgcagcttgtgatgtggtaccttcctgtcaaagaccacattaaacggatatactcaaacccgcgagatgcggaactaatgcgctggcatgaagaagggcgcaagaaggatgggatgattcgacacccgacagatgctcgtcagtggataaactttgatgctcagtatagagagtttgctaaagacccacggaacattagatttgccctgagtactgatggagttaatccttttggagacatgagcagctcacatagtacttgccagtgttctcaccatgtataatcttcctacctggctttgtcaaaagcaaaatacgtactactctgtatcctcatacagggaccccgtcagcctggtattgatattaacgtatttcttgaaccattgttggaagatatggctgatttatggaaagagggattgaaagtgtgagatgagtacttaagggaatacttcacagtgaaggccatcatcttcgtgaccattaacgattatccagtaatgttttcagtttcaggtcaaattaaaggtaaaacaggatgtgtaatctacttgaatggaacgtactataggtatctcccgggttccaacaagcttgtgtacatgcggcaccggcggttcctacgcacaaatcacaagtaccacaagatgaaggcggagttcgatggcactgaagagactaatcctgcaccaaaacctacatcgggagaaaaggtgtgtgcaatgacagaaaattgtttgcgagtttggaaaaatgactaagaaaccatcaaagggaacaaagcgcaagaaacccgaaaagaatatgaaacaaggggatagtaagaagcaagatgatagttcgaagccagatgataaactccctcccccattcaagaagcattccatattttttaagtacctcccatactggaaagatctggaagttcggcatgccatagacgtcatgcatctagagaagaatgtgtttgacaacataattagaacattgttggacatgccaaagaagactaaagatggtctgcaatcaaggatggacctagtcgagatgggaatcagggaagagttacaccctcaaggagagaagaatgacaaagtatatcttccaccagcctgtttcacactgacacctgaggagaagaagtcattttgcaactcactccgtgatgtcagagtcagtcgactagtttccatgaaagatttgtcggtatctggttataattcacacgactgtcatgtcttgctcactgtgtttcttgaaattgcaataagggccataaaaccggagcatttaaaggttactatcacaaggttgtgctactttttcaacgcagtgttgcagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccattgtacctccatcaaatgtggtcatacgagcgttacatggcggttttgaagggttacgtccgaaatcgtgcacatccagagggatcaatggttgagggttatagtactgaagaggttgtcgagtgctgtattgattaccttaaagatggatatgcaattggagtacctgtgccccgacatgagggcagattgagtggcaggggaacgataggaaagaagagattcgtcacccatggtcacaaatcattccaagaagctcacttcagcgtgcttcatcagtttgctatcgttgagccgtacatcgatcaacatatcgaacaaatacgagctaacaataagggtcgcaccaccgagtggataatgaaagaacacaagcgtctcttcatagattggttgcgagacctagatttacctgagggacaaactaccgatgaaataactatgaagcggttggcttgtggtccatcaactacagtaaattcttggtagggatatgacattaatggatactcgtttagtacaagagcccgagataataagacctgtacacaaaacagcggtgtccgtgtggaggcaattgatgaagccggggaaaaacaatcatacttcgggtttattgaagaaatatggtaaatcgactatgggcatacaatgcaattccccatatttaagtgccagtgggtaaaatacccgaacggggtcaatgttaataagttcggtcttactgttgttgacctggcgagtgtgggtcacaaggatgacccttgggtactcgccaatcgcgtggcacaagtgttttatgtgaaagacccatcaaatttgaagaaagatatagtgctacccgggaaacaaaagatattgggagtggatggggttgaagatgtcgtagattacaatcaataagatagtatgccactttatagtcagtttgtacagaagattaagaatgtcgagacatctactcagaagaccgtgaagccttacatgcgcatggacggtgtggggaaaaatgttaaagggtaatgattgttgagtcgcatgtaagcatctaagaagttagtagttatgtaatggtggtatgttaggtgatgtgtgatcatatcgcaaattgacgaacaattgtactcaacattttgcatattagtttgtactaatttttatacaattgcactcaacattttgcatattagtttgtactaatttttatgtgcaattaccatttgtagggtaacatttacagttttttattttttaaaagtttttttaaaagaggtttaaaattttagtagcattttgttatgttcacttaccattatttgaaaacttattttaaaaagatttcaatcaatggtaagtgcacatataaaattgctactatatgttttttaaagtagtaatattaatgtttgaaacatttaagtaatatttacatttgaaaagtagtaatactaaggtttatctacttgtatgtacaattaccttttttattacaactactgtagacatgttcaaatcacaaaaataattttaaaataattctgaaataaatagagtcatccttgtaaaaatcttcgcaggcggaccgtccgcctgcgaagatcctttccctatataagggcaagcccgcggcgccaaaatttctaagtccaggcgggaaccctagaaattttggcgccgtcaggctgccaaattttttcacctccgccgtccttcgccgccacccgcctgcgaccttcaccatccgaccgtcgtcctccgacgccgccgaccgtcgtcctctgcgcgccgcctgccttcgagctcgcgccggctgcacgctacaccgcgccaccggccgtcgatccagctccaccgccgcccgctcccgtagccggccgcatcgccaccgcctaccgctccaccgccgagctccaccgaccgccgctccaccgctccaccaccgccactgccgtccaccgcgcgcgcgcgagctagcgctccaccgccggcaccgtccatcgccgccggccacttccccccccccccccccccggcccctccaccgtgctgccgaccactccaccaccgccggccgctccacagccgccgccgccatctctctctttctctctctcgcagtcgtccacgagcggcttcatcggcctttcgtcgtccacgagcgaagacgtcctcggccgaacggcttcatcggccggtcatcgtccacggccgaacctcgtcgtcgacccttccttcgtcgtccacgaccgaagctcgtcgtcggccgttcgtcgtccacggacgtgtgtgaatgtgggtgtttctttttatatgtgtgtgcatgtgggtgtgagggggtatatatgtgtgtgcatgtgggtgtgaatgggaatgaggggtgggtgatatgtgaatgattgtgaatgtgaatttgggaatgtgggtgatatgtgaatgaaattgggagggtatgttaaattttgcaagatatgtgtatttgtcaaatttttttaataacatgtgggagggtatattaacatttttttaaaaaaaatatggaggatatgtttgcctttttatttttttttaaacaacatgtcaaggaaatgtaattgttaattagtgcactacttgataataacatatcaaattttgtacaaatttgtttgtactaattaatttagcataatagtaagtactaattaataatatttcgcaatttaaatttgtttgtactaattaatttagcataatattaagtactgattaatagcataagtactaattaataacatatctattctagcataatagtaagtagtaattaatttcgcaatttaaatttgtttgtcctaattaatttagcataatagtaagtactaattaataacattttgcaatttaaatttgtttgtactaattaatttagcataacagtaagtactaattaataacatatctattttcgctacgtgttaatatgggaatctcagagaatttaaatttgttcatatgacattttgttaatatacagtttatttttgtacaaatttgtttgtactaatttgagtaatttaaaatgtggaggataacttttttttatgttagaggtttgaaacgatggccgatagtactaaagggactaaagagaaaggtttaggggagcaagagcagtcccttgctgctgtggttgctccggaaccaacggtcccaccggaagatagttccgatagcgacgtagctgacgaagacgatgagtactcgtcgccaagcgatccttgtccaagcccaagcccgaagagaaggaaaaagggcgacggtgaagaaggcgacaaggattacattccccctaaagaaggggtaagtaaacttaatatgtaaactgttcaccgtgactttcatgtataccttctcgtaggaaacggcgccacggcgatcaaaacggcagccgaagaaaaaagttccgtcgaaagacgacgaggtaccagctaacacaaccggctcaaagaaagcgaacggtcagcaaaggcgaagaaaaggaagggtgagagaagcgtgaatagaaaggatgaagggttccatattgttactcatgtttcgccaaaaggagagccgctcgcccctaagacggcatgtgcgaaattcagttcacagtgtggcataatagtaagggaaaagatccccatcacggtcaaggactgggatcatgtatcgaatggggataaggaagtcctatgaaaagagttgaagaaaatcttccagttcccggatggattagaggcagcagtgaagaattgtgcactgcaaacaatggccaagtcttggcgtggttggaaaaccaccttgaacaagaaatttgtgaagacgggacgcacactgtttttgacgtatgccaacataaccccgaatcaatgggacaactttctgatgttgaagaactccccagaagaaattcaaaggagccaaaagtatgcaaagttggccaagaagaacaaatttcctcatcgcttaggctccgcgggatacgcaccaaaggtggagcagtggacaaaagaggaggaaatgaggaagaaggggcaaccagtactaatggaggaatggacacagagatcaaagaactgggtaagagctagaactccgaagatcacggatgaaggcaaagtatcgtttgaagatccggagctgcagagcgttgccgataaaatagagaatttatccagttcacagaagaaaggatttttcaagcctaagagggagaaagatgtgctaagtacggcgctgggtactcctgagcatgggggaagggttcgaggtgtgtcaagctagatgagttggaaggaagggttcaaacatgacccccacaagaagcgtgaagcgtataaggataaacttagagagaaggggctgcggagtttgaaaggcaaatgatggatttctgcgtcaagcacatgcttttgcctcgccccgaaaccaaagaacctgagccagattaccccttcgatgacctcaaagagaatacaccctgcagattgcacgttcccattggacgctccgggaaaactcttgaggctgctacggccattgctatccctaggagaacatataatgaagagttcatacccaatgcgtatgccaaggtgcagccgcaagtggtccacgaagggtttgagtcctacgacattgacttcccgactgcagatggtgtatccatacttggggatgcggtcgatcttgtaattctctagcacaagaatgacatatccttttggattgggcaccgacgccacgcgaaaacctgtggtgccaaaaccggggttgggaaaacctccgagacctcctaagaggaaggtgactgataaggcggaggaacccgagatgtaaaaggaaaatccagtgccggaagtgccaccagagattgcagtgctggaggcagccatggagattccagtgccggatgtgcccatggagattacagtggcagaaccagaggtgcaatttgtggcatcagtcgggtcagaaatagaagaagtaccacgattcgaatgggacggtacagagccagaaatatttgaagacccttctcctacgaaagaccccgaggtgcaagagaccacggtccctgagaaggccactaccagttcagaggtgcctagagcggttaggagccacaactccaagtccaaagataagaacaaggagaagttcatggtaactgtcttcagaggggtaaggaacgtgccaagctcagagatgatgacccccagaaggccgctgaactagccgggccaacatacttcgcaaccaatgattgcccggaaaagtacgaacatgggaaagcactcttgccggaatgggcactgaacgaaggaccatgggagatgaaaaggttacataccttctacatggaggccagcaagaaaggcttgggcaatataacagctcgatcgctggcagattgtttcggtgaagaaggttacgtatggctagatttctcatatctccacaccatatatcgtcgggataagatggacgtcaactacgtcggtgtttggtgcatgtgagtatgagttttaattaattatatgaaaaatatgtacaatacaaatccatgtgattgttactaacaaacttcttctgcaggatgcaatacatggatgctaagaagaaaaaagaacctatcggcttcttgaatccaactcggatctgccaaacacaacataccgtgaggctagcaccagggtatgaccaactgaagggcatgaatccaaaagagatagctgaatataagaagggcttgcacaaggagaaattgattactgtcacacagtacattggacgagccttcttgcactttcaaaataagagagtcgtcatggccgcttataattttaagtaagtccggtacatttatcttctgcacatatgtcttattttagctggtactaactaactatgttgttgttaatatgtagcgatcattatatctgtttactcatccaccctaaagacggaaccgtggtagtcttggaccctctcaattacaaacaccaatcatacaaagaatttctaacaatcttacagtagtaagtgattatgactcttgcatttttatatgaatgtattataaataaatatcctccttaatatgaaacggtacaacatccatatagtgcgtaccagtactacaagttcaagggtggagaacaaacccgaacaagggagaagctgctagtacgtacctattgaccggtaatattccactcacttaatgtaactgccatggaagcaccactgaagactggcttctccgaccttccacccgctaccaattgtttcactaattgcaaattttaactattcttttatgatatgtcctgaagtgtcacaagcaaccgcgaggaacggtcctttgcgggtattacgcttgcgaattccttagagttaatggaaggtacaggattaacgcggaggatgtaagtctctatactatgtgctagacagcttcacatatttatgatactaatatattgtttatcttcaatgcatgcagttgccaagattagaatgtcgaacaagttttgacgatacaggcatcaaaaatgtctaacgtgatatgtgccacttcatccaccatgagtgctgtcatgtgaaaggagatttcttcgaccaagagagtgccctagccacaagtgatgaattcaaggatcttcgggagtggaacaatgctatgccataatgtattaaatagatggcgtatttgaagtgacaatgtaaaaaaatattgtaatatatatattttggcaacacttttgagtaatgtaatatatgtacatttatcagtaccaaatgcttgataatcttccaatatatgtacataataatctacctccaagaatttttattcaataatttaaaagtaatttacgggcaaattattattaaatttcaatattttctacctatcttcgcaggcggaagtttttttttgtaggcggccgattcttcttttcgcaagcggaccggactagccaacgtccgcctgcgaaaattatcttcgcaggcggacggccgccccgcctgcgaagatcggcgatcttcacagtcgttggcttacaggcggacggctgccccgcctgcaaagacccttttcggccggttgcgataatgcttttcctagtagtgggcagcgactgatctgattcctccacttcgctttccaccatatcgtccgccatgtcgagcttctgctccgtccttgcagcagcagcgaggaagccgctgcgccggagctccctccagcggtgattcatgactcgcgaggtccggccgtagacagcgtggccaatcttcttccagcagtcgcccaggcggtagtggaggcgtaggagctcgtcgtcgtcacgggcagtgaaggggcggtggtagacgtcgcgggcgaggtggtggcaccacctgtcacggcacaaccttgcagagcggcgtggcatgatcctggcgaccctactccagtggcggaagccgttctccttgacgaggcgaggcaaccaaggatgacgtaccaaagtaccggtaaaaacatcttcaatttttataatagtaaagaattggtattttcttttttttcaaacttattttttgaatttatttgaaattcatcaaagtgagcagtacgcattcgagaggggatgcgctttgggtgccattattgtcgaaaggttatacatgaaaatggaatataggaaatgttgacactatggtatacgcaagattggaatagggagatagtttaggtctttagtagtataggtaagattggaataaggagatttaggagtataggatatattggtactagggtatacatgagatgagaatagggacatgggatagagagattcttatataagttctgacccctgagatcaacggaatagtcctattcctgtttatatgtatagctccaggatgtatcagagatagaatacaaaatgggagtaagctagctaatctagcccatttgtcatttaattcagaaaaaattgctacacaactcaattttgcattaatcatactttcctcttgctgttatatcgcacctcgcacgagacatgcatattacattgcgtttaaggtaataggttacacaaaaatagtcatatactcatattaatgccttattgccataccattatatgaatattattgtaaaacaacataatcgtcatgaccagatgattggaattaatattgtttgtacatcagtacatgaccaactaaaaggttgtacagctaaaacaaggaaaatcattacagagtacaaaataggccagtagctagatttcatcaaactgccatgcacgcgaaccctagcgcgaggctgccggccaggggatccatcacgtggtcagtggcaaggctgcaagaaccgaagctcgaggcaagagtgtccgcaagggtactgcgctgcaactctagcgacggcagcgactgatcagctggctcctccacttcgctagtttccaccatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtgcagggctcccaggccacgacgcgttagtagcaggcgtttgtacggcggtcccaggcgtcaatgtgacgggcggcaaggaggtggcaggtggcggcacaaggagtgactcaagggcctcatgcatcggcacggtggtcgcagggccgacgagttttgacttgattattagtctgcacgttcaatgcctaaaatatgtaagagaaaatccatgaaatgccattttagataaactatttcagtgagtggtgattatgaaacacatacatttttaaaagggcatgtagcctagtggttgcagtgacctgagtagcaccccaaggtcctaagtttaaatctccataggatcgaatttcagattggattatttgagggctaaattccctatttgataagctatgtttctaaaattaaaaaggctgcatatatccagttggatgtagaggccggttaaagaaatacccttctaaaaaaaagaaacacatacattttccttgatgaagttcaagcaaccgtcattcggcacaaaggcagcaatcttcttcccattcttcaccagctgaacacgagcacacttacagatggcagagtttggctgcttggcctcaataccactataatgaaacagatggaaactagttcaagttaagaaagcatgagtaataaaattgagcatgagtgttgtccaggcgtacatcttctccaaaacaatgcccttggcatgagatgatccagcaaagggtttcttccactcattgccaaagtggctcttcttgtatgccttgtcggcccatctttggttcctgcggtgggtcttgagcttgcgcccagctcccataccacatgttttcttgcaatgaaatttcaggaccaacttaagacaaatgctacgtcttacgattttgccaaacatctcccgcgtgatttttttcctggcatttgacgtttttttggccacatgatctttgcacaaggcatagaagcccacgaacagcccagcagcccatcatcatgcctaaccctgattgctaactctaaccccggtccactcactgccccacacgaccacgcccgcactcgttccccgttcacatcacatcgcacacacgccacgccgcttggatctgggtccgtggccagcacccgcaccgccgtagcgcgcgccaacgacggtgctgacgtggccgtcttccagcagttggtgcgcccgccctcatctgtcccccttctcgtcgatagatccagccgcctctttgccttccccacacgcatggatccatcagtgacggcgacgggaggggctgatccagcgcccgcttggtgatcaggagctctccgtcactctcccacttctctcttgtttcctctactctctctctctctcccactccgatctggcaccccctccttccccgcaggccgcacatatcccaccgcctatctacctcacacgcgcgtggcctgatccgctccctctcccactgacaatgcgggcctagtctggcagtcgcggaaacggacactacggttgctgtctttttaagatgctatagataacaagaatataaggtcattcacaatgcatctacatggcatttggcctcaactctccaactagactgattgtatacgtggagaagaaaaggaggtggggcccatgtcttcactagcttcgcgtgtccgagagcctcgtcagaagaaaacagctttttcaatcgcatctcagcatctgcacgtgagaaagcatgacacaaagagagaagggggagaagctcaccgaaaaaaaggtaattacaaagagagaagggggagaagctcgccgaaaaaagtaattttagtgatggggctcgcataggaaaatgtttggtggggtccacctgaatccatgccgcattgtggagaggaggagcttcgctgttttctgtacgtggctgtttaggctcctcggaaaaacaggacgcattgctaatgccccaacactcattctaaagctaagagcacataacgtggcaaatggaacattccctgcaaaatgcccacaaatcaagagaagtgaaatttaatggtacagtgtactacaagcaacacaatctaatcggtctcctggacctgatggccttaatgttggtttttatagagtttcttggccttggattaaatctgacatcactcaaacggttcaagacttttatgtttcaggccaatttccaaaaggtatgaatgatactaatattactcttattcctaaaaaaaattatcctacttctcctgctgattttaggccaatcagtctttgcaatgtttcttataaaatcatttctaaatctttggccgatcatatcaaaagtgttcttcctgatttaatttcagattctcaacaagcttttataaaaggtcgtcgcattgcaaataatcttattattgcccaagaaatagttcactctttcaatttaaaatcttttaagtaaaatgcttttctgctgaaacttgatcttgcaaaagcctttgatcgtctagaatggaactttattgagaaggctcttcgtcgtaaagggtttcatggtcattttataaatcttgtccttgcttgcattaattcggcaaacttctctgtcaatcttaacggccagtcatatggtcacttttcagctgaaagaggaatacgacaaggttgtcctttatctccttatttatttattcttgcattaaatgaactatttgaaatgatatctaatgcaattcaaacaggtcaagtcaaaggagcttctttaactccaaatggtaccattattccggccctgtatagatgggactaaaacttttaagtccctatcacatcggatgtttgaaaattaattataaatattaaacgtagactattaataaaacccatccataatcttgaactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcactcttcaatgtatgctgacgatcttatgattgtaggtcaagccactcctgaagaagctagaagcatcttccaaattattcaatttttttgccatcaatcaggtcaaactccaggttggaataaatcttctattctgttcagctctcatactcctatcctatcagtgtcactcaagatattttatccattttccctgtctccttaatgaacaacaattccaaacatcttggtcatcctctcattctaaatactaaagccagaaactctgcctacaactttatcattgaaaaattcaaaaccaggctgtcaattattaaagcaaaaactttatcccatgctggtagactttctttaataaaatctgtgtttgcttccatccctattttctatatgtctaccattttacactccaaaaaacttctatataaattaactgccattatcaggaaattctggtggacaggtaccaatgatgaagacagtaaaaaaggtatttgttggaaatcttggtctgacatttgtaaaccttttgatcaaggaggtttgggaatcagatatttactaactgttaaaaaaagtcttcttattcaatgtgcttggagaattattgaaaatccaaataacttggtttctaagatcctaaaagaaaagtatttccctcagggctccttttggaaagctttaacaaaaattcctaaatctactttttggagttctattctgaaaattagacatcttttggataattctatcatatggcaactttctcaaggtgatatctcaatctggaatcaaccttggtgttctgtttggaaatcccttcctaatcatattactgattctgcaatgactctttatttacctacaaaagtttctcatctctggaatgataggaaagaataggatatttccaaagtgtctcaaatctttgatccccaagtttcaaatgaaattttaaaaactccaattgtgcattctaatactgatgacaaactttactggattcataactcaaaaggtatttgtacttctcaaagtgcttataaagtcttatcaaccaactctatgttacctgctgctaatatttcaaatttgcaattaaaccttttaaagaaaacttggaaatgcaaatttattcctccaaaagttaaaacctttatttggagacttctcagaaatgctcttgcaactgcaaaaaatttgaacttcagaattcctactatttcaaactcctgctctcgttgtagtttgtctgaatcttgtgctcatctgttttttcaatgtgcttttgcaaatctggtttggaaactgtctgaatttcatttagatacaatcatcattgcatccatgcaaaacatcagtgatatcttagcctatgttctagctacaaacaactctgaattaagcctttaaaaagcttctattcttctttggatgatttggaaagctagaaatgacttctactttaaaaagaaaaactgggaacccattcaggttaattttgcagctcaaatcatgtcttcaaactttatttcttgtcttgatactattgatgaagatcatgaatctcaaaatcatgatgttaacagctggacttctctcaattctgcttcagtaattcgctgttatactgatgcctcctggcaggatggtaatactggtattggaatcttcatccataactctgatactcataaagccctatttattcaagctgcttctaatttcttctcctctcctttacaagctgagcatgcagcaatcatgacagccattttgatttgtcaaaagttaaatattattgatgttactcttcttttagacaatcaggaattagttagccttttgcaggttcaagactattattctcacgaacattattggagcttaaaccctttactttaagatcttatttcccttgcaggaacacaggctcttaacatcaaatggatttcaagacaagttaataagatggctgactttctagcaaaaaaagcaaggaataaatctagacaaaatctgaatcaaatagtttgtcaaaatatttcccacttatgttcccattctgactgtccgactaagacagctttggaatcttctccttttatggagaatgtatctttggttgatgtattatgcttctaagttcaataaagctctaaattctcaaaaaaaaaaagctactgcaaaatgaaatatttgtagaaaatttttttttaccatcatctgtagccatctgcggcagaacaatcccacatgaccatcatcagtgttaaccacacgaccatcttcagtgttaattaagacacaatcccatttcaaataatttggagcaagaaaactggcagaaactaagatcaagttcttgacaggctcctaacaccaaaaatattgtatgctaccatgcataggttctcagattcaagcatttaaaccaagggacgggtgattacacagcagcaaagaattaatatcgcttatgaaaatgtttatcactgacggtgtcaaatctgaccagcactggaccatcaataagctcacattacctacatctaccgcaatctcactctctaccaatccaagaacacacaacaaacgaatcaaccaaacatggcccatagctacacttcttattacaaactaaggcaaagagatagagaaaatgcttctagtgaagacacatgttaacacgagcgaacgcaacggatcgttgcagaaaccactacaatggacgaaagagaagggatcttttgcacacaccccatggcggcggagggagaggccgagagatctccgaacggcgatgcgagaggagggcttcaatgacggcggcggctgaaagtggagtgaggaaggaagacgagggagattctatagtagcaaatctcagcgatttagggttagcgtggtgcgcgctgagattcgtgttggggtgatgggtataatcccacagtcctcgtgaggtttggtgagagactacgaggcggctaggccagttcccggcccaccatgtcattcattgtgtgaacaggtccaaggcctcctattttaaaaaaaaaaaatttcgggccaatttgccagtagatttttagtttgttttctcaccttggacgtatataatcattccgatgagcattaaattttttttaggggccctatgaaaggatttgatccgtagaaaatttcagaggaaatatgacatgaagttctaaactattgtaactttggaaaaaatccaactacccctctaaactttgattggaagttcattaagcaccgtgtactttgaaatcggatatctcttactatcgaatttcatgcccgttctcgagcgattagccccgccacgtggcttcactcgattccagggttcgagtcgtgcgcgcatccgttggattagaaatcaacgggagagatccacaaaaggatctatttataaattttaatcttccaagggagtttatctcaaaatgtggcatccatcatccagattccagagaaatcctttcctcccctcgtctcgccgctttctcctccgccgaatcgccgattcacaagccgtcaccggcgttggtcaccgccactccacatcagtgcgcctccctcgccaatccccatcccctaaaatccctagcccacagctccaccatcgtcacttcacctctccgcgcctccgcatctcgcgagctgagcgttgtcgcctcctcctcgtctcctcgctcccttgccgcccgtccgcttccctggcgcagctctcaagtgggagggctgcgcgccggctggaagtctcttgactcttcccgttctatcgatccctgcggtgggagagcaccggcaaacagtggtcgtacacctcgccgatcgacttggctcgctgcggcggacgaccactatgacgtcgtccagcagctactgcatatcgactaacctcactccgtcggatcccccgcctggaggctctctgggacgacaatgccggattcgccggcgtgacgcggtaccgggcggacggggaaggctcgaacggccggttgcggtgaacgctccttggtgtttaggctggagatgataatcagggcagtccacaccgccgcaagaggcggcagcacggagatgctgagggggctcacccgacaccactgcaggttgaagtttaccacctccgtagaaagttgtcaagtgcattcctagcttacgtcaagatagagctggtgtcccctgcagggagatgctgttcaagatttatgagcaatacaatttccgcgatgatcgtccaggagtattgtccagcaacggatagtagaaacatgaaagaccaaccttttcccaccgcttatggggaatccttaaatagctatagttgcagctcatttttttgagagccacacaatgggatgctccgtttgctgttggattgaaggaatgatctaacaaattgtattattgatggtttgaaaagtgaggatattatgtttagagatgatcattacagaaactgtacaatgctcgtatatctgttcgcttgttttatatttttagatgattaaagtctctttgcggactatttttctaataataagaacattcatatattcatacattgggtctaattggactggctcatctacactttacatggcgaaaataatggcccatcaccaaatatgcgcgtcgaagccgctcttgctttctagttcaactccctgaattttctaataccatttatataagctcataacatggttttgcataattatttttatctaatttgtactttctctgtttcataatgtaagtcattctagtattttctacattcatattgatgttaatgaatctagacacgttaatatgaatgtagaaaatgctaaaatgacttatattgtgaaacggaggaagtatataatttagttgagttttatatctgttatattagctattcgaggcagctcgttttagcttttaaatacgcaagaccaacaacattcaaatcaagcttaggggataaaatgaacggtattataaagtgtaggtggggcatgatttttatttttgttttctcacctcggacatatataatcaattaaccattccaaatttccaattaaaattgtttttttggcctatgaaaggatttgctccgtagaaaatttcagaagaaatatgacatgatgttcaaaatcatgcaattttttcttacgcgctctttctaaactattgtaccttttcgtgtcttactaccatgtgaaagcgatcaagttacacaaatgcgtttagcaaaaagcaccgaaattcatatcagttagcagagtccaagtagtgcattgtacatcgacataattgaatgagtaaacataagagcactggaattactaataattcatgttttctgttggtaccaaatgtccttccacaagggaaaactcttacatggtgtcgtacagcaattctacagacacaagaccatagcccataggcagctttattatgttgtagaacaaaagaataagaaacatttgaagtacacagcctgctcggttgaattgatatcacaatttagaaacagtgacattttggggctaggagctgatttatatacctccagcccacggccaaccactttggtgaaccatataaatttcttcttgcaatttcaccttgtgacatgtactgttgcgcatacatcgtaatgaaaatatcatgcccaggactaggcagcaggcaccaagtcatacctccaattctgtgaatgctagatctcactgaagtgtcagtataccgacaaaatttgacttttgattagagaagaaatcaaatagtccggagctattatttacacaaggtttgttatgggatggtattctcatactagtcatgtcattctgaaatgtaaggctacacctttggaagatgaagatcggctagtgacgaagtgagatcttctctcgattgggatctccgactttggagtgttgtttgacctggcttccacattccactagaaaactgcatctgacctaagcttccaacagaatagctgtgatagacgcccaatgactgcctggaggactccataagctgaacactgctgcctcctaatccatggctcatgctgaatggatggggctctgacccagcaacagtaggactcagaggtgtctttgttcttgcatcacctgtgaagagaatggcaatacgaagcaaatttaaaagttttgtctataggacggaacctcaagctacagaaaacaaaaggcgagtgcaacagccacacagaaattgcaggatagtttgacttcacataatgaaagaaatctctttccatactattgtgccttcattgttaatagagttaagtaacaaaaactacttttctataatagtatattaaataattaaaaagttcagtccaacataataattaatataaaaagaaaaaagaagcagcttttttagaatggaaagatgtttgattgtttaaaattaaagagatgatgcatagtatatagtagacatatagtataacactttatttggttttccaaaaaagcagagcaaccaatggctatacgtctactaaagaaaaagaaatggtacatatagtatcaacagaattgtcagggtaaaaattttgtgcttctagaatttaagtcccaaccccacagacaatagatgctttttacatgaggaaacaccttaaagtaacagcaatgtcaaggaaaaaaaaaactcaatacatacctgaagtaatatgactccatagatgaaatctgaaaggtgatcccatgctaagcacaggactgcctgcactgttctgcctaaaaagtggcagataagacttgcggaatgatcttgggattgaattgctgacacacaatatggcacatatgactaacacaattgaaatcagaaacaacacaataagaatatttggatttatctctcggtggagtattctgtatccttgaatatcgattcgtgtagacaacacctgtccagcctctaacaaagcaaccccaagagtccaagttatactaccagagtcaattatcacctggttatctttgatctgcagcccctctctcagaagtgatgtaatataaggagccctgaaacaatactgttctataaaaggttgtggtggaacactactctttgcaaccttccatgttttttcacaaaattcctggcctctatttagaacatcaatgagagtggcatcggcagtcaaattgaaaaatttaaaaaccacatagaaaccagacatagcataaaactgcccatgtggttgcggaaaggtactaggaagagcacaaggtttagtgttgcagtcaactgagcttgcattggaccactcagaaagattcactgttaattttgcaagggcactacattcgttccactgaggcatcccgatcagttcaactgccattccctgcttctctttgcctgttgtcttccctccaacactgggacttccatctagtttgagcgggtggcagtaagaacaaatataatcttctttgtatcccgtttgtagacaaggatgcttaacctgaacttttccattaccagctgcccctcccaacttcttcacaagatgtgcaacagatttgtcaaatgcatcatttagcccataaccagacagagaataagcactaagttgatgactgatagaaccaatccttagactcatacttgtttcatcctgaatggaattatcagtctcaaatgtcacctgtaatgatgatccacctaaatcaagtgaaccatatgtcattttagaagatgaggtgccaagcatattcaaatgatggttaagagctatccatccataataagcttcatccatgccactgataatcttgactctgtctctagaacacagaaacgatgaattcttcagaatatcccaagccttgtccagaagccactcagaatctgcactcggtagcttgcgcacaccagctgtggcatatagaaaagcaggcgtgtgtttgtgtgcacgtctaggaatcaacttctcagccattcgaaggaggggctctattgtcatctttaatccagtttcattgtgaacaagtttgttcaacccaggttcagtctccattcgctgataggctcgcccagttaatttaccagattttttcttaggagcatttcctaagggtttcaaagcaataggaaatgtgtttccatcgtcatggttaacagaccattcgtaaacatacactcttgtcccagtgcttccacaatcaagaataacatagtattcagggcttccttccgagagaaagacatggaaatatctcaaagaagcatatataaagaacaccaaaaggaacagagcaatagcacaaccagcagctctcatgcatttctttcgatttgttggtgatgaggggggtgttttctcttttgaaaagcttgcaacagcgccatctctttgaagtgtgcggataggttttgcacgccctgagaccaaatcactaccagtgctagagcccctttctaatgcatcaattcttgagaacgtaggcaaatcttgaagtgaagaagacagccgcatagttgcttctttgtagtcagggtggcaattattataagatctcactggtaagggcaaataagcagttggaatcttggcaaacagaagtcataaggatgcagcataaataaccagagtaaattaattcaatagcgcctttgcaccgcctctgcctgcaagaaaattccatagttagaatatactaacgtggtaaaccacatatgaataaagctaaaatttgaaagatgctccgcactaactaacaacactctcgttatcaggcataagaaaaactttcctacaacaccaatgcaacactagcattgaagaaaatagatgcatcctaaattcctaatcttaggaaatatattaacactatataaatatcagtaatatctgcaaatcaactcacatgctaaaccaggttttccctaaatcctgatactaactcagtgcccccacgttaaactgctagtattcatatgcatcatcccaccgacactacaacagaaacaggtcaccaccgacgacgaactcccggctacacactaccacccataggcaaaaactcaaggatcgcagcaacgcgcccgcccccaaacacgccagcttcccctcgattccagcacccaggatcgcgtcctccaccacaccaaaccgcccgatcccagccaccgacccccgaacaacctaagatctaatcgcagattgccgacacgcgaccacagaaacccggcatcgaagctgccggattggatctggccgggaaggggggggggggacaccgacgacttacccgtcgcggcgggccggtctatgcctccatcgccgcccaccccccggcggcgcggggccagcggcggcgaggattgggagcacccgcgcggcgcggtggggcggaacaattggggcgaggcggcgatgtgggcgggggcggtgcccgcaacggcggcgcgtcgacgaaggaccgggcggtgtggggcagcgtggggtcggcgcggacggaggttgtgggggcgtcgtggcggatggaggtggtggtgacgacgtcttggaggcggcggcagctgagtggaggcgggcgacggatcggggatccgcagtaccggcggcggcggcgcggatgagattagggttaggggagggagggagcaagggtgagagggctgggtgatgaaggggcgatcgacggagggaggaatctgcggcggaggggaggagaccggcggcgaatcggggcaaggagggcggatttggggggcgacggtgcgggcgcgggttgggggatgaggacgcgcgggtgttgggggagaggtggagatgatctcgatcgttccatttttcacggccgtcgactgctgaatgtaagagcttaggagtgaaggattagctgggtccaagttcacagttccgacgaaaatcggttgaatttcagaaaccgtatgagatttcaatgagtttcattaaaatttaaatttgaattgataaaaaaaatcaaattaaatcttataaatagtatgatattcgtagaacctattgggatataaattttcaaaaaaattgatgtattccatgtatttactgaaatttacactagaaaagaaaagaaaaaataacgaattagaaaaagggaaaaaatcagtttacctctttttctagttatcgattgaaatctcgatgatttcgctcggaatttcgccaaagccgactggttttcgcgagcttatcggtaaactcaaggaatttgtattcaaattttggtttatgaaatttgtttggtatctaccagatttcgtgaaaatcgttattccgccagagctcgaaacgaaaggccatcttggaatcgtaaaccctggccagtgaattatagggtagatagataaatggaagtagtattttgctatacttgtggcatgcacgacgaggatagttggtaggcctaccctcgatggatttgcatgcgaccgcgcttgttgttcggtcgagagatacggcaactggcatgagggaaatatattggttgatgaggaaactgttttacgcgagagttgtctacgccaactcgctttgctggcggaaaagctatcacgtgaacgttcgtggaaattggttcacgcgaacgccccttttccggatcgtttctgtatactaactgattagatcgctgtaatttcagatcaccaactaattagatttggagatatacaacatggaccttgtgggctatagtagtttaaattgacatctttatcttatttttacttttttttgtttcttttgtgaaattattttttattctagtttgttatttattttgtgatcacaaaatatgtattcatttttaaaacataacacaacagcaaaatttatctttgaatatttttttcactattatttagagaaggaattttaaatcatatataaactttacatgtgtaaagtttacatataaaatgttactgaaaattactatgtataaagttagtatatgtaaactttatacgaataaagttacatgtataaaatagaattgtttatgttagattttagtcaaaatgagaaaagaaaaggcccggatatgatttagctaactagtgggcccgtgaagattttgcatatgcataggctaagttgtgggctggagcaacttgtgagcaagagcagacacaagttcgctcgacgcgaacagtcgcgtactagactcacccctttgctggcgcacatgccacacggctggcatgtccgtgccctcacgagttttcttttctttcatcaatttttttgccaatttttttgttatttttttattttagaaattgaatctttcatctctaattctagttgaaagtttttgaatttgagttgaacgtttcgaattttgagatcaaagtttttaaatttgagttgaacgttttgaattttgtgacgaaagtttccaaatcttagtttattgttttcaaatattgacttgatttttttttccaaatctgagtttaaagctttaaaatcttggttaacagttttgaaatttgagttgaaaatttcaaatatatagtagaaaaggtttgaattatttacttaaaagtttttaaatctaagttgaaagtatcaaatattaattgaaaagtattcaaatcttgacttggcagtttttaaatttgagttgaaagttttcaatgaaagaaaagaaatgagtttggattaagtgtgcgctacttaatttgttagcgcatatgcgtaaagtaggaaaccactcaaaggaatgttgttctcgttcatctaaaaccatccaaatagttatattttttataaaaaaatgacaacatttataccatgaaattttgtgtccaaacttaactcactctaaataaattcagcaaatgaatagtatagtggtactatatttatacccaaatttatttcctgatttgtaggttgaatttaaacttgatttttgttggagtgctagatgtcactaaactttacattgttaatttttttaaaatcttttataactatttatattgaattttcaagaaaaatgtacgcgagggaacatcgtatcgagggattagaacccactttcctggctgatgaattcggccatgcattaatacagagcagcaatcatgtctattactcatttttataatatcaattctaccgaatgcatatttctatcagtaaaataatatggaacacctcaaattaatacatacgtacatagatgagactccccaaaccagggaaatctcttggaacaacttcggtaagattgtgaggacctactcagacctaccattattttcagaagaatactctctttgagttgtaagaaactattagatattaggattaattgaattgatgtcattgtaaattcatgttattgaaaaaaaaaactattactattcaggatacctgttacgtgctactagaattttataaaattaaaaccatgccatcttcgtcattatatatatatatatatatatatatatatatatatatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaagccatgggtgtgcggcggcacaagcaacgagagagcgaggcagcggtgaccttgtcggtgagggaggtggaggctgcaaaagcagcatctttaaggcaggagccctcgagtgaatgattgatgtgagaatttgtagctgctaattaatatggaaatttttaacctttataccttttaaattaatgtggggacttctatagtggactctaatttaatatattttacgcaaggactacaattaataatatatatatatatatatataaagatataaacatttacacgtagctccttgtttctcaaatattttatcttgatcacaatgggatgtctgatcttctgccaggtaaagattaggcggagaaggctaatctccttgtttctcaaacacctcatcgagatggctaatccctacatgcgaatcacaaaacacaaacaagaacaaaggtagattacaattcaatttgcatatgaatggttaagatctcaaagttggggtttcacaaaccgaactagcagcgaaaatgcaatgacagaaataatctaagtaaaaccctactctaaactataactgctactaaattaatatgattaggaacattctatagttagtcttagggcgtccacaccttgggcttagcccatgacacaattataaggcccaaagcacaaattagactcgggctgcatatggtatgtggcttttttctgcagattcccgacaacttaagagaatttttgatgtgtgaccaaaaccatctgaaagtagactccatacgctttccaacaagtactgatgggagctgagattccttctggatcagcagctatgtccatttgatgttgatgctgttaggagggtcgattccgaataaaaagcgtgtagaatttcatcacttactttctatggaccaaaagtgacatggtgacataggagtagatttggagaaggatattggtgtgataattccagaagcattgaactctttatctctggctgtacctttgttatatattggtagaaacagcctctaccgcatgccccgttatacatcgaataagaaaaggaaacaaactagagaaatatccaagcttatcatctattatcacatgtgaatagtgctactttaatttctacaatataattggttagtccacagcactactacataatacccttttggtgctggttgggaaaccccccttaggtgtcggttttccgaaccggcactagggaggcagcactattgattccaagtgattggtaacggtttcaaaaccggcacctttgaggcgcttgtgagccaaaaaaaaaaaaagctcgatgcatcgagcgcatccaccccccacgttgcccccataatctcaaatccacaacatcaatgaatcaaccaacatcatcacaacgaataaaccaacatcatcatagaaattacagactataaactcccgaatcaaccaatatcaatcacagacatcacacaacaaacattgaaagaacaatcaactccaccactgctcaccgtcgctgtctaccagatccgccaccgctgccaccgtcaccccgaggatccgccgccgccgggccgccatcaggccacaattgcctcccctcccacagttgggccgccgggaagtaggggccgtcgcatccgggaagtaggcgctgtcgcctgaacaccattcgccaccacctcgcgcgcctcccctcccgcaggatctggtggaggggagggcgcgcaggcccctcctagcccctgcgaggccggtgctgccttcgccgcccttccttctgccggatctgtcggagggagggcgcctccaggcagccgccgctcctcccgccgcgcgccgctgacaccgtcgatgccgccgcacgccgctcctctagtcgccgcctccgatgaaagagaagagagggtgctcaagagagaggggaaagagcgcagagagaacgagagagatcgagaggagacgagagagtttgagcgagcgagcggacgctgcggaccttatctcctcgacgcgttgtggtggggcctgtcggctcatcgccggtttttaatattaaaggttctgattctaaataaaaaccgatacctataattacttaaggtgcctggtttttgcgatttcaacccgcggaggtgggaaaaggcctataagtgctggttttagcacttccatcacctatagcgctcacatctgtttgatgttttgtagtagtacatgtaacttcattgatcatgcaagcacttcgtatgcacgctcccctttctttcacccatacaaatatttctgcaaacaataagataaaaaaactcatgaaatacttacataataagcatgcacctttgattgatgaatataaaagataggcatggttatatccgagttagcgatgttctcatcacatcttgtgatgttaaaaactgaaaataatagcgtagccatgacagagttagccgcaacatttttttttgccactaaactgtgaaatcgtatgtgatttgaaataaacagaaaaagaaaatatttgtagacttatccgtgaaatcataagtgactggaaaaacaaaacaacaaaaattaggagatattttcagaaaaagtgtaaacaggagatatttccagggaaaaaaactaaactataaaattgattttcagaaagaatgtaaacaggagatatttccagggaaaaagaaaaaaatgtaaacaggagatatttccagggaaaaaaaactaaactataaaaattaaattttaaatgtatcagagccaggtttcgatcctgggacctgtgggttatgggcccaccacgcttccgctgcgccactctgatattgttgtccagagttaatctctcattcttattatcgcgttttcttgcactatccttgatctaccctgcatgaaaacggttcggaatgtttctccataccggacgtttttggaaacggaaagtatcagttggaaatatttccgaaacttttgaaaacggaaatgaattcaatttttttctcaaaaaatggaaacaaggtaaggctactatctgtgagaaacgaaatcggaatttttttggaaaacaaattctcagatttttttttctgggaatcggaaacaaagtacgtatttctcatgtacaactgattagcttcaatcttctttgctctactagtcgagtgcccgtgcgttgcaacggatcttaaatagaaaatataatatggtttaacttgaaaatatataaatgtgtgtctgcgttgttgtaaaatagaaagctatattatatttaaataaaaaatagttattcgatccgatgtctcccagatggtgtcattcaataatcgaaagatacaaagtccaaaggaacaaatatgccatggttgtacagactcataggtcatctttgggaccaattatagtatagacaacttatgattactctaatgtgattatcattatataaaaattggatgataataaacggataaaagatgttaacagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttgtcactccatttcttttacataacaaagatggaggaaatttcaagcataagtactaatcactctttatttctgataatgaatcactgcatcagtaaaacttgataactcatgtacattgaaaaaatgtgtcgataaggatattctcgctgttttagcattgcagataaagcagaggaagattcaacagagtttcagcctacttgtgcgggtaatatgcatgttttgcaatatttttttctttcaaaggaatatttcttttagaacaacaatagtagtgcagcatgtgcatatttttctcaagtttctagtttgcataataatatcagttatcaatgttgataattcaaaaccacaaacaaaactatatattaatgccgtacggccacgctcgacacctcaacctctaggtcctgaaaagtacaaaatgttcaggttttttttttcaaagaacacaaaaatgttcgggttctagatcaatccctcaccggcgagctcgaggtgctgcggtactggatcgaccgcctcgccgtcgtcagcatgcattgtaccattggaataactaccacccatgcggcagagcattatattagatacttcagagaaaagtattttctatagaagggaaatctataggtaagaatgaaggttttatttacaatccaattcagccacttgaatgttaccaacacacaagatgcctaaaaagcaagggcaatattatgatcagcaaacacgtcaaagatttaggggtgttggacgagttatttcttattttagcaaaatatgtctctaaatggaattatcgttatgttgaccattccaaaaaaaattacctacatttaacaatgactaaagcaaacttaacatttccattctaacattctgcgtcaattaaaaaattattgctatcaacctcaagccatggacacaacacttgtttgttataggatttgttgctattaacctcaattcagtctgcataatgattagtgttttggctatctaagagacagcggacacttgtacgttagaaatatcatgttaacccagagatgatttggtccaagataccattaaaccaattatagcagcaaggacgactgctgtggccgtgcccaaagatgcacaatactccatctctgcatacctttagcctgcaaagctgaattcgttgatgtcatggtttctatacaattaagcgcaattgggcaatttgtgttgttattgttccagtatcacgaaatacaaattagatgtaatctgaacttaccttttcttacatagccttgtgaagaaatcaatagcactgagcagagaggcagagcacgcagaaagcacaaagaggaggaaagagggattagatatggggaagacttgagaatagagaagaaatcgccatcagtaatggcgactcgtggaggtggcgacggaggagccagcgggatcgcgtgacgacgacctgtcggcgggatggactcgcgtggcaccaccgaggcggtcgcggcggcgcagggaaggagccggtagggttgcgacagaggagcagccaggatcgcgcgacgacgatgacctggcagcgggatcggcagccaccgcgggatgagcgtccgaccctgaccatgcggcgcctcctctctgttccactgcggcgcggcagcctatgcacggcggctatgccctaccccgccctcgcctcatccaccgccgcaactccgacacactgtcgggctcatgcctcaccggcacactgtcgggctcaggcctcgacccctcctcgtggcggaaccagacggggatgcggcagcgcgtcggagcgtcgctggagagagaagtgatgcgatggcgttggaggtggttgcgagggagcggagatgcggagatagtgaccgagagaagggggaggatgcgtgcgccgcgtggatcgggcctgcggcggcatgcggagaaagagaaactcgatctgaatcgttggatatcacaatcgtacgggtaatattccgcatgtctgttaagggtggagtcaccaccatcactacgaaatttttaagtagttgagaaatgttcagatttaaactatgtattgaggttcttaattaaatggagatattttttttctagtctagtgattcagatttttattttgcctaatgactatttttatttttattaggccatgccatacatactaattacaattacagatgcatatagttgttctttttctccaagtgaagtgtacaattagttgtaaaaattagaaaggtgatttattgttttagaaaaagtattgaggtacaactcttcgtggattcgagaatttcagtttgaaaaggttttatattctaataaatatttaccctatacgctttgttttttaattcaataatatttgatacctttttatatccagaatttccaattccgattcaaaaaaattaaatttatgtggtttgcctagaaaaaaaaaactacttgagacccaaaccaccaaacgcgtgagtgaaatcctgaacaacttcaccgagaaaaaaaagagtgatttgcttcgaagtggaccattttataaattaggaatgattccatctacctcttcctcccaaaataaattaaattttcgtatattaatttaaacatagatatatctaaaatcttataaaaagataatttattttaaaatgaagagagtagctacgagtaattgcttccaaatcttctctaccaagctcgagcctccttccccaaaccttaccaaaagggaaacaactccatcgatcaatccacctcgaaaatgcacatccatcccttccattctatattaacgtttcaatgtacttccttcgtttaaatatatattaacttttagtgtttanaatttattgtaaagtatacttgatcaatcgtatatttccatcatttaatttctttatcacctacttcctattccttaaccaatcataatatttctttacctattttttttaaataatcatgttcaactccaaatctattttatgacggaggcagtataatttaatgaacggcttcatgcccctcgctgctacttctccctacatggtggcttatgccttctcctaaccaatcgtagcctccattgccatattattcctcctacctaaagactctgtttgagagagtttctggctactgcagtttttcccagaatcagaagctccctcaaacaacagtacagtttggtagttatgctaagccagggaaaaagaactttttgggggacatcatgttaatctcttgctgttttggccctccatggagtctaaccattgggattgtttaggcccattttttgaccatctatttgctgatgaaggaatcaggcatcgagccattggtagatatagttgtttgttactacttgtcatgttatctgccgctatgagtaggcacaaatatagcatgttttgtagaatcgtggtgcatcaacgaatttgttttgcacaatcatctgtgatttctaaattgtgtttacgcatcattttgactctcgaaatcagcattatttgtttttacctttttctttataatcaatacatgattcgttctccttttttgtgctaattatctggtagtttgttactgctccctgaaagtttccacgtttgtgctaccttagtgaacaaggatggaattcgcaattggtttggcttcaaagcgagcttaacacatttgtaggtgtttatggtacgctgcagcagtttgaagggactcgaaacgtttaatgcagtgcagccatattttttcctttcatgattagccattttctcatcagaggtagatcagtaaatgtatgcatactggtgaccattcagaaaacgaccacaggcagagaaccccattccaatagcaattgccattggtgtgtgacatgtaaatgtggggaaactgttttaaacactcgggtggacgtccacccgtttcttgca

SEQ ID NO: 37495 - DNA, 18487 bp, Oryza sativa
taactgtgaatatacgtataatagttagtgtttgatttgttattttcgttacaacttatagaagtcgaatttgaacttgcatgtttgtaaagtgatatattacatattaacctatcttgtgaatttcttttgaaaatttttcataatcatttaggtggaatacaagaaacgggtggacgtccacccgagagattagaatccatcctcaataaatgtactgaagtgcacatgcaaaagcaaaacagacaccaactttacacccaaagtatcgtctgcagtttatgcggtaaaaaaggatatcactctgccattgaacggcaaacttactaggttattatcaccacagtggatctttctgaaagtactaggacaggcaatttcaccagttaccatcgtcgatctgaatatttgatgaagctatttcaagagtgtaatttgatgttgcataaccaaactggttcaaaaagatgaaacggcatagcagcgctggaactttgtgattcgaaataatgatgctgctttctttaagcatacaaggaacctcaggtatgaatttcatttaatccacctttaccttgatttttacagaaaacgggttacttcactatgttctgtcttctgatactcttatatattaaagtgattatcagttcagaattttctggcaatcatcatgatataaacaagtatatactcctatcagtaatcatgccgttgagttgaacacatagtataatatcaaaggccgcaactcctatctggaaaaacaaaagatcacgtcagttccatgttccagttgtgatattacatgctgaagccagatcaatggaatccaaaaagaagaaaaaaaatatagtccggttaaaagaaacataagaactagcaggtctgcagaatcattaaaacataaaagaacaggatgacattacttttggttcacaaagcatgaatgattggactatatccatattcaacaatgcatgaacttattttaaacataactaatataaacaacatagatgcgacatgagggtaacggtagatttaggagatggatttccatacatctaaacgtcttatcaaaggggggaattgagtagttccttttgggcaaacgtacttcatgatttgctaagataaattcatgaacttatcatagcattgaagattctataaaccttcataaaatgcttttggtagtgcaaatgcatacgaaaacaaaacattttataaaccaaggtaaaataaagaccaaataattttacctcataaggtatcctatccagatcagcatgctacaagaagtgcatttctcgttccaaaaagaaactttctttctagtcttgagatctgaacctcttgctccatttgataagaagctgttcaatgtcagcatccattcttgtgcccctacctccccagactaacatgtgagcaagatcaatcattgaagatccgtctacctcatgcactgttttgaaacccattctcgaatagaacctaacgagctgattagaaaggaaacactggtaagaacaccatcacgcgctgcttaaacaaaatgcaggacaaaaaaagtccaccaataaaatgaaacgaaaatattgcaatatgtggagatccagcacttcaaaacaaggaactgtgattttgtgaatcaatacttgcaaatatccaaatctaaatgttgtctcagcgggaataacgccattatcgacaaggtgaaccctaggaaatgataaacaaatcaaaactatttcttctcatcaattgtgctacccattgtttccaaggtgctttcctttgtgaattatatcaaagcgaatcacagcttgagcaattcgtcgaacaccatgcgcgcagcaacatatcaccaccactacgcagcagcccaggctgcaatagtatgttgtatgtaccttggagtggtagagatccgtgtcgttgatggcaagtagctcggcgcgcttgcagccggcgtcgaagccgtggcgcacggcgacggcgccgaggaagacgccgagcccgaacagcggccggtcgggcacctgcagcgtggcgcgggacatcctcatggagtcgaggtgcagcacggcgccgcctggccacgggcggacgacgccctgggcacggcccagctccacctcctccgtctccccctccccgccgctgccgccgccgcggcgcgccgcggtgacgcggaagaaggggccgagcgtggtgaggcgcacgcgcaggccctgcgcgcgcgacgcagacatgatgtccgccatggtagggaagacgacggaagcgcgcgcggcggggctcgccgccggcgtgggcggcgcgggcgcggccatggagagagatgaggggttggggtggagcgtggacacgtggcgagcgatgagctgaagatatttgggtgagggctgcggctggctggctgctgcggtggtgggttcagcagcgccgcgcgaaagaaatcgagtatttctttttcgaagaaaaaaattgttctactaccttcttaagatataaaaaataaaaaagaaaatctttcttatgcatttccctggtataaaatgtttttggctatgaattggtcgtatcagccctaaaacaaacaaaggccttcactaaagccacgcaaaaaaggggaatttaattatttatcacttttacatttcacaattattcaaatattctttttagatttgcgcttactaatttgtcatcaaaaagagagaaattcttaagtttatgccaattttacctacgtggcgggataaatgagattgctagtatgtatgtagggtgtgaaatgtctattttatcctcctgtcctgtcatcctcttccctcctcatttctatttcctacatgcggcagcgacagcacccggctttagtatcctcgattgcgacggccggaagcaaagctgaggaatggagtggcggccagcggtgggaggtgtgggatgcgatagaagctgcggacgtcgatagccttggggagccacgatgcgatccttggttgcggcagcagcaacgtggtagaagtaggagcaagccacgacgacgcagtggtcctgcaatatggtactcccttcgtcccaaaatgtaataacttttaactctcaagatttatttcaaaatataacaacttctctaccaatattttcttctcaaccaatcacaactctccaccattcacttttcttacctacctctactactcaaccaatcacaactctctaccgtttgcttttatctatttttttaataaccgtgtctaattttaaaaatacttatattttagaacggaggaagagtaattcttttttgccggtcatcttctcaatgctaatcgcgtcgtggacaggattggagtatggaatgtgctgatgctggtcgatccatggtttgctggctctttggtgatgtggcagtcggatgggctgttggagcatcacacgaagcatcggatcgccgtggcgatcgggcagatcgacgacgtagatcatttctgatctaaccttgagcgattgctggcagctggactcctcatcaatttaagggctcaccacactacaggaaaaattaactattgccacatatatattgcaaggacatataaattgttacaattagttactcagctaccacaattttatttttttatttaatattaatatatcgccccaatataaatttgttgtgatattttggaatttgttgcaatgaaaaatgggctattacaacgataaaaattactgttgcaatacaaaagtactacagccacgattttaatctccgtggtagcaattacaatttcttgccacaatatattagtgtcgtaattatttaaattttttgttgtactataaaaatacacgtacattgcaacgggtaaaagagctgagcaataaattaaattattgggatcattatacattataattgaaaaggttaatgaaatcctaacactggtattgttatagattttaattagcgcaggtacaatagcaagctgtaagctagctgcaaacatattttaaggagataaataaggagagagaagagcagcgggctacagatttgtagccagctgtagtacggactctaagacacagtgtatgtatgacatgtcagaccagttattgacaatgtagtatgtaactattatataaatgagctattaaattggctataaatgaattgaagctaatagttggctgtactattaaacttgctcttaaaaaagttaatgaaaatctttcctaggttttgggccgaaagcctttctttcttttcagcccatggccaatccactacctccctccgtttagcctgctttcctttgacccagccacaagtggaccccataagaccagctcgaacagtccaataccatcttcaacctctcgaagatagtcccgtgcccgtacggttgctggagcaatcacccaaaattggttgagggtttttatccactcgatctactcttttcgtttttttccaaaatcatagcgtaaaactcaagataaaaacgaaaaatgattgaaagtttttgatcactcgatctactctttcctttttttttctagcgtaaaactcaggataaaaacgaccgtggaagatcgttgcatcatcagcaactgttaaacggagattaaagccgaatcgaaagggaggagtggggaatcgatttttgcgattaaattggaggagaaaacgcaattttgatatgacggcggcgggaggtgtgcagagaacaggtcggattaaaaaacaaaaggcgcacgggagaaaaaactggtgacaaaaaaaattacggaaaaaaaggtaacagatcggattaaaaaaaccggaaaaaaaaccaaaagcgtcagcgcgtgcgcagaaaaaaattccttcacgtgaaaaaaaatgggtaaaaataacggtgtcaagaaaaccaaacggatctttttttacggtagtcggacgttttttcttactggccacataagcttttttttaatcactttttgagtcggacattttttttatttttttctacttttttttttgagtcggactttttttttctacagacgacggtgatttcttggtcttttttatagtagagatgattaaaaccgaaacataaaattaaaaccgattcaaatatggataacgtatcaaaatacctgtaaaaatgttttcaactttcataatagtagagattatacataaggtatggcaacaaataaatagttgttgcagtaagcttacactattaccaaaaaaaatactcctcgggctcacctcacacgcagccacgaaggcccacagaccaagcccaccacgccatgaaccaaatatattagttcataatatccaaggaaccagtcaacagccaattccccattcctcacaaccctaacttaccacacccttccctttgcttcactattttgcatgcatagatccatcacaaaaggtggtttaaattataaaaaaaatgtgtagcaagagtggaaatgtatagatttaaccactctagaaagatccctcaaagatttgtagttcaaaatctcccccctatattttggttggtctcggagagagaaaaacctcgtatgtaaacaggggctcgaagagaaagaaggctatatagctggatttttgtaggcgacagaaattaggtgcctgtgaagatagatcttcgcagacggacgacataagtctcccgcctaaaataatcgcagcgcctgtgaagatctatattcccaggcgatccacataatataagtggtccgtctgggaatatagatcttcgtagtcagaccacaaccttagcctcgggatacattttcttaggtggtgttgtggttcggatgtgcatacctgcctggaaaagaaatggcaaacgtcactaaaattcgtttttctagtagtgaatcatcaccgtgcttcactataatggaatgtgagtcgatagtacacccgtccataaaatcctctcatgcttctgtttttgcttcctctcatgcttctgtttgccttgcatgttccatacccacgcgccgtgcgccatcgaaccctttgggttgcatttgcgaactaaccagatgccattttctttctctgcaatagctagataactgcaaatctgcaattgccaataattaattgccggcggagaacatggcacgccactgcatgtccaccatggccgctaacacggcgtgggccgcgtgcccgacctgcaccggggcgccgacagacgccgccgacatctccgacccgcagcagcggcatgcaggccccgtcgagctgcctcgtcgagagcaggtgctcggcgccgatcctccgcagcgcgcgccacttgcggcgcggcgggaggacgaacacggagttggcggcgtgcccgaccccgacgccgtgccacgcggccggtgaggctgccgttgtgcgtctggaggatctggcgggccgtcgacggagacgaggcgacgatcgagacgacggtgccaagccggaccgccatgagcaacgtggctatggatttaatatggtgtctcgctgtgtatccgccgccaacttgggaccgaactcgattgtaatttgtaatcggagctgtcttgactcttgagtagtatatactcaggtaggggcggtgctcctctccacccgaccccataagtctacaacaatcaatctaggtttaaggtctcaatcgagacgagaagggggaataagccacaattccggcggctacggctccgtctccttcatcaggtgcgcgctttgatctggattaggtgtcgctcgatccttttcattgtcaaatctctcgatctggatttggataattttgtgcgaacttgggatagatcgatgatcttccgctgctgatagttgataaaagtggcctactttctcgtttctgatctgatgctgttctcggtttctccacagcaattcccgcgctgctgatggatccatctgagggaaggaaaatgagtagctttaaggaggaaagaagtgaagggaaagttccggccacggcgattgatcccaccaacgagaaaaaaaagaggactaagatggtgcgctacactcaagaccaaattcagtactgctttgcgaactcggtggagttatctgacgacgacgaggacgattttaagctgacggaggtgctgagcaaggagtgtcttggccggatgtcgcaggagtatctagccaagttgtatgccatggaaatcgctgaagagaaggagaaggctaatctgaagaagatacaggacgtcctccgcaatgaacgagagaacatcttcaacatccgtgaaaaacccgaggacgtccttaagcagtaccacaccaaaggctatgctgagtacgaggttgtcgttgacgatgacaagggcgatgaagacaataaagttcatgcgcgagttgctccccctggccgaagaagattccggaatggggttgccatgaagaagaatcagtcaggaggaggaagtattattaggaagataaattgaaataatcgtctttagtgtttgacagtatttgacatgtatacatcttagttgtaggggaaattatattttcccttctatttattagcatatagtaataatagtattatggtttgattatagtcgtgctaattgtattatgtttcaatcttgttcagcattgatccatcatctagttcagggaatctgaaactacgtaccctagactgaaaagtcagagaacatagtttgttttgactggagtagttttgttgactgcatttttaggaataattttgaaccccttgcaaaagctcgcctgaaaaatgttatgtataatttggaacctctacctcttgcaaaagctaagctggtctctgttgacatttttcagagttgcatgataaggattccgatggacaaaactttttgacagtcatatgagaatggcactctgctaccatatatgtttctccaaatgccaatgcaagttggattaacacctgaaatgaagaatgagtcagtcaggcagtgtgcttgagactgtcagacatattttttagtttagtttgcaaagttattgtagctatcaggtctgtctgatcacaggggcaagtgaaagtgtgaaaccgagcaatttcttcagttcccaacagcaaatttcttcagttgcttgacaagctattactttctcctgaatcttttctagctaacacatcgttagcaagggtgggcgtgatggagtatggatggacctggattttggtctatgctgcttccggatttacctaggcacgagcgaggattgcccatcgcctgtatagggatgggggtgaaagtggaggtgggtgtgttggttaggggtggttatatggagagttttgtcacgatttcccccattgcagtatcttggtggtacttcggggcatggtaacatgtgtggaatcttgtcttgcgggtaaagttgtacacctctgatcagagtaaaactattcgaatagccgtgcccgcggttattggacagtcaaccatctcaccgtgattagtctcaccttaataatttgacttaatgaactggtgtagtttaggtggtttaggtggggcctgtcgcaacgtggttttagcgttggacagtcatgaggttaatactactaaattatattctgctttactgtttttaacttatgatttataaatgctacttttactgcaaatatcctatgagccattccttcgatatccttgcatcataccttctcattggtatgacttgttgagtacagtggttgtactcaatcttgctttattttcccaatccccagaggcagtgaatttgtcggatggtgagttctatgaagattagacttgtgccagacgtcgaggttttgcctggggattatgggggaagcttctctttgccgagcatattaagtttagatgatctttagttttttccgctgcttttctgagtttattttatatttttgtaagacatgaaactgtatcaaattatcatctgtgtactttggttgatgtctggacagagattaaatatacagatagccggtgattcgggttctcgaatctcggggcgcgacacaattgctcacgaaacggttgtgcttataaatctaggcagcactgggaaagtgaaaaaagccttgactcctcatttgcacagataattttttttagataatggaagctttatttagactcagttaattacatcaagatgattttacattaatagtccaccaaggtttttattttctttttattagcaacggaacgggtataattttagactgccagctttttgggggtggtgtggctgaaactaaagtcagctttatagcaatgagtgatacagtgtgtaccaatcatatagaatgaatggattggcttttacttcagaaaatcatccagtttcttaagaaacatcacaattttgtgtcgcatttgtgctaaatattttagttagtgaaacttgactgtattaatttgcagatggaaatacatgtcagatgctgcccttcattcaatcttctacatatagtctacgaaaagtacgtatataatgggttacatagtatcatcgtacatatgtgcaggaccagtttgtaatgggttgtatcatcattaagcaggtaccgttcttgcgtttatactgtgttttttttttaaaaaaaaagtttgtaatgcaattatttaattggtagataaacatgcacccgcacgtggctcagacgcagacatcagatgctcttggctatagcttgcagcggggtggccatggtcatcgtcaacccaagattctccgacatgtccacaccattttcctccacctccaacgggagcgtccactcgaagcgatgcagcagcgaccccagcattgcgtgcagcatccttgtcgcgagtggcagcccgaggcagacgcgcctcccagcgctgaacgggatcagcccgaactccgtcgtcgccgtacccagggcacggccggcggcctcctggccatgctgccggagcatgaacctctccggcaggaacctattcggctccggccacgcctcggcgtcgcgatgcacggcccacaggttcaccaggatggtgctccccctgggcacgacgtggccatgtatctccaccatctcctcggccacgttgggcactatcggcaccaccgggtgcagccggagcgtctccttgatgactgcccggaggtagggaagacggtccatatcggcgtattcagcatgagttttggagccgagaaccttcttgagttcttcctgtagctttctcatggtctctcggtcctgtagtagctctgccattgcccactcgagtgtactcgcaatcgtgtcgactgtcgccagaaatatgtcctgaaattgatggatttaattggattaattgttaaaacaattactacgatgacattaacgaacttattggtagtaaagggacatagttggaagttggatatatatgtccctgtatttcttttatgttacataaataattgatgttacataaataattgtaaaaaaagttggcaaggaccccctttttcttcctcgcctctcttgattcggatctgtcggatgtcaccacaataggggtcctcgccaagcatatctactgtccatctaattcagacctgaagctcgtcgatatcgcatgacaaaggcctaaagagaggagcggagaggggaagagggtatgtttcagtgacggatccaaaccacgggccacctgggtcatggcccgtggcccggtggataaaacccatgttgacacgtgtaaatttaccatgtatttgatagataggccaaaagtataatgggctggctcggggcctacccaaattctgggttcacgcgaggatgttgatgctgagtggaataggaggaaaaggaaagggaccctgttggcggcgacattctgtgcactgttcaggcaatggcagagccatcagcatcagtcatttttgcaaacattgatcacactcgtagtggaggtgacagtgatgaagcctaggcaaccacttgatctaatggagagctggcttcccatgcaaaggaaggcgtcggggtaggactgcatgaccacaaatgccatcaagaagagaagataagatagaaattcaactaggccccagtatgaattttgtttccgcgtcggatgccatgtaaaaccgcctctaatttgattattggtctaggctaattcactatttgtcatcctcccaaaatacacatacccaaatgccactctcccaaatttttattctcaggtaatcagacccacatgtcagtcccccttcccatttgctgaccttatggacccatgtggatccggggaggaggcggacatgtgggcccaggtggcaaatatgaatgaaaatttgtgagagtggcatttgggtatgtgtatttcggaaagatggcattctcgtggttacagagggtgtaaaatattcggtacagtagttacggttgtaaaccagactttaatccacatactagtttttttttagaaaaattcatagatatttgcatggtgacttttctggtaataaaagtctatatataatttatacaaccaccttgattaattatttatattatgctagtatggtagaactcatgaattactaattttccagctataccttttgcaaaataaaaaaaatccaactaaactgcaatagcagcacacggatttattggtatctatagtacccatctatcttaaaaaataattatttccatctccacgtttagatcaccttactaaatataatacatgcacggtaacaacccatccttcagaactgtgcaacctagcctatccaaccgacgggccaacttatacatagcacctcacttacactatcgtcaccgctttatgtacaagagttaacccgaaaatgatatattatagttagggagacaatgtcttataagctggttctactattactcaactagcaatgtggtagcaaagagcacacgacactcatgggtcacacatgtcgcatccttattgggcaagatattacatgcacccaataggagatatcttgaggatgtaggactaacaaaacaaatttaaaagaaagggatgtatgcatgtatgcacgatttgtcttatgaaatataaaaaaacgtgtttattactctatattttaggatggagtgaatagttcttttttgaaaatatcacacgtaccgtactaccccttttgtataataagtaaagattaaaggcaaattttgtaatataacatcatgactttgcaataatagaactactcagtagctacaaacccacttttttttccttctctttcttttatctcacttatatatttaatgtgacaattgtgcactatatgtataaagtcagctcttacactagaacgaccaatctttatatattttttttcttcatttgtggttatagctgacttataactatatacctgcagatacctgcaaatctgcaattgccactaattaattgtcggcgtgtgtcatcatgtagcattgaaaaaaaaaacgtacgcgagagaaaaatatgcacgagagaaagaaatacagtttggtgctttacttacagtgagaaatgttctgatcaggtctctgtcgatggccaccttaccgtcgtccttcccatgctccgacatgtcgagcaacacgtctagcaggtcgtcctcgctcctggcctcgccgtcgtcgccagctgcttcacgccggcggcgcatccgccgctcgatctgctcgtcgacgaggtggtagaccgtccccacccgcccggcgaagcgccgccgcaggccctgcaggtcgacggcggcgagcgccggatagaagtccgagaggttgggcttcagcgacagcgccacggcctccctcgccgcgtcctgcagcacgcgcgcgtcgtcgtcctccaggccggcggagaacatggcgcgccactgcatgtccatcatggccgcgaacgcggcgtggccgacctgcaccggcgctccggcgccgccacccgacgccgccgacatctccgacacgcggcggagcaggtcgagcacagcgtcccgaagcagcggcaggagccgccggccgtcgagctgcctcgccgagagcaggtgctccgcgccgatcctccgcagcgcgcgccacttgcggcgcggcgggaggacgaacacggagttggcggcgtgcccgacgccgtgccacgcgtccggcgggacgcggccggtgaggctgccgttgtgcgtctggaggacctcgcgcgccgtcgacgaggacgaggcgacgaccgcgacgacggtgccaagccggaccgccatgagcgggccgtgccgcccggcgaggcgcgccagggagcggtgcgggaggtcgctggcgatgtcgaggaggttgccgatgagcggaagcggtgttggtccaggtggaagacggcggcgggcgtcgccaaacagttgtaacgcgtatgaaatcaagaacatgagaagaagcgagcacatgcagacgagcaagaaaaccatctttctttttttcttttcttttttgatgactaaaaactctgaatgtgtttttttgacagaagcaggttaccctgaagctcaatttatagacgaaaaagggacaattccatctacataaaccacaaatatttcaacggtaacaattaataccacgaaattcttccacctttcagaattaccgtaatgggggattgggatcatctgcagtaggaatagcgaccgcaagataaaccactgcatgcgatttcagccgtccattttggtgatgaatggaccagatcatcagctacagtactagcgcaaaaatactaaatatttcttgctacagtgatctacagtatccgggtgcatgtgaaccgttagattcggatctaacaggtggcaatggactgcataagttgcagtcatagtacaaactgcacctgatccaaatcccgtaatggggaagtgtttttttcgaaaatataccacaaactttaccaagattacagagatgccctgggagcaagattgggacgggttttcaatctcgatcattgccggcggcagcggtagtgtgtaggacagcaggaggcacacctggataaattttgtgcagctcgctgtccaggaactgacgaatcaattggctgcaatgcagcatagaagaacctacacgtgccctgatgcccaggacgcatgcgcctaacctgcccgaatggaggccgtagcactctcggcgcaacacggacgccagcggtttgcggagggtacgattgtggaggagaaaagtggcatcaggcgagatgtaacactggctcggtccccctgctcagatttcacactgtggcggccggcggcggagcagagaaatgagtgagggctgcatgagcgaatcagatgagagaagtagattgtgggggtgatcccatcgcaaaactaactccgtcattctcccgtcactccgtcaattttgtgctaattctggcaagtggaaggattttgtggtattatctggtaccattgaaacctttgttgtatggatggaattttcccgatggaaaactaactttgcagaactgccactggctacgctctagaagtcaggatttacaaacttccactttccaacctcatatgtccatctacatagatagcagttcgttcgccaccatttaagttcttcggtatttatgggtgactggatttgggtacattctatctatttgtttcctatagcagcattgttcatgcaaggtttgttgtttgtgttgagctcaagctccttagattcagtggcgaactccgtggagaattcctgctgagcctggtgaagcccacaagaaaatttgtagttcatcaacaaaccttcaattgtgctttttatggaggccaacaaaagggattacaggttattaagcggtgtgtatgttaaaggaggcctaaggatgcaatagttgtggcaacgttgcaattccctatcgatttgcacctctattgttgcttgatttcaataggaagtttgcaaccttagtgtagtttcctgttcgttggaatcagatggctggttactttcagctaatcaatttggcgatgtactaggatttgttcccctaaactctcttattatgttattaatgaatgttttatgtttgaaaaaaaatgaggtatatgtatgcacgtgttgcacaatccatggaaaccatccatcgatcactagtactcttcttgtcggtggctcccagtaattaaatttgggaaatcttgctagtgacgatcaataatagtagtaattgagtagtacggtgaaataaaatctgagtgggattgttgtgatcgtgatgtagtactgtgcttattgttgatgggatttttattagttcatcaatacaggggctgcaaggaagaaaaaacaaaggcaactgccaatgacataagcaatcccaatggtaaattggcaatcctattggtcgatttcagggttggaaacctcgatcttgtgaacgagggtcggctctatgccgtaagtcagtgtatactgtagtcagccctttgctgccctattcccatcttcttcaatttccctctttcctcttcaatgctaacctagtcctcctcatccacattctattccacattccctcgttcaatccctcttccttaccttcttcttccccttcctgttttgttctgctttggcgttcgtagggggtcatggatctggatggggatccacccctggaggatgagcatgaagtagtccactctcaacttccagagattgccacctctctggaagcgatgacaatcacaccaacaaaggagatcagagtgaggttgcaacagtctcctgaaacggcaacagttcaagccactcacaacctcctcatgaaggttggacattctggaggccagcagaggcagatccctttggaggctttgaagaaatcaatggcaaaagcttggcaaagagtttatcttgacatctctcaggtagaaagcaatctctttatggctcattttcgtaattatgaagatctgtcctgggtttggcaaaagcaaccgtggtcttttggcagtgatgtttttctgcttgaatgggtttctttggatgagaaaattaaacctatgtcagcttacactttcaagcatcttatggttaatgtgcgtatctatggcattcccccaagtcttagaaatgttaagaatgtcaagttggctgctgaaaacataggtcaaatctcaaaagctgaaccaatagatccagatagtttgctgaggaatcagaaatttgtttctattagaatcaggattgatgtggaaaaaccagttcctgatcatgttatcttggagcttcctgataaatctgaacttaaagcttttctgcattatgaaagaactcccataatatgtactttttgtggtctcctcttccataatgttcaggtctgtcctcaaagacaaagaattatcattcaatttccagatgcatccgaggaagatcttaaagataaactaggaaagtggatcactcagatcgattatatgccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggttgcagcactgttcaagggcccccaagtcaagctgttcacactaccacagtaggcaaacaatgtgagaaaaaagacaaagaacctgatatacaaagtacaccagaagttggtaccgaagagatgttagtacatggaagtacagagaaaaagaagctggtttcaagtactatagaggatcatgtcagctgcaactcaaagaatgtcaatactgctggtaaggtgcatcagatggaaccagtccagtctgttccattggttcaccgagtttcacccagtgcaagtgcccatcagaacagtttagttaaccctgctattggcaccaacgaagtgcaacacagaagaagcacaagagctaccaagatttatgagacagcctcacaacatttaagtaagaagagagggtttcatgaagcagcccatgaatctaccaaacgccattgctccccaactacttcagctacctcttccttctcgattgtgggaggtgaagaacatggagggattgaatcaagaagagcttctccaactaaccatcattcagcaccaatcagggttccaagtagaagaggtgggcagagagctacaagatgggatcagagaggaggttatggtggtggaatggtgacctccacttcttggagacctcttgctgctgctcattctgatgtcattcaaagagatgctccaagatcccctcaaagcattaacaattttcatagcaggaagcatacttggagtgctttggaggtgcatcatgatatctttgttgatcaagctgctggagatactcaagggggtggtgcaagtgatgctggagctagctccaggctgatactggctacagatcctagggaatgcaatgtttcagagattcagcttgttgatcccagtgctggaaacggtggagatggaagtggaaagaatgatggatgggcaatggcgccagcccataaggcgtcaagggcgccatgagtcttttaagctggaactgccgaggtatggggggtcacctcggcagtaggaaaatgcaacacctccaacgcctaatatactctactaatgctaaggtaatctttatttcagaaacaaaaagctctaaagtcactgcttctgatctgatccatcattttcatgtagctaatagtcatgtggttcctgttgatcaagcttctggtggtctgtggctgatgtgggatgaagacatggatcttactatagttcagtctagtattaattatatcttagcttatggagtctataagaactctggtcctattttcaatcttctttgtatttatggtgatcctagtcacagggccactagtgccatgtggagtgaaatctcctcttttgttgtacatagtagtcacaaacctaccttttgtatgggagaccttaatgagatcatgcatgctaatgaaaagtatggtttggcccctcctaatcagaatcgtattaatatttttaagcatcatgtcaataatctggggcttatggatatgggttataatggtccagcttacacttggtccaataagcaacagggtaaggatctggttttggaaaggttggacagatgtcttgcaaatgtggaatggtgttttaattatccaaataccactgtttatcacttgcccatgttgtatagtgatcatgctcccatcattgccattctcaatccgaagaacaggaggcctaaaagatctttca

SEQ ID NO: 37496 - DNA, 15944 bp, Oryza sativa
tgatgtaatttttcctccccctgaaatcccttctgaaaatgacatcctaaaaattctaaagcaaatgcgaagagatgcctccccagggccagatggtgtcaatggtgcattttataaaactgcctgtaattggataaaagacgatgttactgccatggtaggctccttctatgaaacaggtaagcttcaatcaggtatgaatgctactaatattgttcttgttcctaaaaattctaatcctaagtcccctgctgattttagacccattagcctttgtaatgtttcttataaaatcattgctaagtccttggctaattacattcagaataaacttcctaaccttatttgtgacactcagcaggcttttgtcaaggggagacgcatctctaataatattgtgcttgctcaggaaattgctcactctattaatctcacctcttttaatcaaaaagcttttcttttaaaaatagacttgtctaaagcttttgacaggattgaatggagattcatagcggacgctatttgtcgtaaagggtttcatgctaatttcgttcgtcttgttctttcctgcatcaactccgctaatttttctgttgttataaatggtcaatcgtacgggtacttttcagctcatcgaggtattcgtcaaggttgtcctttatcgccttatctttttgtccttgcgattaatgaactttctgaccagcttgcagatgcaattcaaaggaaccacatttcagtaataaagttaggacaaaatggtccttccattcattctctgatgtttgcagatgatctaatcattgtggggcaggcccaacaagaggaagtcaggaaaacctctgaaataatcaattccttttgtctcagatcaggccagactccaaattggggcaaatcttccatcctgttcagcaaaagtactcctgaagaggtaagacaaaatattcttacaatctttcctgtttctcttatgaactccagcacaaagcatctagggcatcctcttctggtgagtgcaaaagacagaaatgctgcctacagtttcattgtcgacaagtttaaaagcaagcttactacttacaaagctaattctctttctcatgcaggtaggcttgccctcattaaatctgtctttgcttccattcctatttattacatgtccatcatgcttttctcaaaaaaattgattgctaaactaactgctattataaggaaattttggtggacaggaattcaagcagatggtggcaaaaaaggaatggctcttaggtcttggaaagacatttgcaaacctgtttctgagggaggcttgggcataagagatttgatggctgtaaataaaagtatccttgtccaatctgcctggagaattcttactaatccaaatgatcttctatcctctgtcctaaaatcaaaatattttccaaacacttccttttggaaggctagaacagatatgccaaaatctgctttctggtcttctattcttcaggtaagggatgtcttggaggaagcttcagtgtggcaactttctaaaggtgatatttctatttggagccaaccctggtgctctatttggaaaaacattcatgatcatcttaatcttgataatcttccttttcacatgcctgataaggtttctgatctttgggatgagaataagaattgggatgctcagaaaataactcaaatttttgatagtgcagctcaacattcaattatgcaggttcagattatgcagggagaggaggaagataggctttgctggaagtacacaccctcaggagtttgttcagccaagagtgcttacaagacaatttacaatgaaatgtaccccaatcaaaatcaggtcagtaatttaacaaaaaatcttttgaaattaatctggaaacacaggtacatgcctcccagagtcaaaacttttggatggaggctgctgagtaatgctctcccaactgctcaaagaatgcaccacaggatcaaaaccgttagtcccaattgtcagacctgtggtcaaaggaggatgacttgcatctcttctttctctataatttcagtcgtttatgttggttcatctctgactttaatctcaaagctgataatctttcttctctaggctctgttcaagatattattgcctatctttcagctaatggcatcaatatatacaatcttttaattatgctttggcagatttggaaagcaaggaatgatatcaacttcaaaacaaagatttgggagccacaacaagtgtgcaatgctgcgcaggcaatggcaaagacatatgaaagtgttcatcaaatggaagaagacagttgccaagacttcaatcgggctgaagagaataatataagaaattctattgttaaaattcctacaggaacaagagtttatgtggatgcctcttggaaggaagagaaaataggagtagggatcttcatccacaaccctagcaatcacaatgctattgtcatcaaagctcaaagtctcaatgcaggaactccttgctagcagaagctgaaggattatttttagctatgcaaattgctcgtcatcttcagctgcaagaccctatttttctctcagataacagtgagatagtgaatgttgtgcagaacgaggactacatacaaaaccccggacattggtctctgagaccaattctttcaagaattaaaaattttctgcaggatcaacaagttcgaatcatttggatctctagagagctcaacaaagttgcagatggccttgcaaagtcagcaagacaagctcagactaacagctgcttagcttttgattgctctaatatttctcacatttgttccagagatgtttgtcctactaaaagagctctttccttcactcctaatggagcagttaatgtaactcatgctttgtgtttctaaaacgctttcttttaataaagtgcatgagctctcaaaaaaaaaaaacctcgatcttgattgggtcacgtggcacaacgcatacagtcccgaattcttggcatgataagcgtttcatgcatgtattcacaccccttccgcagctgttcgatgccgtatcaggggtcaaaatggtacgaaaattttccggattccagacctattttcgaaaacagaatctgtcggtcggaaatttttcggaattttttagaaacggaaatgaattcggaaatattttctcggaaacggaatcgaaaatgataagggcagttttcgacggaactcagaatcagttggaaattttctcggaatttctgaaaattttgtgactgcgataccctggattctttttttaagcactgaacagtgaataccatggtttaaaatatgtgttatgcaaatataaagttacataagaatatttttttcctgcattagaatttatcaatagcattactctcttaaatatatataatttattccatactgtgttttgtgatgaactgttaagacttaacaattggacttatatcattgtgttttatgatgaattgttgatcgttgggacttgagaattggatttgttagtttgaggggtttttgtattccgataaattttcgttaccgtattcgcgccggttcgttttcgctccgttttcggtttccgacggaactcggaatcggtcggaaattttctcggaatttctgaaaattttgtgactgcgataccctggattctttttttaagcactgaacagtgaataccatggtttaaaatatgtgttatgcaaatataaagttacataagaatatttttttcctgcattagaatttatcaatagcattactctcttaaacatatataatttattccatagactgtgttttgtgatgaactattaggacttaacaattggacttatatcattgtgttttatggtgaattgttgatcgttgggatttgagaattggatttgttagtttgaggggtttttgtattccgataaattttcgttaccgtattcacgccggttcgttttcgctccgttttcggtttcgataatatttgattccgtttttttatccgtggtttccgatttaaaaaaaagaaaatggaaatgataaaggtggttttcgtccgcctccataccgttttcacccatatgccgtatacatggtgaaaaaaatccagtggacctaaatgtaaattacaagttctaagaggttttttttgttataaaatgcaacgttccatgacatgcagacgcggaagaaagccatttttctttagtgactaacaactctgaatgtgttttttgacaggagcagctaccgctgaagctgaatttatagacggaaaactgactttgaaatgcttgtttgtaccacagagaaaactcaattcatttcatttcacaatattaatggctgagttctagttttgagaggagttcgggacctttcctcttatcacgtaaaaaaagactgatggactaaagtattgattaattaagtattagctaactaaatttaagaaataaatcaattaatttaaatataaaacaaacatattatcaaaatatattaaataataatttaaatgaaactaatttggtgttgaatatgttgctaaatttttcaataaatttgataaactaaaataagttctgatgaagataaatggggcacacaaaacgagatatctattagcgtataattaattaagttttaattattacaaacttgaaaaatagattaatatgatagtttagaataactttcatataaagaaaattcgcacaaaatacaccgtttagcagtttgaaaagcgtgccacaatattctagaatttcatcctctccttccatgagatttgaacgggaccataatatgaaacggatggagtatccaataatttactcccatccgtttcacaacgtaagtcattctagcatttcccacatttatactgatgttaatgaatctagacatatatatttatctagattcattaacatcaatatgaatgtggtaaatgctataatgacttacattgtaaaacggaggaaatatctatttatctattatatactaaaagcctatcaacttactacaaacgctcctaagcctccacataggattttaaaaacactcctacatcgccatgcatgtggtgctctaataattatagaaattctaagaaacaaaacaccatcgattttcatttacattattttcaaccatcagatatattataaaagtactaattaaatttatctccaaaacctgcatctagattgccgtacgtgcacataagtacattagttggtatttaaaaaacgtacgtacgtacgtacgtatgcacgccgggcgaactgactgttttttcttcttttctttctcacttggacaaaaaatcaaactgcccatattaactatgctttaattacgtgtacaaatatacataattttgagtttctaattaggcgcatgtcgtcgaaacaccaatgaaaaacaaaaataaattaacaatatatattatataatagttaaattagacttgcatttttaaaaataaaaacaactccaattgtaattagcaattttcaaaagttattcactccctacgtaaaaagtaatgatatgtcaaaatgattatcactaaatttatcatgaatctatttatcatgtattatgtgttttctctattcgtataatttttaaaaattaaggatcgtatatattcttttcacaccataccggtgtcctgtatcttctacttaggcttcgtttgatatagctcgatggctgagcttattcaggacacatgaaacggcgtaagtcattagttcaagattaactaaatgatataaagctgaaaatagattaatttgatttattttaaactttatataaaatatatttttaataatacgcatgttgcatttaaatatatacgatgttgattatgattgtcaatttaattatgctgaatagaatgattcagatggattatatttagatattattattaaaagatatttcttttgtaataattcctagatcaatgggtagatcactggggtatgtgcttacaacgaacaaggagcagccaatcgaatactactttagaactaattgcttatttacttaatcgtttaatttgtagtatataatagtctttgtcaaaaaaaggcctaatatatcaatcgtatgttaccactaatccaaaagtatataagttctatccacaatttgtcaagtcatactgcttactcggcattcatgcacagtgcacctaataattagctgacatccaatgagcacttatatcatcaagcaccgaagataacatactatactaagtaaggaactattaacaaatggtaggtaagtagagcatgtcacctaaccacaacaaacaatagtcgtctacaagcagattgccggtatcaataatacatttctacacttctaccagcactcttaagatgcatgtcacataatagatcgaatgaatcagaaaaaatctgagaaaaaaatacatggccatctatttacacttaaaccgatagatccactatcttcaaccattagattagatatattctagctaaaaaccaaacaatagtcatgccatcccaccaaactttttgaaaataattttttttactaatgatgtaaaacaaaatcgtagacactcatataaacgtgtgcacaaccacctacgaatatacacactactattagccaaaaaatacatgcgcataaaaattatcacatggaaacatattatatccatttataattatgtcattttcatctaaactaggaagatagcccgcgcatatgcgcgggcatgtgcgtaaaattttattacgaatgtccatgtgtagatggttttctatccaaaatattattttacattatcataaactaaaattgaacttatttaacatgctttgaacgttggttacttgcaacatataaattgtgaactaaaattacatcaaaccgtgttgtttttaattcatgagaaaattttgtaacgaaacaattgatgtgtttcctatgaatgtccaattcttttgttagattttatttgaaattttaaatattttcattttttggtcctgctaaaatgtttgaatatttctatctagaatgggttataaacccaacaaaaagaattttaaaattagataaattttgtttaattttcatttcattttatcttcattttttttggacaaatccactatatgaagcatctttgaaatgctttgatctcaatataagtgggttgatcctacaacttggcatggtgtaaaggcatccataattctaaattatctcgctccaattatgtaaaaaaaattaatatagaggccatagtattttcttagcaaattaccgctaaactggagcgtcaggtaagaatcacacgtttgtagattgttccatgctatatgtcacaaattcacgatgtactgcagcaagttttaccaaaaagtaaatggatacggtctttaaattcctatatggaattgggttatatattgctgaggcgacatcaggttgtttcactcttaagattccttggtgcaaccaacatgcttagtacgatcagtatgttgttcaactggccacatgacttcatagatcatatatataatttagacgctacgatcatcttaagattatttatttatctcctaaaatgatcatttattgataaaagcatcaatatcaaaacgtatgggtaaatagcttttgtatacacgctgagaaaaaaataactaagttgatagaaagtcgttagatgtctaatgggatataagtaatgggtctaccagttttataaaaaaatcgactgggatattttgatttttagtgagaaattttagtattttattttatttagggtaaaatttgctagggacatctaaaaaatatgtacttaaccggggacaccgtaagaacgcgtatcagttatgggacactgaaaaaactttataaaatccaaaggaaatggacagagaaacaataacgaaagtatgattttgccccttgcctaccaagttcagctcgcaaacacctccgacactgcaaccgcacccgccgccagtgagatggctgtctagtggggggagggggtttcgagaagggcccatgcgcctgggcccgtggctccatgtcgttcttgcactcgtcgccgctgcagtgcaagggccatgttggtgtcaatgctccgccacacaccgcgcttggggttagcacaacgtggaccacctcctgattcatgtcgagcagggcgccgcaaagcacaagctattgctgtcagtctcgcagccgcaccacgccacgatgccataccctccacctcccatgtcgtgactaccacgacgtctgagctatatgcgagccacacttggcaggaagggggcaaaatcatactttcgcaattgtttctctccccctttccattggatataacaaagtaatgctgcgggtatctaacagctaattaccagttttttgcagtgtcccatagcagatatacgttactgcagtatctcttagctaattacactttttttttatatcttgtagtaaattttacctttagtaagtagaggctacaatatggatgtgggtccataatgtaattttttgttagcacttaaatacaatcaatatgggcattaagttattgttttcacttaaaataataataactggctagacctaatagatggagattcgcttgtggtcttttctttgcccataaaaataattttaattatcatagagatagaaaaacagagaaaagtaaggccgcacaccacacgggaacggggatggagggagggttgggatgtttcttttttttagaaaaaaattgattgatctgatgacctaaaatataatgtgttgaattttaagtcaaaactgatggttggatgttatttttttctcagatttattagttcttttctaatttaactttgacaagtggcagcttagcaaaacgcgtatagggatgtagaggaagggaatatggtttgggatgttttttattagaaaatatatcaataatgatgtaaaataatgtgttcatatttaagtggaagccaatggatggatgtttctataatttaagaatgtcatacaacgatttagaaatatttataagaggtttaatagactttaacgcctatttatgagattattttccataaagataattttaattttaattatgatagggataaaaaacagaaaggaacagggagcctacaaattgatacgtgcgtggtacacggatatggggacatgggaggttttggtattctaagatagatctaacgaagtccaccgatttaaatgaatatcgatggttagatttctctattttattaggatgccatgtgacggtttggaagtgtttgtaggaaatttaatagattttatttagaatttaatagattttatttagaatataatagatagatagatagtactacgtacatatggatttttgctttattttatacggtagaaaattatattttatattttttcttccgatgatacgttgtactaattttttttttgcctttatctcattttgacactggcaatttttttattccggcgaatcgaacggaagcttttcttttttttctgaatcatacgtactggtattttttgttttgtcgacggtacgtattctcacttttatacagggaaggtattatatacacacacctaatgattattctaaagtaatgggcccaccaatttaaatggaaatcaacgatacatatagatctaatctaatggtataaaatagcgggtccaccaattaaatgaaaatcgacggtgagattagatagtgccacgtgacggcataggagcgtttataggagtcccacgtggctacttgagagcgtttgtaggaagtttaatggacttttagtatataatagataatagatagatagatagataggaaaaaaatcaaatatttatatattgctaaaaatggaaataatcggggattaggggtgagtaataaaaaaaaatttcttggcaaacgacataccggtcaacagcaatacatctatgctaatttcaccaatctcaagatatgccattttttagagatactcataggaattaatgcattgtgtgtgaacgtgtttacaggggtgagtatatagtaaatacgttttgtgagcatctggcttgtttataaaagacaaaatttttaatgtactacctaccttttggccacacaccaacaggcaacagctgacggctgaggagtgagtcataataaacaatataataggaatcttgttgtgtagtcatcgttgtgtacttgtaccattggttgatccctaaaatattccatccaatgtacctttactatcacaattgcgagcagaatttaattacgatcaggttactttcctgctcgacattcgtttccgagtctctcctaataattatttgccatcagtggacgtctacaggatttttcccagtatggagaaattactcgtcattgccctcaaaattagagaatttttacagtacaatgtactactagtatataattattcttttgggtttttttttaccatatggttttccagttacaaatatttgcatcatattcatcttaatttgtagagagattcatatatatctcaaacaagcactccctctatctacaaatataaggataattcgtcgagaatatttcaccatccattttcttatctcaatcaatcacaattgtcacttctttgaattccctaagcatgtttccaaaatccgatgggtactgcactaattactgcatatcaatctccactgcatgggtgacaactgtactataattctttaatataactaaccatgtaatccctctaacctcttaaaaaacaatatgcctccatactataatttgttacatctggtattagattagttttttatgagacgggggagtatacgtgaagtttaaggtaaggttgaaccttttttaaaaaacttaaacacatagacatacacatagaggaatcgaggtcatcgatgcatccccaagataggtgtagcagttagaagctacaactccatctgtatcagaatatatttgttttaggattttttttagcaaaaactgaggtagagaaaatatattctcttttagttattttagtgatcaaattttgaatttcttagatttatatcgaaatatatatccccactgttggctgaataatatattgatttccacgcattagaactagtaaaaaaaacttggtacaaaatttcgaatcctctaaatacttatatttggaatgagataaatataatgtgtactccctccatccataaaataactatattttagtcttgggtatttaaaatgagatagaagaaaaaaaagactaaaatgcctcctgatcaataaaataaatattatatattgatgggtggataggtaaggaaacggcaaaggtagtgaacaaatgaaacttattaacttattattttgtaaaccgagcacaggtaagggatataaaagtaaactcgttttgaaaatgggcagtatctaaagttattttgggatcgacggagttacctactaataaaatgcttaatccttctctctctctcatgattggtgcacatgcacgctacaacattttttcacaatctgtgtggatagctgttgttgaaacaatggaacagatccaaactatttgaatctgtgtactctaggagatggatgatctggtgaatgaataatgtcatgaacaaaaatgggtccatttttccgtcatatatattcggtgcaccctcttcttatcatatctcacattttactttctccggtacacatcggtcgggacattctatagatctgacaaatataatgcaaacacgaggcaaagtatagattctggaggaccatagtggtaagagcatcggttctaagatgatcatgagtttctgaaataaaacaagcaagtctgtcgaaaagtaaatgtaaaaggcatatatatatgcttaattaaaaagcaagtcttctattttgtctccaagcaaaagtcctaaccctagcaggaacggctgtggctttgtttttccagatgttattcaacaaagagtgttacttttttttttaagaataacacagtacaacacagacactcacaacgcacgcacactcacccaccaaatcccacccccaaaaattgacgccggcatgccgcatcctgcatgttactgaatttacatctgaccaagattggtgttctctcttcatgatttctttataagattgttgaattgcttgtacctgtaggagtataaatccggcatatatagtctgtcttccctgtcatcatgcattatttctacctccaacatttgttaatttgtgatgcttatggttgacgaagttgaataagatagctagctagtatgctacacacactcacggcgtttttgagaatttaaattcctaacacgagaattttagcatcggtcacacaatctccaactaaaggaaaagaagattcagagaacatatcttatgtcagtggaatggagaatctgaatttgcctataattttttagataatgaaaattgattgcattcccagcctctgccttatagcacagagccaatataattttatactaaataaaaatgacataatatgatgggacaaattgctaactacccaaagaaagactagctaaaaggtttcaaatgaccacgcagattataacaagtaagcttctatacagtacaccaaccataataaagtaagagatgcttagctaccaactctaagatgggaatatatcctatgcacaaaagccttaccgtgtatacaccatgcatactaacgaaaatatttctccaaaaattttggaaaaaaattatacatgtatttttaatagtattacatctaatctcatcttcatattctttatatgtagagagcaacaaaaaagataaaattctgatagatttgtactctcaaaactgtcagaatttttatcttttttgttacggctaaaatataataaatttgaggttaagactttacacatactgtaatagtataagaagtacttgtacattttttttccagattttttgataaaatttgttagttgatgtgcatggtgtgtatacaagacttgtatgcacagatatgttcctcttcaagacatagcatatagtagtattttggtccactattatgacatagtggaccagcagtgtgaagccactttgaagagataactagcatgggttagacaactttctattattgaaaaaattatatcattttagcaatgccaaattgtccgatgtggttatcggcactccatgatttgtacagtgcattttcgctagcacattggcactagtagttgtaggaaaaaaaaacccttagggtaccaaactctaaacaacaggtgccagtagagccaatcacattgttttcctaccaggacatattcttagacacccactcaatggagaatgacaaaaaatatatccgtgaaaactcatataccatgctcatctctacacgtcatgtaaggtatcttaactaattaaaaaattagtagttttccgttcgtcacaaatctttttcatctgtctcctcgtgatcgtgcacgcaatatgagtctttcgcccgtcactgctaagttacagccagcccaatccacacaattcatccctgttcatgctagggtgtttttcagcccagtccacgcgagcaaatatgcccgaacaaaaagaaaacaaaaataaaagaacagcaaatgaaaatcgcaggccgccagctcagcgcgagtcctcctcctgcaatccagtggcttttaatgtgctatcctgtagatcccacttaaattaatgatttgatatttggcaatcttgtttgtgcaatagatatatcttgcctgatcttgatttatggcaaagtatttctttgatctgtttctggaggcctagggttcgttcgggtgttatagattttgggactttctaggtattttcttgtggtgtttgctatgtgcctatattcttagatcttggactgattgtggattggggctatgctctaaccttagaaccttacttgtcctcccctaacgcacttcaccagtcccactccccggacagtaagattcctgctgatttgcaagggccactcgccaatgaggcataagcgccactgttgctcgtgcagcagtcatgttgttccaacttccaagtcactgtgtcagcagtcctactgattaacactccttaaaatgggtttcgattatttgagatcatggcccactttcattcacttaggtggtcccacatgtcatcctcataaatgttaattaaagcaattaggcaacaaaacaatgttaaattatcaaatttttaataagatggacatcatcatcatcatggattcgtgaagtcagaatccatgggggcagcggaagtgatctgaaaccgttcttgacatgccgcgcagcaaagcggataaatgatgacgtggggatggtctagtttgatcgtcatggaagagaaggatggtgttgtccttgctgctgtcttctttcaacctagccggtcagtttctgactgaagtaatgcaagaatatgttacatatatacaaagctcacaacagagctcttgcattagaacaaaagaattgctggaaaaagatgatgcagttatacacgtatgtggtgataatttggaggaaaatcatttgatagctggatgatcacctgggattctaaactgcatgtaaaagcatgacaaaaagattggatcttttgtgattggttttagttaagaagtcataatctttgagaagttgcagaggaggtaccaatgcaaggttgttgcgattggagaggttgaagtagcatgtaatgctgtaaaataaggatcagcatcagtttactcatatatcaacttcggcgttgatggcagcatcggcagcaacatttgaagtagcagcatcttttatatcggttgtggcactgttgatgtcaatcccgatatcagcatcgagctcttctaagtcaacggagacaatggagtgcctggcagcttgcttttgcttttgcttctgcaactcaggtgcactaatatcttctttcttttgcgctttggttgggggccttggagcaaagatgaaggaggaagagggccaactcccaagtttggattggccgatgcaggagcgtattcgatgcggcacccactttagctgatgatgggaggatcgacgtaaacaacctacaagatgatgaggcatgaaagtgttagtgaataaatattttgaaaatagggaagagtgcatataatggatacctttctgttggtcttgacaaaatcaggatcaagaatgcagcaataagtggttccaatcaggttaaacatatgttgcttccattcacaccaccatcgggaccagagctttgaactagatgtgtgggtatagaaatcctcacaatcgcctagtgaaggtctctcgatcaacatgaaacgatcgaattctatggcattggctactgggcccctcgcctggattttgtcaatgaagtagaggccaatcgggtgctaagcgaagcgaagttgataagtagaaactagtggacggtaaaactcatacgagacatgggagttacaacccgtggagaccccggttggaagaaggcaatgggtgatggttgatatgaagatatcccttctttattaatcaaattgggtttaaaactggcagggaattcaaaattatcgccatccttataggcataccaaattttagcagtcttagcgaagccatagtaaaaggctttgaactaatagctatgatcgacaggcaataatttgcctcttgggtagcacgatgcgacttcgccataagtgcatgcatcaa

SEQ ID NO: 37497 - DNA, 4529 bp, Oryza sativa
  unsure (1)..(4529): unsure at all n locations
ttgttaaatatgtgatccgaattttgggcccacaatatattcggattagtttgctagtaggattagtttcctagtaggagttcctattaggtttcctattaggtgtctttctattatcccctatatatactcttgtaaaccgtacgggaaggggtgacgttcccattgttattcctttacgttggtaattatctcctctatagtgatcattgccggtcggcgcccgtggttttttcccacaagggtttccacgtaaaaattcgtgtctccgttgtgcatctattttcataacaagtggtatcagagcattggggatcaatctactagttcccagccaccggcgtgtttatcggatcgaagaaatcgatctcgggcggcaccgtcgtctcgtgattccaatccgaagcaaagttgccgtcgactcggagtcgacgtcgtccttcctgccgccgacgcgtcagaggagcagcgcaggcgcagcagaagcatcggcagccagcagccctaatacagaagcgcacggttcaagaaaaaaaaatcagccgagagagatcggttgtttcgttctgtgcatgctaatttttccagtggaaaattgctacagccaccaaagcttgtgtaccaggaagtttcagatctacgctacgtgcacacgagaagtgtaccaagtttcgcgattttgctaggtttacatcaatttcttactagcaaattcagtattaattcccatggtaagtttgaagtatgatctaccgctcctagaccgagacacaagattctcactttggcaagtgaagatgcgagccgttcttgcacagcaagacctcgatgatgcgctttctggatttgacaagaggacacaggattggtccaacgatgagaagaaaagggatcgtaaggctatgtcatatattcatcttcatctatctaacaatattttgcaatctgaccagtaagatgcacctgaagcaaaagttatttttgcacaagttgcaagatgatgggtctgtgatggatcatctctccgctttcaaggaaattgttgctgaccttgagtctatggaggtaaagtatgatgaagaggatttaggccttattttattgtgttcattgcctagctcatatgcaaacttcagggatactattctttatagccgtgatactctaactttgaaagaaatttatgatactttgcatgccaaagaaaagatgaagaagatggtaccctctgaaggttcaaattcacaagcagaaggcttggttgttcggggcaggcaacaggcaacaggagaagaacacaaacagcaaatcaagagataaaagttcaagtagctaccatgggagatcaaagtctagaggcaggtataagtcatgcaaatactgcaagagagatggatatgatatctctaagtgttggaagctacaggataaagacaagagaaccggaaaatatgtaccaaaaggtaagaaagaagaggaaggtaaagccgcagttgttactgatgagaagtctgatgcaaaattgcttgttgcttatgctggttgtgcacaaactagtgaccagtggattcttgatactgcatgcacctatcacatgtgctcgaatagggattggtttgccacctatgaagctgtgcaaggtggtactgttttgatgggtgatgatacaccatgcgaggttgcaggtattggaacagttcagatcaagatgtttgatggctgtatcagaacattgtcagatgtgcggcatattccaaatttgaagagaagtctcatctttatgtactcttgatcgcaaagggtacaaatattctggtggagacggaattttgaaggtaactaaaggctctcttgttgtgatgaaagctgatattaaatctgccaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgaggattgctagatggacaaagcatcaagaagctcaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagacaaactgaaaggaaggtgaaaatccttcgtactgacaatgggatggatttctgttctaagatatttaaatcatattgcaagtctgaaggcattgtgcgtcactacaccgttcctcacacacctcaacaaaacggcgtagcagagcgtatgaacaggacaattatatcaaaggcccgttgtatgttgtctaatgcaggtttgcctaaacagttttgggcggaagccgtttccactgcttgttatcttatcaatcgatcacccagttatgccattgataagaagactccaattaaggtatggtctggttccccagcaaattattcagacttaagagtatttggttgtattgcttatgctcatgttgataatagtaaattggagcctagagctattaagtgtatttttcttggttatccgtctggtgtgaaaggctataagttatggtgtcctgaaaccaaaaaggttgtgattagtagaaacgttgtctttcatgaatcagttatgttacatgacaaaccttctactaatgttcctgttgagagtcaggagaaagcaagtgtgcaggtggagcacttgattagttcagggcatgcaccagaaaaagaaaatgttgctattaacctagatgcacctgttattgaagattcagattcttctattgttcagcagtctccaaaacattctattgcaaaagataagcccaaaagaaatattaaacctcctcgaagatatattgaagaagcgaacatagttgcttatgctttgagtgtggcagaagaaattgaaggtaatgtcgaaccttctacatattctgatgctattgtttctgatgattgcaatagatggataactgctatgcatgatgagatggagtcgcttgaaaagaatcatacttgggaattggtgaaattgccaaaggagaagaaacctatccgttgcaagtggatcttcaaaagaaaggaaggtatgtctccaagtgatgaggcaagatacaaagcaaggttagttgctaaaggttatagctagataccaggtattgattttaatgatgtcttttcccctgttgtgaagcatagttcaattcgcactttactcagtattgttgcaatgtatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatcaaactatgatagctgtgtttatctcaaagttgttgatggttcagctatatatttgcttctttatgtcaatgatatgttgattgctgcaaaagacaaattagagatagcaaagttgaaggcacaattgagtagtgaatttgagatgaaggatttgggtgcagcgaagaaaattctcggtatggaaattactagagaaagacgttctggcaagttatatcttagtcagaaaggttatattgaaaaagttcttcgtcgtttcaatatgcatgatgcaaaaccagtgagtactcctttagctgcacatttcatattatcttcagatttatgtccacagtcagattatgatattgagtacatgtctagagttccttattcaagtgcagttggttcacttatgtatgccatggtatgttctcgtcctgacttatcacatgcactgagtgttggcagtagatacatggctaatcctggcaaagagcataggaaagctgttcaaaggattttcagatacctacgtggtacatctagtgcttgtttgcagtttgggagatctagagatggacttgttggttatgtggattcagattttgctggagatttggataggagaagatcactcacaggttatgttttcactattggaggatgtgctgttagttggaaggcaagtttgcaagcaactgttgccttatctactactaaagcagagtatatggctatttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37498 - DNA, 700 bp, Oryza sativa
tttacctcctaccagacttgaaacattgcaggtttggggctctggtcatattgaaatgtcatcatggatgaaaaaccccgcaattttcctatgcctaaaagaactccacatgtctgagtctggagatgtaaggatctaccaccgttatggcagtctgtctctcttgagtccctgtctttatcccgtttggataatttgaccacattatctagtggcattgacatggctgttccaggatgcaatggttccctggaaatttttccaaagctgaagaagatgcatttacattacttacctaacttggagaaatggatggacaatgaagtaacatcggtgatgttccctgagctcaaagaattaaaaatttacaattgtccaaagctagtgaatattccaaaagctcctatcctacgagagctggatatattccagtgcagaattgcactgaactcactcagccatcttgcagcactttcccaactcaactatgttggtgactggagtgtttctaaggatttgcaggtaataccaatacgctcctggccatctcttgtgacattagcgctagcctctttagggaactcgcttctcccagatgagcagcagacgaccatgccccctctggaatcaattcagaagctgagcatttggtattctagttgtttcttctcacctaattcgtcaaactggccctttggtt

SEQ ID NO: 37499 - DNA, 522 bp, Oryza sativa
ccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgataagccaagaaatcaaacagggcaatgatacatcaagtaagcaaattgaattgataaaaatcacactccattattattatagtagccccctgactgaaaacttcaagaaaaaacttgaagttagcagtcaaagaggaaagata

SEQ ID NO: 37500 - DNA, 776 bp, Oryza sativa
cctgcagccctgtatgtatatgtatatgtatatgtatatgtatgtatatgtatatgtatatgtatatatatgtattgcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaatgggtatttctgaagtcttctttcctttagcttttttgcatttttgaatatattcttttgcagcaggctctagataataatttattcttaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaagatgcactcttgaacttcatctaggattatatggtcctttggcttaaatttatatgaatttggtgggaatattctgagtttgttgtcatctccaaatgtgaagcactcgactccggcgtaattcattgatcttttcatacctgaaatat

SEQ ID NO: 37501 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtagccaaacatgtaggtgaggtccctagctttgctgctattgattcctccatggctcacactctcacactgctgctatatactccgtatactgctacctggctgcagcaaaggtattccacttttagcactatacaacagttgacgtggcctagtggtggtggtggtggagcatagcgccacgtctaccgacgagctagccaccccggccatggacgagcttgtactctccccttcctccttctccgccacggcctgcttcccgacgcttgacttcgagttctgcgaggtccccgaccaatggctgctgggactcggacacgacgagctcgacaaggatgccgccgcctccgccttggcggcggcagcggcctcgcaatcggcgagcaacgacgacgtgcccaggaacccgcccgccacgacgacgacgacgaagcggcgggggcgga

SEQ ID NO: 37502 - DNA, 6669 bp, Oryza sativa
gccgcagtgcccaccgtgtcacggatggacaaggcgtccctcctcgccgacgccgttgactacatcgccgagctgcgccgccgcgtcgagcggctcgaggccgaggcgcggagggcgccgctggctccctccgctgccgccgccgccgcctgggccgcggggctgggcgccggcgccatcggccgggatgatctcgtggtgcggatgatcgggcgtgacgccgccatactgcgcctgacgacggcggcggcggcggcgcggcacgccccggcgcgcatgatgtgcgcggtgcgggcgctgaacctggcggtgcagcacgcgtcggtggcgcgcgtgggcggcgcgacggtgcaggacgtgatggtggacgacgtgcccgccgcgctccaggacgaagcccgcctccgcgccgcgctgctgcacacgctgcagctcgccgacacgacctagctcttgctagctcgagctgatcaatggcagtgatacatggctagatcgaactagctagctaatctattagtccctctgttttaggttataatacgctttaactttggtcaaaattaaactactataagtttaactaattttataaaaaaataataatattcttaacttaagataaatatattataaaaatttatttaattatagattacctgaaaagaagtgagtatatatacacattgatctacgtacgtgtctgtaatggaagatgatgcatatgatcaacgcatgcatgcaagttagtagagtagttgtgatatattagtatatttctcactctcaatctcaatgcatggatcgatgatcaatgcatcgactcaattggctagctttttttttttttgcttgttttgtttttcctcttgaagattattgtcaaccaagttgtacacttgtactgtccaactatatatatatatattcgatcaaatagtttgaagctttatatattggcatatatattaatcaggattcaggacctgcaaattttgattcagttcgctgccatttagctatagtacgtacgtggtagtttaatttggattaattgtaggagtactagttactacattttgaaccattcaaatttactatatatgcatgttgcataaacaaacgcaatgcagctaactagggttatatatgtcttttttggcacaagatgtgtacacgaagtaatttgatatggtgttaaacgaatatttgccccttgtatattaaacttcgctagggtctagttcgatctaattttgctctttcttcacaagtactggtgagattaggtataatatagaacggagagagtataatatattgatgtgttcatgcactgtaaccagtgttgtaaagaacggaatacggtgttcgaacggaatgggtaccgtcaagcaattactcatgttcacactaataccaatatattagataatttcttgtagttctagagattcttaacatattatattgtcaaaatgagataatgtgttcgtatctcaccatgtgattatactgaaacagacagtaattttcttactagcttatataccagcagaagggttgtactaggtcttgtggattgctaacaatttaaaacaggttccaatgaaacttaattataacatacagtaagtccaatccggtgattatgaaaaattgggtgattaagcgaacaaaatggccatatttgagcattttccaactatacggaacggtttagccgacgtatccgtacgaccgtacgtatatacggccgtatatatatagtcggccgacttttactacactgactgtgacagcccattttcatactacaccactattccttttcgggatcaatggttttaaccacttaatttctaggaataacgtagccatcaatcccatcaatttgccttttcaatttcgccttcggtccagatctggcaaattaatacggagtatatgtggatcatttgctaggagaagcaacaaaaacttttcaatcaacagtgtcccttaatttgtttttaatttgaaaggtgtacatcctacgtactgtcctgtgtccagtgtcgttttcgatttgtcactcatggtgagtttatctagtgatgcaaattaaatttagattcttcctcctttcaaaaatcaaaaaaaaatcctttaaaaaaattagtttgttcccgtgattgcggtggcaacgcgggttggatcagcacctcccttcccctcatctcatgcccaactgcatgtgatgaggagttccatgagggccgaccatcgtgtgtcgattggtgtattttctcggtgcggttcaagaaagtactagtatatatagtatgtgacatatcctaagattttttagggttagtcatattctaacataagttaattttttttactgaaagtagtaggtttggctggcaacaacatctttaatttatgtgtattccctatgttaaaaaaaaatataacctttcaagtactgatcttatagtacatatcttctacctctagccaaaatgccaaatttcccattctctctcctcgccactctccccagtccccacatccccttcctctgttcttcttggttggagccctccatctccagcgcaaaaacacgctccacgctgcatcttcttttgcttctcggctggagcctcatatctagcgtgaaaacacgctccctcgcctcctcctcctcactgttacgacgcaaaatgcaatgtggtacatgagtactatgtctagttgagactgagtatgttcccggcaagggagcgtgctaagtcggccatcccatgcccctgcggttggatgagggcgtcgccgccgccgtagctacgcatcggaccctagctaaactttgggtcttctacggggaagaaaaagtggaagagaggtagtgagagtggagaggagacatggggaatagttgggtgagctctccatccatgcccggggaacgtattccacgtgcgaagatggggctccattgcttcggttgatgataagcagagaagaggagagaatgagaaaaaagcacttgagctagaggtaaaagataggtggtctaagattggtgcggacacgtggcagtggagaagcaaattctttccaaatatgcaaaggaccgaggtcctgtataattttgttccgacagaggaaaaactcaataaagaccgttgatagaagcatatatatggtgtaatagaacattaaaattaaattggcccttttcggtgcctggcgatggagatgtgttgacggctcaaattcgcacatgtgtcacacagagatagcacgtcatattccaaaaggagaattttgcttctttgatttacttatagggacaacacatatataaaatctatagtaagatgtttttctacaagtattatactccctccgtttttaatatatgacaccgctgattttttaacaaacttttcattattcgtcttatttaaaattttcgtgcaaatataaaaatataatattatgtttaaaaagcatttgataataaataagtcacaataaaataaataataattatatattttttaataagatgaatgttaaatatatctaaaataatcaacggcgcatataatagaaaacggagggagtaactaatgattgccgaaatattgctttgtttatgtgctcccggccgtgtcccgttcaaagcctcaacaaatgtcaacaatgcagatcgattggtttatagtacagtgtacaggattctcctacttctgccaacttgaagcttttgcaatgcatttatgcatgtgccccatgtccgtacggtctccatcgaaatggtcgttgaggaggcacaggcccaactaactgccgatcacgagcccagatatagctatggcttatatgggctgtatatagttagtgtgctataagatactaagacaccacatggttaggctctgtttccctccggcatggaaaacggagcagcgattagttaagtatttgctaattaagtatttactatttttttcaaaaatagattaatatgattttttaaacaacttttgtatatatatatattttaaaaaacgcaccgtttagcagtttaaaaagcgtgcacgtggaaaacaagggagggaagttgggcactagagctaacgaacgcaacctaagttgggaacgcaccctcaattattggtctaatccgattcatatcctttgatcacaataaaatatatttcgaaccccaaattgttaagattggtgtgaaggtggtttccttgatgtggatcgtggacataaagggggagggagagaggagacgagagaacgaagggcgataggggatggcatgtgggcccacctctaaaaaaacatgtgatgagtggactacacagtcaataaatatcaccttcaatattgtctgggagtagttattttatatcggttttaacagccagaggaatcgtgcgttatacccagttttgcggttgagagattaaaattagactccttttcacaccaaattgattcgttagtgggctctaaatctataatgggctctctggacattaagcccaattaagatgaaccgaaggtgtgattgatttgggtttgtttggggtggtgaaatggcatgcgaaacaacacatcacatctggatcgtttccttctctctgcgcacgtccacttgcccgggaccttcgtactatggtggtgtttcagtaggagggattaaagcttagtcttctcataaaaattttagtctctctcatagggacttatgcttttatgagagagactaaagtttagtctctccttcccaaacagcacctatacattgctgcaatgcttctcaagaaaaaggagacaaagaaccaaacaccacttggttaatgcaccaactcagttattatcaccaatcttttttcctcacatatgcctgtcttatgcacgtactcctacttctacatctgcatgaaacaaaacacaagctagctccaaccaaaacctatgattactagtactactaactgtacagctactgtaatcttcactagagaaaataagagaaaataagagggtcaaaggaaatggaagaaaaatagtcacacagatgcaaaaaaaaaaaaactccatccattccgaaatataagcacttatagcatttaaattttacactaaatgtaagcacttccaacactgttttgatactacttattccatcagttatctccaattctaatttattcccatattaaacccaaacatacctaatttaatgaggtcatcaaaatctcttatgctcgatcttaacctgatctaaacaatttagaggaaacataacaaacctataatacaacctcaaagatcatatgattggatggtgaggtgaagtaagaaaaaggacagagaatgagtggagttgtcttgcatgcaaaaagcaaactcaacgcaaactacaagaagggaaaacatagggtagttgctgttagaaaatagtgtatcgtgtatggtaactttctgttgatgattagataatgggaataaaattgaaagtagcaaccacttctaatctttaccttaattttgttcttataaatgcttatacattggagcggagggagcaactacttctctacatagtatttagggcatatttggcagggctcaactccttataactcaaggagcatagtctagagtggagttatgtagtagcctgaactacactctagattagattacatttgcatgcttcgctctttttctgggtgaaactaaaaccgtttggttggctacctctgcctctcttagagctaaagacaaccaaacggtaaaaaaatgccttagtttctattcctatttactatctcagcgcattgtaataataatttgctttaatttttccacatgcttttttatcttagtcaatcacaaccaatatttatttaatttaacctcttattagtctcgtgaataaatttacttgtattcttaaagggaggaagaacgaactattaggaagtgttcgagagaagcacgtagaggaagaaattgtcctcgttcttttgtgctggtgattcccaaactgttaaatgatacattttttttaaaaaaagatctataaaaaagttgctttaaaaatcatattaatccatatttcaagtttgtaatcatatgctaacggttcatctcattttacggatctcctcaatactcttctttccccttccttttagatacaatattaggccgtgttccggagattcggttggaaacttctcttccgtgcacgtaaaaacgcttactcgaaagcgcattattaattaaatatttattactattaaaacttgaaaaacagattaatatgtttttaaaaagcaattttgtttttttaaacaagcactgtgcccttatataaattattattcagaaaacaagcattttaaaaaaataaaattgagattcgaacacaaaagacatgttccatcccatcgactgcaaagtcgcagttgcaactcatcaggacctgaccagacctgacctgaccagaccgggctgcctcctctcctcatccctgcacctacactccaatactccaatcaatccctccccaaaatcacacgcctcggccccgacccaaatcccccgcttttctcctctctgtccgatcgcctcctcttcctcctc

SEQ ID NO: 37503 - DNA, 9379 bp, Oryza sativa
aggagcttcagcggcttgagatggagctgcgagctcaggtcatcgcccacccgcagatcatcgaggcgcagcgcagcttcgaggctgctgccaaggagcatgtaacggccgcggcaaagctgaaggttctgattttgctttccacttacacgcacttcgtgttgccagtcgtatcatgcattaggtgggaactgagtacatgtaacttactaattgcacatgatttggcctgtactgcggttattggctgcttatgagtgctactcactcattcattatttctgttggcatgatgatcagtattgctacagatggttacactgtcgtgaagtgggaattgttcctttttattttgatgtctaggatgttgcttagtgggtgacctcggtagcttctttgctgcttcttacagaatgaagtacgtagtatcaaatatttctttatgctgtgataaatttatgcatttattcttttttaccaaattttggctaataccttaatgatggttatgtggtgttctgttgttgactgagtatatctgttattgtgtttgatttgatgcgtgcagtgccttgcttgttagctcaagtaatgttagtttacggttcacacacaagtcatgatctatactccctctgtcccaaaatataaagggatttaggatagatggtacacatcctagtagtctgtccagattcgcagtactaggatgtgcccctatcccatccatcctaaatcccttataatctgggatggagggggtacattacatgattgatgtacatactgcagattgccttgtcctttttagtgggaaaaaaaatactgatttcgaattgtacaggaacaactgcatgaacgggaaaagtacatccttgagctcgaaatgaaattggatgacaaggacagggaactggatgctttgaagattgaccatcaaacggttagtgctctgtgttgcaccagtgagatttagaggttgtgatctctcaccatctttgtttccttttggcaggtgtgggcaaatcaagatcttcttagagaacagacaaaagagcttgcaacttttaggtactactgattcatttcagtatcatgtgggatgaccgtatttattactagttagagcaacaaagcagctgagttgcacctcatcaaagtattagagttgtttatggacttgctgaattgcttgttttcttactcaatgaaaaacccgcatgtgatgttgattcccttttcttttcttttcttttcttttcttttttgtgaatcatgtgatgcccatttatgcatgataaaatagttttattgtgcaaaagaacataacaaataaaaaaaatcatgtagtcatttgcaatccctgaccaggacattttttttttggtttgagcaaaatctttgttgtagaaaataaaatgtgtttggtattttcttatcttctgcagaagggaacgtgacaattctgaagctgaaagggcacagcatcttaaacaaatccatgatctccaagaacatctgcgagaaaaggaaagccaaatgcttgcattagaggaacaggtattcttttttcaaccctcttgtttccattctattttagattgtgtatgactgtatgtctctatgcgcatagtcatactacaaaagatacataaacatctttactgacaatgtgcttataacagtatcctagttattcacttttgaatgattaacatgatagactcttacagaaagtgtaacttagtatcataggatgagtttactgcagttcatttctaatgttatgcaatgtatattgttgaactagggttttaaacactttatgatagttttaattcctttccaatgaaatggcttctccttgtttttcggttgcggcaaaaaaagttttcccttcagggagaatattaaagcattatcaccattgaggcattaagtaagggcttggtatccaggcatgaccaatttaccatttatttcttggtaagaatttttaaatcaatggccaaaatttgtggaatgttgcttcctcaaattagcatccagccattccttgacaagcatttatttacagcatagggctgctcaagataacattatttacaaagatgaacaattgagggaagctcatgcttggatggcacgagttcaagaaatggatactttacagtctcagacaatgcaagctgagttacgtgatcgtactgagcaattcaatcaatattggattagtttccaacaacaggtacgatgtgtggttcattagatgccttcattctactgtttgcgtatgtcttgactgcgttatattaacattctcttcaccctgtcctcttgcttttccccagtatgttgagatgcaaaggggttttctgcataccatacaacaacttcagctagaactaaatgaattaagagaccgaactggagcaccaaaagatggttcacaaactgcacaggagagttcggccgagtcaacacttggtcagaacaaagggaacaacatggctgcaaatggtagtggaacaacagatagtagtcagtcagtgaaaagtaatggagttccagattgttccacaaaggtatggacgtatggttgttttttattgtagcttcctgaaacatttttcagtgcttatcatggaaggtgcaaaatatagtttgatattggtcagtcgacttccttagtatgtggtcagtatccatgatttgtgttggtcttacttctattcagttaaactgtatcatattggtttatgtggacacttctatttcactcaagaagaatattctcaatggaactgcaatatttgttgctttcagggaaacagtaatgcctctcctgtacctgttgttccttcatcactgttgggtataggtggttttgttccttctgcgcagattgccgggatgcattcttatatgatgcatcctcaaggtgttcctccatctttagcatcgcctaactccgctgttcctcagtttggtagtttccagtcacagtcgacaattcaaccaaacatgcagtggcccaatcaacaggtacacaatactgtgtagcattttattattgtatcctgtttctgttgacattttgaccacctataatttctaacgcggaaacaatttttttgtcaattaggaagctcagaatgcctctcagacaccagatgaaacaaactatcacacatccccaccagatcagaaggcattgcaacaagctgctggtaataatgatgagctttctttgaagcagaatcaggcaacccgtgcagaacatcttacagctacagcccatgggaaacaacagcaacaacaacgtttcccaagtgtggtttctgaatccactcatgaacaaaaggttactagtctgttttcttgttgttcgttttgtgtactcatacaatttaacactgtttaaaatctaattctttctagaacagttacaggttgtggaatccaatgtaactgaacatttagtttacaatgagcaacaaaaggcccaggattcatcttcaattgtcagccctattcgaaaatttgaacatcaagagcaaacaaatgaattcaaggttaaaatatttaccattgtttcttttgtaaatttctatttgatgtgtaagcatcttatatcaaagctctatgtacaccaggatgaaaaagttgcatcgggcaaccagtcggaggagcaggtagctaggcatcagcataaagcttcagattttgatgcatcaactactcaaatccacttgaaaggtggtgcagcagagttcactgctaacgttgggaatcagactgacacgcatacttctgctggtggtggtttgggttcactcttacctcgcataccaaaggagccttcccttctagatgagagatcccttctggcttgcattgtacgtgcagttcctgctggacctgatggccgaatcaagattagcacaactgtgagttatacatgcatgcttatgattgagttcctgactagtgggaactgtatatattgttgtctaatggaacatttactgactcatgtgcaaatttttttttcagctaccaaataggcttggcaaaatgttggctcctcttcattggcatgactataagaagcactatgggaagctagatgattttgtggctagccatccagaggtctattttcacaatcattaagtaaaataaccgtgggtaattcttgttattgattgttgtgtttgttctgcagctctttgtgattgaaggagacttcattcaccttcgggaaggagcacagcagatcatttcagctactacagctgccgccaaaattgccgctgttgcatcttcggctccttactcattgttaccttcagttgctgtcactcccgtggcacaaagcactaggcaaaagagaggacctgttgttgattccagatcttcaaatgtaatgccatctagaaatgggtctaccactgctagctttggagatcagtttgacaagggtggacatatcccaaaacccaacgatagtgttggttataacattgttcaggggattggtgatgtaacaattgcaagtaaagtaaaagacatccaggagaatggcttttcagatgaagttcgacctgggcagtcatccatgcatgctgtttctgcaaatggagtcagacaggaacgatctggccttcctgcaggtaataccaggcatggttatggtgggaagcaacagggaaggtatgaaccatttttatgtgttattgtagttagacagtctttcttgtttcttagtgctgatttactgtaaattccttgtatgtaccaggtctacggggcctgcatacatttccagaagatgagcaagtggcttgtcgttcggtacgatttcatactctggtgtaaaaagtaggagctgctattgctattttggtaattacggagtagttattttttgtttagaagttagtcaagttactatgcttttgtagatttatttactactgttattctgtttctagaggcaattggatataggtgatgttagctcatacaccctctatttcaaattacttgtcgttttacgtttgtcctaagtaatcattttaatctttgaccgccaatttcaatatactcatatagtttaacatcatgagatttatatttttaaattcaccatgagaaatactttcataataagtaattgacatgttattaaactacatggatttccaaaaattaattgtcaaagtatatgtttgacttaggacaaatctagaatgacaagcaatttgaaatggagggagtagaaggtttagaattagacaagtatagtaccatagtgttgaatgagagtaattagcaaactacagtaccatatacattttacatcggcgtctagtttcttttatcaggctatatgtagagtattatctgacacacgttgtttgtatatggaactcagcatcacatgcttcaattttttttctctcattgcaggtccagttggtttgaagggcagtgagcaaatcatgtgaagctatgttttggtttaaggtttaaaagggttgaagtcgaagatgaccagaatgaattgttgtgaatttaattccgcaccaattgcttttcgcagcgcctgtattgggccatgttttggcaagttgtactgaaactagttcccgatcagaaaatactgaggaagttttgcaaccattgtaacttgtctatgcctgcgtgccgtggcgtggggcacccgaatgatagcatctgtgcccttccatggtgttacgccacattttaaactgttgaattttagccagcatctatacagtaccagcgttttttagtaacaattgtcttacatggggtgtacagcgttttatagtaacaattgtcttacatgggttgcatcggaggaaaaatcagtcagggtctccctctgtcttattttaagcgtagctataagttttcgtgtcaaactttaattatgtttcatttaaaattgtctcatttaactgcttctcctagtggtgcgcggggtctgatgcattctgaattctgatgcattcgtctcaacaggatcattcatattcgaagcccgaaggcattgccgactaccgtgccagtttgtttcagcaaaagtgtgtttttgctgataagaataagacggcgagggccgaggagctttcaacgaaactgcaaccaaactggtggattccacgacacgaatgcactaggcaaaagatagtcgagctttcagttttacatcgcaaaagttatagtcaagttgtcatattatactcatacggaccaaacatgtccgcttgaattacgcaccagaggcccagagcgcttcatgctttgcctttcatcttcattaattccaccgtgctttgcagctgagaacgcctcatgctgtgactgtaatgctgtgcaacgcaacatggcggaatcgctacttctcccggtggtgcgtggggtggccggcaaggcggccgacgcgctcgtccagagcgtcactcgcatgtgcggcatcgacggcgaccgccgcaagctggagcgccagcttctggccgtccagtgcaagctggccgatgccgaggcgaagagcgagaccaaccccgccgtcaagcgctggatgaaggacctcaaggccgtcgcctacgaggccgacgacgtcctcgacgacttcgagtacgaggcgctgcgccgcgaggtcaagatcggcgactccaccacccgcaaggtactcggcttcttcacgccgcatagcccactcctgttccgtgttaccatgagtaggaagctgggtgatgtcctcaagaagatcaacgagctggtcgaagagatgaacaagtttggcctgatggaacacgtagaggtgccacagcttccttatcggctaacacactcggggctggacgagtcagcagacatatttgggcgagagcatgacaaagaggtgttggtgaaactgacgctggatcagcatgatcagcagaatttgcaggttctccccatcgtggggatgggaggtttgggcaagacgacgcttgccaagctgatatacaatgaccccagtgtccaggaacatttccaactgaagatgtggcactgtgtctcagagaactttgaagttggttcccttctgaaatccatcgttgaattggctacaaatagaagatgccaactaatcaacaccatcgagctgttgcgacggcaacttgaggaagcctttggccgaagaaggtttctacttgttcttgacgatgtatggaacgacgaggaaaacaagtgggctgatgacctaaagccactactgaactctgttggcggtgcaggaagtgtcattgtcgtcacaactcggagccaacgagtggcatctataatgggcacacttgaaccttatgagctacggtgtctgaatgaagatgattcgtgggaggtgttctccaagagagcgtttggtaaacaagtacaggagcaagcaaagttggtttccatcggcacacgtattgtcaagaaatgcaggggggtgcctcttgctctcaagacgatgggtggccttatgagttcaaagcaatcagtctcagaatgggaggtcattgcagaaagtaatattggggctagggtccaaggtaaaaatgatgtcatggacatattgaaattgagctatagacacctatcacctgaaatgaagcaatgctttgcgttctgtgcaattttcccccaagattacgagatggttaaagacgaactaatccaactatggatggcaaatggttttattcaagaagaggagaacatggatttgacacataaaggagaaatgatcttccatgatttggtatggagatcgttcctccaagacgtgaaagaggagttcataatcggttatcactgtgattcaattgtttgtaaaatgcatgatttaatgcatgacctagcaaaagatgttactgatgaatgtgctagtacaacaaaagagttggatcagctgaaaggctcgataaaagatgtccgtcacttgcgaattcctgaagaaatggaagaaacgatgaccgagttattcaaaggcacatcatctctgcatactctgatagaccgatcatggcgatcaacattatggaatgttagtgtggaattcaatttggcatcagtgagagcattgcgttgttctgttatcaatagtgctatcacaaatgcaaagcatatacggtttctcgacctttccgagactagtatcgttagattgccagattcaatatgcatgttatataacttacaatcactgaggctcaatagttgcgatgagctagaatatttgccaaaaggtatgagaacaatgaggaagcttatccatatttatctatattggtgtgacagtttgcgacggatgcccccaaatatcggtctgctgaataatcttcgtactctgacaacatatgttgtggacactgaagcaggctgtggaattgaggagctcaaagacttgcaacaccttaccaacaggttggaactgtacaatttgcacaaagtaaaaagcgaagagaaggcaaaacaagccaatatgtaccagaagaaaaatctaagtgaagtattgtttttctggggccgacaaaaacgttgcatgcctaatgacaatgcctataacgaggagcgtgtgttggagtcacttgcaccttattgtagtaacctcaaagttttggagttacatggatatggtggtgttgaaatccctgaatggatgagagacccacacacgttccagcgtatatcaaaactcaacatttcaaactgtccaagatgcaaggatctaccaccagtatggctcttggtctctcttgaggagttgtccttgtcttgcatggataacctaaccacattatgtacgaatgatgatgtagaagctgagggatgtggtacctctctgcaaattttccccaagcttaagaagatgttcttaagaaatctaccaaacttggagagatgggcagtcaatatttcaggagatcctagtagcttcatcacgcttccccagctcgagatactaagaatcagtgactgccctaaacttgcaggcattccagattgcccggttctaagagacctgaatatagatagatgttcaaatattgctgtcagctcgctcgcacacgtaacaagtttgtcctatctcagttacgacgcagaaggctttgattctatgaccatgccgctgggctcatggtcatcactcatgagattaaaagtaaggtctctcgcaaacatggtgatttctctggaggaccaacaaaaccaaggagaaagtaatctcgtaaatcttcggcgtttgaatctacatggccccaaatgcttcacgacggtatccggtttctctgaattgcaccatgggatatgggta

SEQ ID NO: 37504 - DNA, 6676 bp, Oryza sativa
aaatttttctttgtccgaggaaatcctttatttatcctgtctagaggaattaaatataactagttgttccggaatagtggagatcccgaagttgcctgcatcgctcgaggaattgtttattcaaagttgccagaatttggtcgtaccactgcctccaaaccttggaaatttggcaagtctaaggaatttcatcgtaataaagtgtgagtccctgaaattgctgcccgatggaatggatggcctcacttccctgaggaaattacatcttgatggttgtcggggatagagaaatttccggagggtctcctccagcggctcccgaccctcgaatacctacatttatattcctgcagtgtcagcaatgatcagcttgtaagacgttgcaaagaaggtggtgagtattttgacttgctctcctccattccagataaatcaataatattttcagaaaggtactatcgcaagaggttcctccccttctgctgactgctagtacctgattgaggtgcgtacgttgctgctattccatcatcttgttcaactattaacagtagttgaataatccatcaaaatatagctcctaccaagttatcaaccacttccattttttacttcttttcagcgcttgtttatagttgtgtttgctagacgctgttggatagcaaggtggcacatcttctcagcatacagatgagaacttcagttacaggctgcaatggcctctatctaaaaatgttccaggctacgaagatcggaaatggtgacatctacaagctgttcagattgatgctatttcaaatactattattgctaaagttgttaaacatgtgcatttatttagtttttttaatcgaactttagtaaatacataagaaattctgccaaaacttgacaatattgtcaaattgtcaaaatttggtaaggtttattttgactacaatctacccctaatttattttatcaggctatgtacttgtatttttattaagtatagcttgataaaaaatgtttttttatatcctgagttacatagctccaaaaaagcacaagaatatatccttagttacatagctctaaaaattagatgccaaccctgatgaggagctggtaagatagtaaaaagatggcatgacttcgatgaattgaattatatatgaattggacttggatgaactcgatagattgcaaaggaagaaactgaataacctatatataacacctgagacttggatttttttttaaaaaaaacatttccattggtctagtgtgtgtttggttacaagaatgttgattatatatattcccataaatcgtggagtaattctagttgattcctatgtttgataaaaccaccaggaatgttagttagagatataggatattccggctaaccaacattctgggaattaatacacggcattaggaattaacgcctactccctcggtcccacaaagagtcaattcctagcatccctagataaaattagcagagagtgagaatgactaaaatacatttaatcattaaaaaaatagtaagagtgacatgttgttaaagggtattgaaggaataaaacttctcgttttacgtgcggagggtaggtaggagtataaaaattggttttttgtgagataaaattcaaactctagaagttgattttttttttaacggagggagtacgcttctacgaatgtttacattctctattgcctgattgccatggttaggattacattaagattactgtccatcccgatttcctgtgaccaaacttaccctaacggcaggggctgggggcctagggatataatccattttaattatcttaaaaaaagctcattggtgtaaatcaaccacatttttgtggtgtccgcgtaaatcaaccacaccctgtcatgtctgaaacaaccatgccaccaaaatatatggaggtatttggttatattattacatgaaacatccattattgataatagaacagaaaacatgcatcatgttctagctaggtagtttcttcattgtgcaaacttggcataaaacagtcgctcgaactcctccatctttcgtgcctccatacacatgagcacacgcacgccacccccatcgttgtcaatgccatccatcatataaacaaatccgccacgcacagactccgcacgagacatcatctccggcttcccccacccaaaatccgcatcataaactggcatgcctagccaagagaccattcgtaattctgtatctggcaggtttcccttggtatgcttgttgggcatccctgccatctcattgtagtctatcgccgactgcagcatctcatcgtcaaggcgtcccaatgcgttctttatctgggcagcagttacatccagtgtccccaagacaatgtccctaactgtggaggctactttcaagtcgacaagtgcattgccgaagtagcgatctgggagaggtggcttcacacggcgccgaatgttgactgggaagatgacgcgtgtctcggcgtctagagggagttgccgagcaatgcacatgcactgccatacaagggcgctcatggcacaaaatgtgctcaatccaccacatatttgtttaagggcatcgagctggttcttggagatgacgaatatcttggtggatatagggtctgatggctcacagaagttgagctttagactgaacattgagtgcacatccgggtggacgataggtggggagcgtgtgcggaggagggtgcgttcatggcagggcagctccaacatggcggcttcaccatctcggcagaaagaagaccatgtctggaagaaatggaacgcgctaagggcatcgatggcgacatggtgcaacaccgtccctaatgccacaccaccacaactcaagaaagtcacctgcaaggaataattaatgtgcacctaggtacatatcaccacactagtccaaagctagctctatacaattgaatatacacacatacacacacaaactagatatatactgacctgtactccaagcatgatggatgctggctcaatacggggggcaaacaacctcctcaactctggtgatggcttaaggtcgctgaaggcatcaacggtgagttttgactgagccacaacaaagagcgcaccctcggcattgcagtcaatttcaggcctaccatcaccatctacactgagacggcctgccaaggggtagaaggccactagggcctttgccatagcctccttaagcctgcctacctcgaaaaaatcggcagcaacagtggcagtgtcacgttggtagaagtacacagtaggggtatggcctctgctgaccatgactatgtcgaggggagagagccagagcccttgccttggcgtgtcctcgtggggcgttacaaaacaagactccatctctttcacctcttcttctatcgtctctggcgtgtcctcgtggggcgttacaaaacatgactccatttttttcacctcttcgtctgtcgtctctcacttcagcgccttgtccatgagaaaatattggctgcaatgcatactaaactgctgggattagggatgaaagcggatcgaatacggtcagaaactagctctatcatatttgttttcatattattttttcaaaattggaatcagaaccggatatgaaaacaggattgaatattatcgaatacagatacggagcgaatacgaaacgaaacgaatgcggtgacaaatattaatcggaacataaaaacccctcaaactaagcatcacaaatcaacgaagaaatataacttcattattttttctaatagaaaatgtcaacattttcaagttttagcgattaataataccatatcgacaaacatccacaaacttgcacacgctgacggctgacatagtcacacagattaacattaggtcattagcacaaacttgcacacactaacatagtcactcactgactcacacacatcacagtatcacacactgacatagtcacacacatcaggtcattactcattagcacatagcagtcatacccttgtttagttcccaactttttcttcaaacttttaacttttccatcacataaaaacttttctacacacataaacttataacttttctgtcacatcgtttcaatttcaaccaaacttttaattttagcgtgaactaaacacaaccatggactcgcagagtcacagtacatagttatattcctcttccctcccgaagtggtcgaccatgtacgcatgcagggagtagatcgagcacttacctggtgaggaactcgctgacaggcttgccggataggatggtgaggtgtcgccgttggcgatgcggaggatgtcctcgtacgtgacgagcggcgccaggcggcagaacgcctcgttggcggtgatggggcaagtcgacggcggaggcggcgatggggcgcgccggccgtcgctggcgcagagggagatgcagatgcagatgctggcgggcggctgtgtgggtggagagcaggagagagactggagagcacctagagctagggttacatggttgatagttgggctgaatggcttaggcctgaatgcctgattgggtttcccagaggaaaaagtacaccgaaggtccctcaacttgtcatccaaaccagaaaaccagatatccacaactaatcaaaaccggtgacaatatgtcctttggtggttttgacaccggttttatcctatgttgcggctgagtcagcgtgggacccacatgttaggctgtgtcatctctctcccccactcttctctttctcggttcctcgtatctctctctctctgcccgtaggatggtcggcgggagaggaggagggcggcgccggcagcagcccgacggagctccacgtcgtaggcggcgggaaggcgcgggacgccacaccatctaagtaagtaactatcacatacgccacaccatcaattcatccattagaatcaaatttacactgagatctctgcaagactgcaacctacgctattttcttatcaagctatgtaactcagggccatagctccaaaaaagcaatgaaaaacataagaacatatcccgagttacatagctggtaagatagtaaaaaaatgtcatgatttcgatgaattgaattatatgcaatggacttggatgaactcgatagatttgcaaagaaagagactgaataacctatacatacatacatacatacatacatacatacatacatacatacatacatacatacatacatacatacatacatacatacatacatacatacatacatacatacatacatacatacatacatacatacatacatacatatacacatacatacatatatatatatatatatgtatgtatgtatatatatatttacatatacatatacatatatgtatatatatacatacatatacatatacatatatatatatacatatacatatatatatatatatatatacatatatatatatatatatatatacatatatatatatatacatatatatatacatatatatatatatatacatatatatatatatacatgaatatagacatctattaatgaatatgaacttagtgagaatatagacatctattatatatcaaattccaatatagagtgcataggattacaagcatttgcaccaaattggtatagggatattaagtctaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacatatgtctgcagcatttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtaatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggagatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacgctaaattaagaaaaaatggtcagaaatattttaattctgaagacattaaattagtaagattaataaaagaaaaagtgaaagaactaaaacctctagaattaccatt

SEQ ID NO: 37505 - DNA, 1701 bp, Oryza sativa
cacacacacacacacacacacgcatatatatatacatatacatatacatatacatacatatacatatatatacatatacatatatatatatatatacatatatatatatatatatatacacacacacacacacacacacacacacacatatatatacatatctacatatacacatacatatacatatgtacatatgtatgtatacatatatatatacatatatacatatatacatatacatacatatatatacatacatatgtacatatatacatatatacgtatacatacatatatatacatacatatgtacatatacatatatatgtatacatatatatatatatatatacatatatatgtatacatatatatatgtatacatatatatatgtatacatatacatatgtatatatatacatgtatacatatatatatatatacacatatatacatatatatatgtatacacatatatatatatatatatatatataaagcaacaactgagacttggatgattttttttaaaaaaaaattccattcgtccaatgtgtgtggttgcaagaatgttgattatatatattcccataaatcgtggagaaattctagttgattcctatgtttgataaaaccaccaggaatgttagttagggggctaactaacattctgagaattaatacgcggcattaggattagttttaaacgttcctggtggttttatcaaacataggaatgcaacattcctagaaacataggaatttgtcatgtctgaaacaaccatgccaccaaaatatatggaggtatttgattatattattacatgaaatatccattattgataataaaacagaaaacatgcattatgtttgtagctagatagctagtttcctcattgcacaaacttggcataaagcagtcgctcgaactcctccatctttcgtgcctccatacacatgagcacgcgcacgccacccccatcgttgtcggtgccatccatcatataaacgaaaccgctgcgcacagactctgcacgagacatcatctccggcttcccccacccaaaatccacgtcgtaaacaggcatgcctagccaaccaatcattcgcagttctgtatctggtaggtttcctttcgcaggcttgttggacatccctgctatctcattgtagtctatcactgactgcaacatctcaccatcaaggcggcccaatgtgctctttatttggccagcacttgcagccaatgtccccaagacaacgtccctcaccgtggaggccactttcatgatgacaagtgcattgccgaagtagcggtctgggagaggtggcgttacacggcgtcggatgttgactgggaaggtgacgcgtgtctcggcgtctagaggcagctgccgagcaacacacatgcactgccatacaagggcgctcacggcacaaaatgtgctcatgccacaacagattcgtttaagggctacaagctggtgcacagagatggtgaagatcttggtagatatggggccacgacgaagagtgcaccctcggcattgcactcaatcttgggcctactgccgccatctacatggagacgacctgccagtgggtagaaggccaccagggccctagccatagcctccttgatccttcctacctcaaaaaagtcggtgttgccgctggcagcaacaacatcacgtcggtag

SEQ ID NO: 37506 - DNA, 14951 bp, Oryza sativa
aatgtatgacgttttaactaattaaagtcaggatcgagtacaacccaaatagttgttatagttacctggattatggtacgatgctgctctctcaatggacacttaaccgattgatcttctccacggccggccttcgtcgccgcgccgtcgtcggctgctccgcctcttcgccgccggcgaccttgccgaggagtctgtgtctgtgccctctccgttcttgagctagctagttagctcgcatgcagtgtgaggctgtgagcccgagcagctctggttgccgatccgtgggggaagagatagattagtggcttgatctggccgcggcatggctgactaatttatactccatccatattaaatattttaatatagaacgtagttgatttatgtaatttattttattgtgacttaatttatcatcaaatatactttaaacataacatatatttttatatttgcataaaagttttgaatttttagataatagaataaaacatcccggactttgctcattagagctatagccaattattacaaaagtacgtatcacctaaacactgagtgtagttcaaatgaattaaacacatccaacaaaataaaagatcaaactaagataaaagttttgatcaaatgtttattaaaaagtcaacgacgttatatattatacattatacattatgaattatatcccatcgatgggaaaagaattaaagaagagatatgatgtggttttcatgttttagttgtcgggaatctctcctctctaaatgtttaggtactaatcactagtactaacataaacacttgtatttactcggtgacacaaacacacaagaactgaacaacacacagctttggtcgaggcagccacaccccggctcacttcattttcctttcattttatagactcacacagtacatgcagataacaaccagccaattctcttgaccgggactcacgctatgcacacaaacgtgcagatgccatgcaactaagtaactaactaatcctacttatttgccaagaaatcacttcacatgattaccactaatcacagcacatgcggctaatcactagcaacaactaaatctcatgcatagctaggaccgattcactcggctaatactgaccacaccttgcttgcaattcggctacttctcgcagcactccacatgcagttgagctcttggtcttcatgaacgttgtttgctccattctcgcaccaccgcatcacacggcatgtcggcatctcgcccatgagctggagccaaactaaatatgcagtttgtacatatctcacgtacatagcttctagcatgtgacctatactacatgtaaacaaaatagaaccatgcatatatcctaattaatgacaagattaaactctatcattagtgtggatacgtacgttagtggttcaagccactagacttgtccccatccaattttcagccatcggatgagcaaaccaacgtacaggatatatatgaagggaactatatatagttgcgccatatttttttctggttaactaaaacacgatcatattaatttctaagcagcaacagatgactatttaataaccaattgttcaaagacagccgtcgcatgaacagattaacaaattagtaacaataactaagtgtcttgattaaacaactaacataatagaacattgaatttaactaagagaaaatagaaaacaaaaaaatattacagtgtcaaagttctgttgggttagttccttttgcatacatcatatgatccatccacaaatatacatcgagcagggccctatttgattacatgggctaatgtttagccctcaccttttagtctcaaattagccctcaagaatccaaacaggtgggctaattttgagctaattcaaggctaaaaggtgaagagagagtagaaagagagccaaacataacaccctaagctaatgtttagcctaccaattcatgactaaatattagctctcaaaattagccctatgctaatcttccaaacaggacccagctgtagatgcatactacctgtaaatgcaataatgcttcggggaccattaatataattggtatgcgatttatgtggtgctgcagggtggctgttgtttggtggcaggttctattcaattacaaacactatattcatcaatgcacatataacaatatttggtgtaatacacctgccaagtttagaagttttgtgtaatgcgaagatttggctcatacattagagcaagtttaatagtatagcccactactagctctaattcatctatagccaatttaatagccaatttatacaatagttgcttactatactattaatatatggtctcacctggcatacacacattgtggcttatagtccgtgttgcagctggctatagatctgtagcccgctgctcttctcttttctcttttatctcattaaaatatattggcttatagccggctattgtacctgctcttatgcatgctgaaactttacaagttacagttacgcggatttttcaccaagattcacaaatagacttcaataattgttttctccttatgtgttggctttattatttcagttcttattgttgctagagtatttgctctctgagagaactttgtaataaatggttgtaacttctttgtagcaaaggcccggatttttattctattatcttaaaaaaaaaacctacgaaggctcaggagagcaagagagaggcggcctagagctacagtaaaaacaccaataccaatagagatagattctaatagctcgagtggacgtccacccgtttattgcatgtcaactaaatggtaatgaaaaattttcaaaaaaattgacaagatagatcaatatgtatatatcactccagaaacatgcaagttcaaattaacttctataagttgtaataaaaataataaatttaactgtatatttacatatattaatttgagtcttgtttgttatttttgttataatttgtagaagttgaattttaacttggcatgtttgtggtgtgatatattacatattgttcatatttttttcatttttttataaccatgtagatgacatgtaataaacatgtggatatccactcgagctgttaaaacagtttccccaatacgaaggagaacccttcttacctccccgatttcagccggctcttgtcatccatgcacacgcaacatgattttttttagatatatcggatgtcatccgccttctctggaattaatttgtcagcattctaaatataggatcccaatagatagttacctcagcaaaatcactatatagttcgacctatacggaaataaacatcatacgtatatatatgcataaggttgggagcagataaaggagtccgttgataaggatatataggaggtctagtactatttaatctcacctagaactgctcaaatcatatcttaggttgagcacgtactttcactccgcactatggcaaattgaaataagtttcgctttacactaggggttataatcagctctaaacgaaacaacgatgggagcaagtataatgcagatagatgcgtactaaactgcatcatatgatgtaccacctactgacctagctacaatggtgtaccttgagtgagtgaggccctatttagttcgcgaaaagaaaattttgtgtgttacatcggatgttcgaccagatgtcggaaaggttttcggacacgaatgaaaaaactaattttatgactcacctggaaaccgcaagacaaatattttgagcctaattaatccgtcattagcatatgagggttactgtagcgcttatgtgatgaggacatcctccactattacatgctggtaaagacgcaaaagttgggcgatgaccgtgtgagcttctgaataatcccaccttacttagctagggaggaggaagccaccttaaaagggagagctacccttctcctatcgaactagtcttttaggtagattgggcctttccccgagtgggtgtgcctaagaactgttggagtccggacaaccttaatttgttgggcctcggccaactctacctgggcctgttagggtccgagcaaccttaatttgttgggcctcgaccaactccacctgggtcggattgttatcattatggctaatcatggacttaggtgcaaaagattcatctcacgatttccccccaactgtgcaattagttttttaatttatatttaatgctccatgcacgtgtctaaagattagatgtgatgtttttgggaaaaaaatttgggaaactaaaccaggccttagtttccaaacaaaacttttcaccctgccacatcgaatgtttggacacatgcatggagtattaaatattaaaaaaaactaattatacagattgcatgtaaattctgagatgaatcttttaaacctaattgctccatgatttgataatatggtgctacagtaaacatttgctaatgataaattaattagatttaataaattcgtctcgcagtttataggcggaatttataatttgttttattattaatctacgtttaatacttcaaatgtatatctatatatccgatatgacatgtcaaaccttttcgtctcgcgaactacaaggcctgaaattgcaacacatggggtgtaccaggaccaggaggagagtcaccaccgcacatgcagtagttgggttggcttggagatttggtcgtggtggtccggtaacaatggtgatgtatagcctggcggagcaaggccatcaggaccgccttcctttagtgctctactacagcttttgtttggctaactaactatagccaaacttcataggctgtgttcgtttgcagtagttggaactcctttcttatgcaagcaaaacgaaacattggattaatacataattaattaaatatttatttttaataaagattaatataatttttaaagcaactttcttttttttaaaaaaaaagatgatttagtagcttaggaaagatacatacagaaaatgaaaaaggtgaagttgggaacttgcactagagaacacaaaccttaaaggagtattgtagtattcctactgtgacaatgaactgtacaatagacccatcaacattcaacaaattaattgggagaatgctatgaaggtgtgtgagcgtgccgtgtagccgtgtagatggcaccgttgctttcaggagagggaaggtagtccgggagcatacatgtggtttagaacgctgggaaagggaccgaaggagggaagacgatttttttttgacgcaaaaggcagagagactctaccttgttaccattgtattaatggtggtcatataagtaacaaagccagtggctggcaagagattataagggggaacaaagaggaaggataaagaaaacgaaagataaaaaagaaggaaggaagaagaaaatgaagaagaaagaacaaaacacaaaaataaaaaggaaacctagcttagcttgtctgcccaagtgttgatgtgttcgcgaaggctgggctttaggcgatgaacccataattggagactttctctgatttgatgtaggatgtatgcaacgcttgtttcagtgagcttgaagatcagctcgttgcgtgcttttcagagaccgtgcgaacaagcagcaaagcatgcaggccatcccggtttctggtgttctggcaaggtgtccaggattgattccacaaagagggaagacgatcgagcctagagattttcttgtttcaggcactgaacagtgagtacaacatcaacgatcgctgctgggaagagggctgacgccgagcaagggacgtgtcgtggcgacagctgcttcaacatcctgataatttggtactccgttccactcccttcaaaccttggaaaatagggtaaggctaaggaatctcacggtgaggagctgtggtgctctgaaagggctgcctgatggaatggattgtcgatttttatggctgcagtgaccagctgcaaagatgtttcagagaaggtggtgagtattttgacttgctattcactgtttgagagaagcaaatggtttcacgggtaaatttgacccataccattataaatttactattttagaaaaatattgttacaatttgtgaaaccgactagatgccacaaaaatttcgtaaaattctaataatgccgctgttgtccatttttcaatcatgttcttttcttcctctccccgatgaccacacggaggttggccggcgagctccgggaggcttgtccggtgtgccagggccatcaactgggtggcaggcggtcggcgtggaggggcaatgaggagcactggcaaggtggcatcggccccgcccaaacacaacgcaggcaagttatgatagaccattgaatatatccaaattggatgatgacctgtattccaagcgtgatggatgctggttcaatgtaggggacaagcaacatccgcaactctgtagatggcttaagatcgctgaaggcatcgacagtgagctttgatcgtgccacaacaaagagcgcgccctcagtattgctgtcaatcttagacctaccattaccatcttacactgagacaacctaccaagaggtagaaggccacgagggccttagccatatggtcttgtttggatcatccggactattaaatagccctccagaatcttgctatttaggagtattaaacgtagattactgataaaattcatttcataacccctgggttatttttgtgagacgaatctaacaagatatattaatctatgatttgctacaataatcatccgctaaacatgggttagtatacctcgttatattcgtctcgcaaaatagccaggggttatggaattgattttgtcagtaatatacgtttaatacctcagaggatcctccttttgagcgttcctaactcgaaaatcgcgtacacgaacacgataggggtatggcctctgttggtcaggggagagagccagagtcgttgcctcggcgtgtcccgtggggcgttacaaaacaggactccatctcgttcaacctcttcttctatctttgacagcgcgcagccttgcccatgagaaaatgttggctggaatgtactaaacttttcgggctagctcctttggcaaagatccacacataaatatatatcgacaagctacatatatcaattaaatgcattaatgcttgggggacctagcttgtattgctgctgcagagtaccattactgaaaacagcagacacaccataattatattgtatgggatgccattcgcctgttttgtggcaggattaatttaattacaaacactactctggtgtttgtaatttaatttacatgcaacatgatctagtgtaggcatatcggatatcatttcttttctctagaattaatgcttgtgtctggattgcatatttatcaagcatatacttcccccgtgtcaaattatttattgttcataattcctgagtcaaattaaatgtttcaatctttgaccatcagtttctatacacttaaattctctattatcataagatttatattttcagattcacattgagaaatacttacatagtatatataataattcgtatgtttaagacggttaaagaaaaaaaataatgattaaagatagacatgcttaacttaggacaaacatgacaaataatttgaatcgaaggaagcatgtaaatttagattataagcatggatatatccatcttgcagttccatgctcttggagaagaacaagggaaagccctctccatacaagcttagatgattagcacgatgttaacggtcgttaagtataaactttaaccgtcaactcatatataaaagaactaaaatattacatcaaaatttagtgagtgggagtgggaggtagtggcggaggaagcacaatgtggtggtgcccgccgtagccatggcggtgaggaggcgggggtggggacggctcgaggatgaccaagaatagggcagctgataccgacgacaacacccctagtacgtcgacgagctcggcagcgccacgacacccatcctgccaccgtcacgtctccatcaagcaaccagctcggtgacaatggagaatagagaggtaagcggggccgaagaggccatcgacatcggcaatgacctcgctgctccctcaccagcctccatactgccgtaggatttcttttacaccggatttataagttgggggttaagatttctggtgcgatttaaggatgaggtttaaactcggtggaaagatgaggcctcaaaattccaacagaaagtgacggagagggaaggagaaggcttgggccaagccgaagagaggaggatgaggcccaacgtgaacagttcagttctataatttccaatgttttcaggctccattagctcatctcacgcggcctttgctggccgcttactcgcatccggcatcccatcgatcggcgcgtgccggcggcagcggcgatggcgacggtgagcgagcacacgacatggagcccctcctcatccctcgctcatgtcacgccctctccctagcctcttatgacctgttcactttaatgccaaaaaaaaccttgccaaaattttgacatagttaccaaaattttaaaaacttactaaaattttgactaaaatttggtaaggttgaaaatgacatcaaagtgaacagacccttactctccctcatcatcatcgccccgctcctgtgggacttcaggcgcgccgcgttcgtgcacgcaaggtgcttgtagaaatgcctcaactacagacttgcttgcacttgcagcattctgcgtcgtcttgtctgtaggtcgatgatttcgtgtcaatctggcggccaaatcttggtattgattttgcggggggaatcgacgtgatatatattcattgaagcttttcactctcttcttttgatttttccggtgcaaataagtactgtaaaagacaacttttacggtgatctagcatttcctcctaaaaacaagtgcgcctagctagctgattaggagtacactagtacttgcttatcatcatcagtaggaatttcggagcaagacaaggcatcgccgtgtccattcaaccaagcgtgctttactgctttccattcttttatactccctccgtttcgaaatatttgacaccgttgactttttagcacatgtttacagcggcgtatctaggatttatgatataggtggtccgacttaacaaaaataaacactataaatgtgaaaaaaatgtaatgatggtaatatatataatacaaatacaaaataataaaataaaccaaaagtgtaccatgttatatatattaataagacatcttaaaacatatataaattagcaattaattagtaaaattcagacttaaacaagtttatatggctagaaaagtttgaagaaaattaccatactactactttttataaggtctacttctaacagtggccatgaaagtgtccattatattttcttcattcactttgaagaaaaacatcccgcttaatgaatgaaaacatcctgcaatatcttcatcttttttatgcaatctacaatacaataatacaatttagtatcaaattcacaagttttaaaagttaaatatgaaaattgaagaaaaaacaacacaagttcaagacctaaaatcctaaatacctgccacacccacacggcatcacagccacatgcctgccgcctgcacgctgctggagttctggagtctggacgccgaacagaaaaagaaatcgctgatcccggcggccggcgccgacgaaccggccatgacacacgcggcatgccactgaacagaagcgctgaaggctgattcgccgaagcggcgagccggcgtccggcgatgacggtcgacgatcaggtcatcaaaaatcgaatgagtgagtcgagaggacagagcagtcgcgccatcgcggtcatggcgcggagggcagagacgccgttgcggagtcgcggactcgatctctatctcgctcgatcagcgctcgcggtcatgctcctgcccaccaatcttgcggcggaaaacaaggcgtgattgttttgatcgctagaaggaagacggctcgtcgctcgagtcttgacgctggcgcttcggtctgatctggtatcgtacaagttttttcttttcttttttttaaagaaacttatactacctagttgcgccgcaatttttttgggaccacccggaccaccctacagatccgccggtgcatgtttgaccgttcgtcttattcaaaaacttcttgtaaaatatgtaaaattatatgcctacataaaaatatatttaacaatgaatcaaatgataggaaaagaattaataattacttaaatttcttgaataagacgaacggtcaaacatttcgaaacggagggagtatataacaacagtagtaaagcgtgcttagccaggctagctggacggccaaaaataattttgccaaaataatactatcaccttgactttgccttgacttacattacgattcagatcatcgatcactcgtcctcttattcgctactaatttccttcgcacatccagcaatcagatatcctgagatagacagagacagcacagaagtaaagaaggcccgttgtcactgtcagctagtgcgagctgagtagtggtagaagcatggcagaatcgctgctcctcccggtggtgcgcggggtggtcggcaaggcggccggcgcgctcgtccagagcgtcactcgcatgtgcggcgtcgacggcgatcgccacaagctggagcgccagcttctggccgtccagtgcaagctgtccgacgccgaggcgaagagcgagaccagccccgccgtgaagaggtggatgaaggacctcaaggccgtcgcgtacgaggccgacgacgtcctcgacgacttccactacgaggcactgcgccgcgacgcccagatcggcgactccaccaccgacaaggtactcggctacttcacgccgcacagccccctcctgttccgtgttgccatgagcaagaagctgaacagtgtcctcaagaagatcaacgagctggttgaagagatgaacaagtttggcctagtggagcgtgcagatcaggcaacagtacatgtgatccatcctcagacgcactccggcctcgatagcttgatggagatcgttggcagagacgacgacaaggagatggtggtgaatttgttacttgagcagcgatccaagcggatggttgaggtgctatcaatcgtagggatggggggattgggcaagaccacacttgcgaagatggtgtacaacgacacaagggttcaacaacgctttgagttgcccatgtggctctgtgtctcagatgatttcaatgttgtttctctagtcagatccattattgaattggctaccaggggaaattgcaccttgccagacagaatcgaactattgcgcagccgtctacatgaggtggtaggccgcaaaaggtatctacttgttcttgatgatgtttggaatgaggaggaacataaatgggaggagctgaggccattgctgcattctgctggtgctccaggaagtgtagtacttgtcacaactcggagccagcgggtagcatccataatgggcacagttcctgctcacacgctatcatacctaaaccatgatgattcatgggaattattccggaagaaagcattcagtaaagaagaggagcagcagccagagtttgcagagattggcaatcgtattgtcaagaagtgcaaagggttacctcttgctctgaagacaatgggaggccttatgagttccaagaagcgaatccaggaatgggaagctattgcaggaagcaagagttgggaggatgttgggactacaaatgagatcctatccatactaaaactgagctataggcacttaccacttgaaatgaagcaatgttttgccttttgcgcaatcttcccaaaggactaccagatggagagggacaagttggtccagctctggatagcgaataatttcatccaagaggaggggatgatggatttggaagagagaggacagtttgttttcaatgagctagtgtggaggtccttcttccaagatgtaaaggtagaaagttttcatgtcgggattaaacagacttacaagtcaattacatgctacatgcatgatctaatgcatgatctagcaaaatctgtcacagaggaatgtgttgatgcgcaagacctgaaccagcaaaaagcctcgatgaaagatgtccgccatctgatgtcaagtgccaagttgcaagagaacagtgaattatttaaacatgtgggacctcttcacacattattgtcaccatattggtcaaaatcatcaccactacccagaaatatcaagagattaaacttgacgtctttacgagcattgcataatgataaattgaatgtttctccaaaggcattagcaagtataacacacttacgataccttgatctttctcattctagtaagctagaacatttacctgattcaatatgtatgttatacagcttgcaagctttgaggttaaatggttgcttgaaacttcagcatttaccagagggtatgagatttatgagcaagctcaggcacctttatcttattggttgtcatagcttgaaacgcatgccaccaagaattggtcagctaaagaacctccggactcttaccacatttgttgtggataccaaagatggatgtgggcttgaagaactgaaagacttgcatcatctaggtggccgactagaactgtttaatctgaaagctatacaaagtgggtcaaatgcaagagaagccaatctccatatccaagaaaatgtaactgagttgttgttgcactggtgtcatgatatattcgagtacagtgaccatgactttgatctcgatgttgttgacaacaaaaaggagatcgtagagttctctttacctcctagcagacttgaaacattgcaggtatggggctctggtcatattgaaatgtcatcatggatgaaaaaccccgcaattttcctatgcctaaaagaactccacatgtctgagtgctggagatgtaaggatctaccaccgttatggcagtctgtctctcttgagtccctgtctttatcccgtttggataatttgaccacattatctagtggcattgacatggctgttccaggatgcaatggttccctggaaatttttccaaagctgaagaagatgcatttacattacttacctaacttggagaaatggatggacaatgaagtaacatcggtgatgttccctgagctcaaagaattaaaaatttacaattgtccaaagctagtgaatattccaaaagctcctatcctacgagagctggatatattccagtgcagaattgcactgaactcactcagccatcttgcagcactttcccaactcaactatgttggtgactggagtgtttctaaggatttgcaggtaataccaatacgctcctggccatctcttgtgacattagcgctagcctctttagggaactcgcttctcccagatgagcagcagacgaccatgccccctctggaatcaattcagaagctgagcatttggtattctagttgtttcttctcacctaattcgtcaaactggccctttggtttctgggattgctttgcatttgtggaagaattgtcgatagtattatgcgacgatcttgtccattggcctgtgaaggagctctgtggcttgaattcccttcgttgtgtaagatttagttattgcaagaatctgaccagttcatcatcagaagaatccttattcccgtctggtctggaaaagttgtacatagaattttgcaataacttattagagattcccaagctccctgcttcactggagacactacgcattaatgaatgcacttctttggtgtctctgccaccaaatcttgcaagacttgccaagttgagagatctcacattattttcttgctcaagtctgagaaatttgcctgatgttatggatggcctcactggtcttcaggaactatgtgttcggcagtgccctggggtagagacactgccacagagtcttcttcagcgactgccaaacctcaggaagctaatgacactaggaagccacaagttagataagcgatgcagaagaggaggggagtactgggagtatgtctctaatattccatgtctgaacagagacttcatagaagaaagaccctgttaaggggtttgcaaagaaattcctgccttgctgctcaactctcaactaaggtctgcctacatgcactgcctcttctctttttttccccttctcctccttggattatgtaagagtgattttacagtcattgaggagataccatatttttctagtgtaaaatatggtacctctcaaggaccgtgaatttactcattatgtaaatgtaatgtttgtgttcctctgaatctgaatctgtgataggtggatagcagtgaacaacccacacatgatgcgcaatccaagggctatcagtccctcacctttgaacctagatcagtagtgctaaatgttaaccattgcttgctcaaccaataaaaatggtaaagatcacagattgcagtcaatgaatccatatgccatctgaagattgagctagacatcaccactaccaaacactgcatttgcttcgaatttagacatagaatttatttttttttagataatggattaaaaccctgcctctacatcccacaggatatacacaaccctaaagatttttttttagagaagggtattttttaccggcctctgcatccaaccggaaccggatatatataccggcctctacatccaaccggaaccggatatatacggccattgaaatagggaacttaaccccgcaaacaacctaatctgaaattcgctcctatggagctttgaactcaggatcttggggtactactcaggtcactgtaaccactagactacgtgccctttcgta

SEQ ID NO: 37507 - DNA, 2194 bp, Oryza sativa
gtcctgaaaacagcaaagggtctataacgtaaaccagcaaacaagtaaacatggtaaaaccgctcaaaccagacaccctaaaatcttttagaaatcctcctaatcctctcattctcacgtcatatgcaaaccttaaacataaatacagaacgagtctccttaataccatcggatgcaacccttccaatcttttgacaacaacaacaaagtcgcgtccaaaccctacaaatcgcgaccaaatcctagaaaccactgcaggaaagtaaatggcatccaaaccctaggaaccgcgaacttgtaatacgacaaagaagcagcaggagcagaggtgggaggaggaggaggaggtaccaacggtgagaaatcctctccgcctcttcaccgagcgtctcaatgagcttccgccagggctcgtgccgcgacccttagttcaccccgggaaccctcggaccaccgcaggtttccgctcgcatgccgcgggtgccggagagcaccactgccccgtacggaagccatcggcgtcggcggatccagcgcggcggcagacgaacccaacattgaagccactaggccgtccttccccggcggccggcaaggccaatccggcggagaagtccgggcaggcaaggggatggggatggggatggagacggggacttggaacgagaagaccatatactaggagggggtttctcgcaaaaagtcgtggacaagtgttgaattttccgaatatcttaaccgtctggatcagatcggacggcccttatccttcagaagtttgcaaaaagttcagggtttcagactcttaagaagttcagatttttctaagattttagggtgtctggtttctataatcttcagagtcttctcctgtcatcgacatcgctatcgcagtgtacttctgatttctgaaccaccacggcgatctacccgattgcaagctcatcgatgtcgatttcattcatcgaaaccaggtgcatgctgggctgtaattaagccgatatgcagttggtgattgaatatgcagttatcatgtcatgcataatttgttgattctgagccattccttggtgagttctccttctgtgggttgttgcgtgttacgatgacggttgcaaatcgtgttgtactgcaaatggggcgttgaaattcttgttattattggctattcataaagcctgagatcatagagtgcatggtttttctttttcttttacaacaaagtagacaataccccatttaagtagtctacatcaagatagaacatggtatctctgtgacgggactaatcagaaggaacaaaaatctagtgcaatcagctgaaaatcctggtaagtactaatatgacaacccacaaagaaactaagatttgaatgtacaatgcaaaaaaaaaaaaagtcaactatcaacatgctcgatcaattcaaatgaacaattgaagactgtgacagccaaaaatataagcttaattgcctctttgctttctttcgcgcatcgagcaatcaaagagcctgagagaaaaagcgagagaagttgcagctaattagtgagcagcatagagccatggcggaatcgctaatcctccccatggtgcgcggggtggcggcgaaggccgccgatgcactcgtacagagagtcaccggcgcgtgcggcgccgtcgacgacgaccgccgcaagctgcaacgccagctgctggccgtccagcgcgcgctggccgacgccgaggcgaagagcgagaccaacctcgccgtcaggcgctggatgaaggacctcaacgccgccgcctacgaggccgacgacgtcctcgacgacttccgctacgaggcgctgcgccgcgacggcgacgccaccgccggcaaggtactcggctacttcaccccgcacaacccactcctgttccgcgtaaccatgagcaagaagctgagcaatgtcctcgagaagatgaacaagctggttgacaagatgaacgagcttggcttgtcagtggatcgcacagaatcaccacaagaactgaaacctccttatctccagatgcattctgctgcactggatgaatcaagtgacattgttggcagagacgacgacaaggaggtggtggttaagctgttgctggatcagcgatatgagcagagattgcaggttctccctgtcatcgggatcgggggttcaggcaagacgacgctcgccaagatgg

SEQ ID NO: 37508 - DNA, 2939 bp, Oryza sativa
gttagttcttgacgatgtatggaacgaggatgagaacaagtggaaggatgaactaaggccactcctgtgctctgctgctggtggtcatggaagtgttgtagtggtcacaactcggagccaacaagtagcatctatcatgggcaccatgagatcccatgaactagcatgtctgaatgatgatgattcatgggaattgttctcaaagaaagcattcagtgaagaagtacgagagacagcagaattggtcaccattggaagacttattgtcaagaaatgcaaggggcttcctcttgctctcaatgctatgggtggcctgatgagctcaaagcaacaactccatgaatggaaagccatcgcagacagtgccagagacaaagatgaaatactttccatgcttaaattaagctacagacacttaccatccgaaatgaagcaatgttttgccttctgttccatattcccaaggaaccatgagatggacaaggaagtcttgatccaactgtggatggcaaatggtttcatccaagaagatggaataatggatttggaacaaaaaggagaatacaccttccaatatttggtttggagatccttcctccaagatgtcaaagcaaagaaaactctggaccatttggcagagctccagccgtcgaccattctacaaaaggaaattatggacaaggcattaccatatgagtccattggttgcaaaatgcacgatttgatgcatgacctagcaaaagacgtggcagacgaatgtgtaacttcagaacatgtacttcagcacgatgcatctgtcagaaatgtccgtcacatgaatatatctagcacttttggtatgcaagaaactatggaaatgttacaagtaacatcatctctccgtacttggatagtgccatcacccttgtgcagggatctcaaggatttaagcctggcatcattaagaacccttgtaattgaaaagggaatcttccattaccattcggttatgtctaaccatgtgatcacttattcgaagcatctacgatatcttgacctatctatgtctcaaattgttatgttgccaagttcaatatgtgtgatgtataacttacaaacattgagactcaatggttgcagctttctaaaatatttaccggaaagtatgggaaaaatgaggaagctcctccatctttatcttctgggatgtgatagtttggtgcggatgccaccaaactttggtcttttgaacaatcttcgcactctaacaacatttgttttggacactaaagctggttgtggaattgacgagctcaagaacttgcgtcacattgccaacaggttggaactgtacaatttgagaaaaattaattgcaggaacaatggaatagaagccaatctccatcagaaggaaaatctaagtgaactactattgcactggggtcgtgataaaatttacacaccggaaaacagtgcctacaatgaggaagaagtgttggagtcacttacacctcatggtaagctcaaaattttagagctgcatggatatagtggcctgaagatcccacaatggatgagagacccacagatgttgcagtgcctaacaactctccgcatttccaactgtttaggatgcaaggatctatcaacactgtggttatcggtctcgcttgagcatctgcagttatcccgtatggataatctaaccacattgtgtaagaacgttggtgtgggagctgaaggatacaccatccctcagcaagttttcccaaagttaaagtctctgaaactagagttgttatttagcttggagaaatgggcagaaaatactgcaggtgaggctaagaatttggttacatttccagagctcgaaatgctacagatcattcgctgtagtaaacttgcaagtgtcccagactgtccggttctaaaagaactggacagatttggatcttatatgcttgcaatgaacgaactcacacatctgacatcattgtccaagctcaattacgttgcaaacagtctttgtgattgtgtgagcatgcctttgggctcatggccatctctcgtagaactagttcttagatcttcaacacacattccaaccactctgcaggtggaggcaaatcaaggccagctagaataccttcggagtttgagtctagtaaactgcttcacggctgcatccggctcatccgaaatgcgtcttgggctctggaaatgctttgcctttgtggaggtattgcatattcatatgtgcctcagtcttgtgtgctggccaactgaggagttgacgagcttgattcaccttcgacacctatatattgagcactgtcatagacttgagggaaaaggttcatcatccgaggaaaaattcatgtcactgtcccatctagagaggttacacatacaacactgctacaatctactggagatcccaatgctgcctgcatccctgcaggatctgcggttagaatcttgccgaagattggtggcattgccttcgaaccttggaaatctggccatgttaaggcatctttatttgatgaactgctatgtcctgaaagatcttcctgatgggatggatggcctcgtttcccttaaaattttggagattcaggcatgtgcagagatagaggaattcccacagggtctcctccagcgacttccaacactgaaagaactgtccatacaagggtgccctggattggaaacacggtgcagagaaggtggtgagtattttgatcttgtctcttccgttcaacgtatatgcattccagcagcagcgaaaacagaaatggaggaggaatcaaggtctggaatctaacctgaagaagcttgtaaaaaggctcatcccctcctgctgactctcaaatgaggtgcatacgctttgctcttccattatctcactcttgtcaccatgcaaaggtccagaattgtttccatgcttcttcttccat

SEQ ID NO: 37509 - DNA, 8188 bp, Oryza sativa
  unsure (1)..(8188): unsure at all n locations
ttcccttgcaatgcattgaagaatttgatcaaaactggaacttttttttttggaaatttaaactggaacaatattgacacgccgtgcacaatcgacagcgaaaggttggtatagagattcaacgttaggtgcagatgatataggaagtggcagcacaagaaggcaggcatgcccacctgctgcaaccagaggcaccaaggagctgcagttagatggtaagcagaacagctgaggaagccgtgtatctttcttttgccggcaatttcattgtcagatcagatgttagacaaccccctttcttaatactacaaagatgtgcaagtcttttgcgtgttccctaaaagcagctaagatgaaggctgtgattggcagcaatgtctctccttataataacagtggccatgccagctaggccatattgatgaagggtgtgagaagagcagatgggaaggatgaacaaaggccatgattttcaaaaccaggcgaagaagtgaacatgccagttgatgtaaatttgtgagactgtttcctagcgttctgtcatgtttgtgctcctttctctattttttttaatgtaaaagtaggaaagcggctagtatttcattgaacggaaagaactcctttctttttcttaatgatataggagtaacaagcaaaattatctacataatcttaaaaaaaaacatacaagttggtaaccaattaaccatatgcgccagatttcaatcgtgaaattttatgtattgtataccttctagaaggtttttaacctgctgctaggtgttagtcaggattcagtaaagacaagtggagaacataggacaattgtgaattgtgtgtgcattttattcaccattgactactccagattttgcagagaccatagaatggttaaaaggaaacatgttgcattgagtaggatccattaaacttggtaccaggcaaacaagcagctagcgaattctaatcacatctcttcagcttctcccaccaatgaattcagaaacctgtacagaacaaaacataattccttttaatgtgtgggtggcaattggcaagtgccaaagcacaacaaaataaatcgattattttttattgttgactcaaaatcaccagaagtttcactttcatatttgtttgagataaaaaaaatatcgattataaaaaaaattgcaagcaaaaaaaaagagagagatcagagatcgaatcaaataaacattttcatctgtacggggctaatttttcagccgtggcctccgtgttagtcatggactctgaattgaacacaataaaattatctaggagggatagaaagtttgaaaccaacataaccaagtcatatgtggaaattccccgaaccgccaaattgagaaaaacctaaataaacccccaaatcctcgaatcaagttaagctctttctttcaactagacatttcacgcgcgttgcacgccctatcaccgtatcacacagtaggatagcgaaatagtagtttgttttaccgatatctatacatgactggacaatgcattacaattataaatcacttaacctaaaatacagatcacacattgcacatcataattcatcaattcaggtcagctgtcatcacactatcgaataggtacacgttgtttaattacatacaaatacccaacatatatcagtaatctggaagtgtcacatttatatctccatagtccatttccgtcaaaagttcaaccaccaaacaatctgcacacacagaaaaggcatttgttagataacgaagtatcttcatacactgtaggaataaggacattttgtgctagaaccattttagcccatgtatgtatatatccaagagggcattgacaggaactgcaataccaaactcaaaggatgacgtgtcagatttgctagcctgatgtgcattgattatcatacatgcatgccgaccaatgcactaaacaatatatttttctcaaatgtgaagtttgagacaccccccaaaaaaaaaatctaagcaatttacgacacaaatctaaaacaaaaattacaaataaacagagtgaaactaatgactggatgcatacctgattttggttccacctgaaacagcacaaaagtaatcataatagagtgaaaaaaaatatgaccgtcaatctgaagaccatgtgtacaatgcataatttattgatgttcggtagatttgctcaggatacacaaagaaaatctcacctagtcacatgccaactatcgtaaattaacctcaattcacattgtttacatttcattgaagagcagaactataatattcgtagcaaacatagcagatgatctactcaccaaatcaacaccgtgaaaaaaaaggcatagctaaatatacctgaaacagctatttccataggaaaactaccattgaaacaatactaaatacaaaaggcaaaaaaatctagttgaagttcaatcacggaaagcttttacctatcatacttccacagctccactatacagttttgaatggtgttactgcccaatttccttcctgttccttctacctgacattcagttggataaaaaaactggcagctaacagcagtacaaagggaccaccgagtacctgctctgcttgatacatcagccaaactaccaaaaacatattattttcagacacacaaacatgaaaataaactgggaagttagtacagacaaaatgctgaggggacttagtttcagagatgggtatacctatgttgattcttagtagcatttagcaattttacagcctactcagctgatgctctgcacagacatgtaattcatagccagtttaatactttaattatgacaattgccaataactgaactacattcagattcaatcggagtatggatgatcaatcaaacaaatatatgacagcaaagtatgtttttgcacgttgagcaaaaacacaataaaaattacatgtataagagctaaaatatcgaatttagaatcacttaaagcaaaagnccttttcttttcccccttttttctttaaaaagaaaaaacccccccctttttttttaccttgattgacagcacacatatagcacaaccgatcaggataaggagccaagaacacaatttttgaaccaaaataatccaaagttagcatccaaattttccatgcccaaataatggatatcaataggccatgcatgggtagttgaaaaattttaagatagtttcagactctgtgctaataggaaaaatagcaaaacaccttaaaggcaaggcaaccaactcacaagcatattctccgtgctcatccaaaggtggccttcgtaaaataatagtagaaatcatatgtttactacttctatgcatactgtctgcaatatacccccaaagcgctgaagcaccttctaatatgtttgagctgaaaacagtcttcaccgttaatccacccatttgatctccaagaagtaagaactactaaatgttctgtgcagagataaatcaatagattattacttgtttggtgaattaatgttgcaacacacagcatggcagtggaagaaaacgcccatgcgagtatgcgacaatgttgtttcccggccaagggccaaccgtgcggttcccaccgatgaattaggcctccatgatttccagtatgtgacccaaatcggttaaattaaaacctgccctgaattggttggtgagttgagagctattcgggggtggcgtgttcgcatgcggagctatccacgtcgcccgcgagcgcgtctccttccgcgtccgcgcaagccgctggctggcgtgccgtccgattggcttgagcgtacggctaggatgaagcaggtggatttttgcagaaaggaccttttcttagtagataatacttttaggtccctcaccaaacggttttacgttccgagttcttaagttaaggcccgcgctctgaaaaactaagtaaaagggtcttttttgaatgaaaaaaaaagagcatacccaatccgcaattgattaaagcggttgctttggagttgccggaaaatttggatcctttagagtagtagtagtagtagtaatattcatgtaatgtttgtgacttcttccatgctctgatctttgcattcttttttttttccgtgcagtaaatcaatctctctggttcctgaagatgaacagcatcaggaggttttctgggatgcgcaagcctaacgccccatctgcaatacataaagacaaagacgagagcgtagttttcttcagggagatgtacaagcgtgaaaaagatagggacatcaacctcctggaacccatgcaatccgttgagtttgatgctatccaaggtgacatcttcggctcttgcgtttctatttttcctatatgtgtcgtcagaaatgttatggacatattcacaatctcttgattagcaatatgaacatttgattagcaatatgaaaatttgcagttgaaaatcccactcaaattgcttcaaagatggatgacctcactgcagtgtttgtgttcttttgaatttgtatctgtgataggtggccgcacgagcaaagctccgtcagggaagacagatttcctcatagcagtggacgagaagcatgactacgactggtaggatggaattcaattcatccagatgactagatcatatacttgtgttgttggaactgtttttttagaagaacagcttgtttcaggctgaagacgcctccagctacaccactgtttccttccatagagatggaaaccaactcatctcaaatggttttccagaaggagctaccaattcatcagcaagttaaaccttcagcttccagggtatatactaatttgctccataaattatactgaatgattttctttttactgaatgctacagtttagagctcctaagtggattttctgctcaattgcaatctgcatttctagattgtctcttcatcagagagcttctcttgatcttgattttatcaattacagctatcaggaaagacagaggcaacgaaaacatcggcaagatcaatgtttcctgcacctaactcttcatcagagaagagcatattcagagtgtccacacaatccatctccaatgagaagaaccaaattgaaaggagatcaacttctgcagccataacgagcggaacaaaggtagttgctgcaattacacctacagctcctaccgcaacttgcaatgcaaccaagaaacactctgaaagatgctatgcaagccaaggtagcagtacaaatggactcaagagagtgacgaaccctgagctcccctactgtgcaccgaagaatctgatcacaacgccattgacagcgaaagcatggcgtagtgatctagcatttggtgtgcatgacacagcagaaattggcaggataagaaggcagtcatgcctaccagttactgtcatggatggcaagcagaaaggcttacctgataaggtgaaggctgtgactgtcagcaataaccgtggtcgtgcaggcgatgccacattgatcaagggaatgagaagaacagacgggaagaaagagcagaggccaaagcatggaaatcaagcgaagtgagcttgtcatttggtataattttgtgaaaccaataattttatgagacattttcctggcgttttctcgtgtttgtactcctttttttttcatgtaacgcacaagactatttgcacatctggtgtagatgtggtttcaactctgaaattgcatgccttccaagttgaaggcttttaaacagctgttgggtatcttggatttgtggagcagaattatcccgctgcaaatgatcattgatcagacacctcatttttcatctatatctacatattttgctaaattaactagcatccagatatcaaaagacatgttcacattgccagcaccactgctgtaccagtatacatgcatgtaccaggtaaaacttttctctgcagaatcttgcaccaaaacgaaccaacacatgttgtatctaactatagtatcaacggtaatcggcgttcatcggtttggaacctgaggcaagtatcagatttgcaagagggaacagggcaacaggctgccaccggcatggccactgccattaaacagcattggtaggattgagtggctttcctcgccccatggtaaatcctcttgtgccatctggcatacgaggaccagggggtggctttgaaggatgatcagcaagagcactgtgattcgatggaggagtgccaattggatgattggcatcccggctatggccatagtactgaccacgggcacgccctcttccaccacgtcctcttcctctttccgtgcctcatcccgcctttgtcatggtagccatcatcagcctatgaaatttatacatgtcgttataatatccacacttgattctggcgcacaataatggtgagcaggagaggatcatttaaagtacctgatgatcaagatgtgcttctgaaatctgggaagcatcctctgtttcgtagtcttgtggatggtcagttgtttcagggtcatcttcgtctgcagcatccacctcatctccacctcttcttccttgacccatggcttgtttctaatgacaattaatgaaaacaaatgtttaacgatttaagaatcttctattttacaaataaataaaataacatgcatagtaatgtaggaatgttaaatcttactaagctagtcaaacatgtttttctgggagctatatctgttgataaatgatgaaatgaccaaaaacaagcttacacctaatgtttacccatcagttaaatatagaagtaactaaatcaagaatgaacaaaccacccagtattgccgattaatgaaatataaatgttaatgactaagatctagtcaggaaacacaagtagtgcataaaggacaattgtgaatcgcaaatgcattttaaaaatcagtccatggttaagggagaacaagttgcattgtgtagggtccgttaaagtaccaggcaaccaagcagtgagcggactctaatcccatctctccagcttctcccactactgaattcagaaacctgtatacagaaaaacagagttcctttaaattgtgttgatggcaactaccaaagcacctcaaaataattcctagaaaaaaaaaacaaatggttagagaaatcaagaagacatactgccttttcagcatcttcaacagtttcatactccacaaaagcatgcacctgcaagtaaagccaaaaaaaatgagggacgaaatcaaggtactggtgttgaaacttgaaatgccttccaaaatagtatttcattgcttatccctcttttcaagtatgacatttcggacatggacaaggtcaccaacatgcaacttttgatcatcacttctatctatgaaatagtaagcaatgttttaaaaaacagtacatggtttcgtgtggtcaccccaccttgtagggcttatgtggtgtaatcggccacatatgcagcttacacggtacaaggttagggcacctgtaccttgtatgtatgcaaccttgtaagcagccttgtagaacttttttttaaaacactaaataagaatatatgaagctaccataatgtgaaactatcccatgagaaatctaatgctaacatctgcacatatcaatccaaacagtaaatgtattagtgatcaagtattaagaagttggaatacacattcttgtatggtgtcaaatatttattaacagagctagaacaagtatatgcaataactaataaactttccgtgttcctttagaagttagatataccatgatacattaccttattagcaaacaacatctcaatctttgatgctttgccagtagaagttccagcaccatcaatcccaccttgtggatagcaagtacgaattgatttcacactgcaatatagaacatcatgtgttcaacaccacatttggcatatatttgtgctcaaagacatgcattgatgcatacctcccaaaagctgagaaaatcttcataagatttggatagcggtgctcttcacgcaaattttcagcaacaacaatgcgtgactgagtacacatataacagaaaattcagttcccatacatatataatgaatagattttatttgattaattagattctgacctgaacttcttcagcatccgcctcagtaaagagcactcgacgtctaaccctttttccatcatctgaaacaacctgtatataagaagat

SEQ ID NO: 37510 - DNA, 13711 bp, Oryza sativa
taatgcatctttaattaaaatgaagggtgggctgtgtcaagtgtcaacaataggatgaacaggcatatcggaaagaaaaaaaaattaaaaagtcattaaggccctatttgattcagcttaggattattataaactggattattaggagtaaactgaaacaaacaagtagataattatgatttataagccagattagtataatctaataatctcctctggaggagcattttccaaattattggtggctaaagacccactacccttagatgcctccaataatctagagaaacaaatagctcacagcttattctatgtcagcttattataatccagcttatagtaatctgatttaataatatagattacaataatcttaagttaaaacaaacagggcctaaataagatgcttaccagctctgctgacgtccgcaatactgcagccaatgcggatctctcactaactaactcccggatcttcctaaaagatgcaactacagacattggcactggaaaacagaagacatgtcaatgccatcagaaaatatgagccaacaaatatcatgtgtaggaaagcatgtgctaaattcatgtacaccacttaatgatatgatgcaactcaaaagtatcaactgttgtttggtgaacagtagttatatcaagcaagtatatgcagattccaatagtggtacaacaaaaggtgcaaatatattagaatgcttcaacataatattcgcccatttctaaatgtgccagtagtctttttacagcagaacattgtcaaacatcaatgctggtgcaacagtcatgcataactgcagtaatatcaatgtgcatcaattcatacggaagaatgcattcccaggttaaagatatctatatcagtagaatacaattaaaaatagcctaattagcaatacgtagtgcagtagttcacaggaattttatcatcatatattgcatgacaaatttgaaattatcgctggcaccaaacatttaaagaaaaatatagacatgaaggtggacagcgatttttgtcgtaggtttgttaaggtataagtgagaataaccctaaaacattatggtggttctcatttcaaaaggaaaataggaaggtggaaagcacaatcaggcggtctatttgaaattgaacagttgactcaccaaatccctctggatctctaatcatgaatttcatcaaatgttctgttgtagccagattgacatcactgaagtaaaattccacctgtcaaggttttaaaatacaatcaaaccaagggtgtaccacttatataggtgcaaatcaagcatcccataacagcttgattgcactaataaacaacaaaaaaaggaattaatataagacgaagttaatatcatactttcaatgatcagagaaaaggtaaactaataagaaagtaaaaagatgcagaaggtaaacaatacaaaagaagagaattgatttctctctccatttctccccttcagaaagatgcaaagagaaacaatcataaaatagatggagagctgcactatttctatttcctaagttattatcctcaaaaaagaaaacagtataactcctcatggtactatgcatgcagcaattacgagcttcagcaagacgacatgatatggttttgtcgtttttacaccgtgtcgctaataaatcatactgaggcccatcatgtttgccaaacatcacaaacatgcatatcttgttattccatatttgctcgttggcaggcatgagacatgtcactcgacccaaaccccacacacacgtaaatgcagcagaccgcgccatgtggaaagacaacatgcacccttcccgccatccccaccctatctgatttgtatagactataaaccctatagtgttctccaagaaaagaagtgcagaattacagtgcattttctaaaaatagcaatctctaacagacattccctgttttactcgtcctagattccaccttagccccttactagtgcacacaggacaatcaaggtgccagtgatctgtgaagtaatattttttatcctcatagtttcagaaatacaagaataagcaaaataataggcaataaacagttttaaggaacaaatatctatagacatcatccctctagtgcatacatctgtaactaaagatcaaacttgcagacaaatcaacagaagtgtaaagtcacactaattccatcgtttcacttgcaatcactgggttaagctacacttcctacatgcctatttctactccatagacgacccaatctaacccttgcgttgatcaaaagatcaagctttatcggttgaaacttgagattccacaccaaaccaatcctcataatcagcaccaaacagcatggcaaaaggcagtaaacacatcatccatcaggtgggtgggggggagcgctacctgcttgacgacccgacgagccacatcctccgggatccctccttctcccaccgccccggccgccgcggcgtccccctcatcctccccgtagtgttgccagtgctggtggtgctggtggtggtggtgcggctggtagtgctgctggtggtggtggtaggccccacccccgcccccgcggtgctggcggcgagggttggcgtggtggtggtggtggtgggcgccggatcgaggggtgaactccggggcggcggcgttgaggcgggcggcggagggggcgggggcggaggcggatgaggcggatgaggaggaggtggtggagtccggggcgtcgtcctgcgccatggatggatggagagagagaggagcggccgcgagcgaagcgtgagaggagagagagagagagagaagaagggtttgcttggggggactctggagagaagaggagaagacggcaaaagggaagagagacaagaggagacgagtcgggtggtgacgtgtactctacccggagagcgagttgggcttcggcccaaaagcccaacatatcccagcctgttactgctgtaccagtactccccccccccctcacggtggtgtttgaatctcctatatatgaagataaaaattaaatgtttcacgccaagtgaggtaataataacgtgtaactaattgagttttaatgattacaaacttaaaaaatagattaatctgatattttacaacaattttcatatagaaagttttcgcacgaaacacaccgtttagcagtttgaaaaacgtgccacaagtatctaaattttcatccacgagtatctctatctcttctctactctctactgttaacaaattgaagatgtttttgccggtattttgatatgtcatctgtgtatgagttggttctaagttcgttcgcttttagaaatatacaatatacgtatttgagtcggtttttaagtttgttttagaaatgcatatccgtataagaaatctttttacaaaaactcgcatgctaacttgagatgaacaaactcctaactacagctcatgattttctaaaagtatatatatccaagtgaattctcacagtaaatttcaccttaactaaatcatataacaacagccttcactcgttgcaacgcacgatcattttttctagcaagctaatagtaatcggttgggggccatcacatcctaaaacacgtcagggagaacaaggattcctaacacccccggttgtgtctgttccccgcaatgtaccgatgtatggatgtagtttctctgaatgactcgtatacttcagacttcagagacgcaaccagtcacttggtcacacattgctgtgacctggtatgatgttttttttttctaaatatttcaatcctgcagaaagagacaataagaaaccttgtgaagttttggtatattgcagcaagcaatgcccttgctcatttcagtggctaattgtgaatgatttctctcagaatttttcactcttcttttgttgccagtattttcagtcccttgcaacaaagactgaccgccacagaaaaagttcagaacataaacttcacttgtttttatcagagggaacaacaacattctcaagagaacactaccaaaaaaaaatgaattcagaaaattcagacattctcttctcagcagaaggcacgatgtacaattacaaaaaggatagtggagcagcgtagagaactaattatccaagtcgccgatccttgaaggtgattgcgcagcggagagcgatcgaggagaacctagggccttgggggttcggagttttcttctccgacccctcccacaaacaaaaacaaactgttgaatcaaaacatatgtccaagatccaacatttctcgatccttctttattgccggcactcgaccgacctcaccgccgttgtcctctacgacgtacggcgacatggccatgatcagctgctgaaattctaaagtactccctccgtacttaaaaatcgaatctaagactggatgtgatatattctagtacaacgactctggacaaatatatgttgagaggaaggaatcttttacaacctgcatttaaatcccttgcactaagggcctgtttagatctcattctaaaattttacaccatgtcacatcgaacgtttgaacacatgtataaagtattaaatacatgctaaaaaaataactagtttcacatattgcgactacttcgcgagatgaatcttttaagtctaattgctccatgatttaacaatgtggtgctacaataaatatgtgttaatgacagactaattagacaataaattcgtctcacggtttactgacggatattgtaattagtttttttgttagtgcccgaacaccccatacgacactctatataatatccgatgtgacagaccaaaactttgcactcctgaatctaaacacccctaagaggaaagccctgaactgaagtttttatttgcctgctttcagtttctctcaacgaagaagcaaactggtgttgggatcatattcatagggaatgaaatgatctctctgttaaggagaatcgagattatatatatgtggtacaacatcatcataaaatgcaggcatcccatgcactgaagggtgaagactgatcggccactgaaaataattccgaatgcgaccttcattctatcataaaatggaaagaaacataatcaccatagatgaaatttgaggcctcgtttttcagaagaaagtacgcaggcatccacggcggcgatggtgcccaaagcagaggagttttcttctccgtacccccatcaggtcgttgtattgacgaggccgccggcaaggcaatcctgcctgggcttaagtcggttcatgggccgtggcccgtatgtaccacaggtccaggtcgcaacatttgtctcggatcctagccgcacgtcttaatccaacggttcgtgaggccctgagggagttcggagaagaaaactccgaacccctccgtagtccgtacccttcgtctcggttgtgaccgtcgtcaagatcggtgaccgtacggccgatctccgacgaaccttaaacccttacaccggcttgttttctcgattttgcttgctctctgtttgttcttggctgttttctcttaggagaattcctccagtgcgaaaacggcaatttggagaaagaggcgatcgtttcttcaatcctgagtcgttatgatgtttttaatgatgatttcggtgcctaatattgctgctgcaacgtttctgaagatattggtgcttagctcgttcttgagtattgcccaattggcatgtctgcatacagcacatggctatatgacgattagttttgcctttttatcagctatgcattaattcatagatgatgggttgctgatggccatgcctcgttgtttttgcagtttgaacgagccagaatgcctgattgtctctgcacatttgcaaatggcaaattttgttctttcaggcatggttgtagattccagtgaaccctcaactgtttatgacaacgtcgaaatcaggatggtaaaagaaaggaaatacgaagtattttctagctcatcgagcaacaacatgcagcagacatgtccaaggtatgtgacagagcatagtatttttcttttcctagtacagtctacaaatcgtattgttgccctcactattgacctttttttagcaacaacaaaacaattttagcaggtgttcattcgctgacacgagaccacagctccaggtaaacaccaggaacaaattcagcagccagtgtgaggtttcttcagttaacttcctttgttttggcagttcagttaacttgctttgcattgcagtaaggtgccttcagttaatatagctggcaccttgctctgaacaaagacttccatgtcaattccattcttcttgttgcctcgggtaaaaaaaaacagcactctcgtgtacatggattccatcatcatgtaactattatcctatagtgcatacattttcttatattcactgttgagtagatctggatctgagtcaactgtttgagaccatgagcgagattggcttgtagacgccttcctgatcttcctctcatccatcctatgagcaatgatacagtagcacatggaaccaagagttgtaagcatgatcactgcaccgattgccattgtgcaccaagctagccaccagtcgtcgcgcccgacaacaacataggttagtgctatgaaggccaccgagataaagaggcatgccagccacatcagcttgttcatcacaaagaccatccttctcttggctttctgctcaacaacaattagcgaggtctggacgacgacgacagcaagtgagatgaagagagccaaggcatcaaagaccaaaaatactaggaaggccgggttgcttgctacatatgcctgccccaaggacatgcctggaggtgcctgagtgatatcttccacaaaattgccaggaacggtgaaaatggcagcaaaggcgacggtggcaataagcactgcaaccacagtattggagttgatggcattgtttagaccaccaatgtggagtttttcgagtctcttcttgattttctggacttgcatcttggtctgtttagtttgcttgatctgggactggacatcatgtctgatatcactaactgtttgcttaagttgctttgccggattgggtggatgtacttgctcttttgcagttactccaccagcctctctcaagatgttaacaagttcttcattgttgagttgctcagcaatggcaagagcggtgtgccctgatctgttaactgcatttacttcaattccctcaactgatagtagagtctgcactatctgtaaggaattacacatatatcagtcaaagcaaaccttcttgtttctatatgtttgaaatatgatatgcttctttattctttttaaaacttatgtacaggcacctgcatttgttttgaatttgttcataaagaaagcattatcaccattccaatcaaatagaggtatcctacagtaaagttatgataatctctgttctcaaaatactgacataattaaactcagtaaacaggatagcaagtgatttggcaaacaaatagtcatctaaaaagatcgacaaaaacatatagtagcaaggaggtaaaataaaacaaatgaaattcccaatataagatcacctacaacgatattggccttccgtgttgcaacatgcaatggtctgtttcccttgttgtcttccagatgaattactgagatatcaggcttcaacagctcgataacaatttcagcattttgtccttttgaagccatatgtagtgctgtttgccccttcttgtcagttcttaaaccaattcctggatccctacttaataatgatcttacaatttccacatggcccagtcttgcagctgaatgcagaactgtcttcccattatttcttgcaattctcgcaaggtttgcatcagattccagtaggaggttaacaatttcagtgtgacccagaattgcagcagtatccaaagctgtagcatttacagaatttgtagtcattgcaagagcaggaaaagcctgcaacagctccttcagaacttctgaaaaaccaagaaacaaaagaaacgtatgagccaggatttcttttttcttcgttagcaaaatacttaactaaaccatatcttgtacaaatcattgtgatcatgactatagctgtggtttgctggctactagatataactccatgactaaaatgacatgaatttcagtctttcacaagtagaaaacagaatgagatcataaggtcataaaactaataatggttgcacaaaatccaccatcgcgcgaaaggaatactaccatttttttcattgtatatattcttaaataaaccattcaatgtagacacatcgtgaaagcttctttgggtacagaatttgtcaaccctcactaaacaagaccataaatccataatgaaaaactcagcttgcctatcacctaaaaagaaggtatttgcttccttgctggacatgaggtctaaatcaaaccagatgtgagatatgcactagtctcagacatttatgtaaaaaaaagagagaagaaggtaaccacaacgattcatgttagcaatgcacgttgtgaagaaaagaaatgaacaaaagcaaaagcacttgtatatttccataagtcaaatcagacaagttcagcataggatttttcaaagccctacacaatgacacatgcaaattagattaagtcaatgcaaaatcctaatgccataaacctctaatcatcagctcattgacttggcactggcaggctgagatcgaagtcagtcatcactaataacagaaatcaggttcagaaaatgaacaaaaaaaaagaacaaacaaaaaagaagaagaagaagaaagaactgacctagatggccttgcttcgccgcaatatggaacgcgtcgaagctgttgttcgccttgacgccggccgtctgcacgtcggagaccttgaggatctcgcgcaccacgtcggtgtgccccctctcggcggcgacgtacagcggcgtctcgccgtcgtggttggcctgcgcggcgcgctccgccgccacctccgggtcgaactcggcgatgatccgctgcgcgccggcggcgttcccggacctcgcggcgaggtggagcggcgtgtcgccgcgcttcccggggctgtccctgtgcctccggaagttgtccgtggacatcatcttgaagctcttctgcttctccatccccctgaagctcttgagcttctccagcgcgcccaatcggaagctcgtctgcctctccatctccaaatcagaacagattcttcaaaaccgcggaatccaaggtaaatttctgttgcttttggttggtgtggagagatcaaaagcgctcagagattgcaacttgtggagaaagcgctgtgattgatattgcaatctaagaaaagaattcctcactttccagaaatctcctggctttgattcacaagaacattagcagcaagattcgcgcatccccttgggaaaaaaaaactggaatggggggtctgtgaaaatctgcccaccaatcaaaatcattgggccatgaacagagtgcctgataggtgatactccaactgaggaaaaaaaatcagcattttgaccacatgttagaacttagaacacagttgattataacatctcgaagaagcgaaaatggagaagtgaactccaaaccaacaaactaaaaaggacaagaagaagaagaacatgacacttacaaattctatccaccccttagaacgattggaaggcaagaagaaccaatggagccaaagaaaagaaacaaaagaaaccaagtgattgactctagaccttccaatcagccaaagaaaaagaagagaaccaagaaagggtcctagtgggaatcttggacctctcctagctttgatttcttcttcttctttggccctcttctctctctatctccctagagagctcactttcaggctaaactcccctctgcctggcttctcagcacaactgccagaagacaaatatgctgccgcctagcagcagcccaagttggtagagtttggtccctggttttattttttttcctatcttttcttttgtgggggagaaataaattaatgggtcataaataattgtacaacttgccagtccattgttgctattttcactggactgctcatcgttttgttcagtggtagctctatcattaattggtacgggttgattgctttcgtccagcaaatccaggttcgacctcttaacctgctcatattccatctggattaaacgaaatgaagggttggaaaaaatgtggcttctcctatcttaataccattaaatggctagtttcttctagctatcccaacatttgagttctatctttaattcaatcggggggcaataaattacagtactaggtgagagaattattatttttgcatattgttcataagtttttttattgtgcatcttgtagtatttcgctaactactcattttgttgtgtggtgactctatgattaattcaatcaagggcattagatggcacctactaagtgagaaaaaggcaaggatttttttatggtttatattgtccgttacctaaaaaatttgtacctctctgtaaatagttatatttttatgaataaattatggaataatcaacattatatttttataaataccattcgattaagtgcaaaatgatacaagggcacacatgccacgacaaacatgataaacatagtattaattgcagcacattccactgaaaaaggcaagttttcttaaaggcataaaaaagtcaagttacaacgtatactccatccgccaaaaaaaaaaactcaatctagaagcatcccctcctaatataatgaatctaggcaatctagatttgttgtatgtgaccctcttagattgagttttttgggactaggagagtcagactctctccgtcaaaaaatataagagattttaggtgaatatgacacatcatagtaatatgatatatcacatttatctgaaatcccttatattttaaaatgaaagaaatattagcaactaatattaactagtaaacaaaatatagttatcaattaaattgtgcctataagtagacattttcacctaaaatgttaaagaaatattttgcttttctaatgaaagatgcatttctcatgctatatgctttagaacaattttactctgctttatctcttagtgtctgtttttacaatttgtcggcactctcaccatagtggagttagttagtctctcctttatatctctttactttcacaatagtttctctttttttatggtccaatggggcgccaaggcggccatcaaaaaaatcactggttagagtgaaagcaaattaaagcagataaacattttttgctttcctaaaataattcagatcgccatacattacacgtggatggtgtcgacgttttgatttctgccttatccaggacccacctgtctggtatatgtggcactgtcttgtttgatctacgtgtatctgttgccatgtgtgggctcctgcagccgaaagcctccaaaagcataatcacttgagagtagggatgaacatggccatcatcttctcctcttttggatgaaagaatacaaacttgcatgtggctagcatatccctttggcattaaatgataaatatcagaaaataaacataacttttcttctagaaatgactattatctctgatattttgcaataaagttgtgtaaattacggagtaaaagggcctgttcactttgatgaaaaaaaacttaccaatgctaaaattttggcatagttgtcaaaattttggtaacttgataaaattttggcaggatttcttatatagttatcaaaatttgacagcaaactaaatgtagccatttttttagtaactttattaaaactcggtaaagttgaaaatagcatgaagaggcccaaaatctatgtagtttgatgtggtgtgtttgtataagcaacatacaagttaatggtgcagtggacatcatgggagggacttctcttgtcttgtagtaagttcaacaattgatctgccttagagtacattttctcttccctgatttcaacattgttttactaagagcaagtttaattgtgtagctgactattgattccaaaaggatacacatcagcaaagagtaagtgaagagctagaaggatttgtacaatagctggatattgatactgtatttggacaactatcaaaattatattttagctgaattggcaacttactcaccagcaagatgaaggcttgttggtcagccataggttgagcactagtggaccccatggcatgcatgggagcttgtattagcactggcgacaaaataagcgcctacatttctctcttttccatctcaacacaaatataacttatttgttgctatagtttgtttacatagaattattgtgcctgctctaaggctcctatcatttttggtgaaaaattcccacgtgcgaaattaagcctttgttgagcaaacaaattaagaatgcccggtttggttagaggcagaaataagcatgcatatgtacgcaaaagaatatctggatttgaacagagtaaatcccttttttccagcagtttactcaacatggatatcttaatttgcagccgacgattgcggatcttgcaaattaaggccgctataaatgcaagaaaataaatagatattgcaatgtaatactaaatggcacatgaacaataatcctgatcgaattgaaggtagagaatatatgctgggcagtgtgatcgatcctgtcccatgcgtgcaaagagaggaattcataatttacaattatgcagaatggttagataaacatctggcgatgatcgatgggggtagcatcatgtggtgatgtccccggccttgtgtgcagagcacctaacccggccatccatccctagtccatccagtaataatccatggtgcgctagagacgaattagattagcacctaatgccacactgcaattgtttaatataatcaggcacataggccgcagctaacacccccatcagcacgacaatgacagtattatgatagtatgatatagtggaaaaaaggccacgagcagctagttaatcagttgcacacgtgggtcctgacgagaattaatgtttgtttagaggcaagttgcgtgatatagtagcacacatctataggattaattaagattgagctatctagtgatgaaacgttgttagagctaagctatagcatgacttggaaaaagaaaaccacacttgttcttttagctacaccttgtgtgtatcgatcagtgagctatctagtgaagatgaaggcagccggccggtgttggcgctcatcgatcgaccgactgttatattagcattccaattttgcaagtgtaactgtgtaagatgtgtagtaatataacaaacagttcaccaccggtgaccacccatgggcagatcgatcgcgcaaaaaaaattacacgtcaatatattaattagaagaaaagagtttttgtcacgtaacataatcggccgaaccaacttatatatgcgaggggaagggagcaaagaaaaaaaaaactgaagcttaaaaaactacggtggctaaacacaaatttcaaatagcaggaagatggacagatcaatctgtctcgatcgttcatgcatggacagacaatttaatgtacacagtagctagcttttgtgtgattgtcgcgtacgtccctgggcgccggccaagcttgacccccggccctctt

SEQ ID NO: 37511 - DNA, 33148 bp, Oryza sativa
tcctgcagcccctagttccaaagcatacacagttcgcacggagtagtctattagagcacccacaatggtaaagtaaggggctatctataaaacatgtacatctcagcaatagactagattatagtaaatcacctcaacagtatgtctacatggttatctatagctctctcatgcattgctcgtttctctatagactatctctatgttagtagatagctttgctctctctcttcatttaatatcttccaagtaggaaaatatgctgacatggatctcttatagagagcttatagataaccattgtgggtgcccttagcacgcgattaattaagtatttgctaactttttttctcaaaatggatcaatatgatttttttaagcaactttcgtatagaaactttttttaaaaaatacaccgtttagtagtttgaaaaacgtgcgcacggaaaaaaaaaaagagtggttgggaaaaggggcgtccgaacacagctaacctagctagctacatccccgttctaaaagaaattcatctctctttacaatgaatctaagcaaatatttgttctgatttattcttagaagttaaaaaatagaacgggttcagatttattcttagaagttaattttttagaacggataaagtatattaattactaactgatctgtatgcccaccgtagctgagccatacttgaaaagaagctaatgacgtactgctctctgacatacctacagaggtcgttgtgtgagactcatgtgttagtcatttaaaagcagatgatgctccctccgtgtcataataattttattttttgacttatcctatttgtcctaaaaataagtttatttttttaagtaattattgtattggagccaggaaaagcagagaataattatattagaataaataaaacgaaaaataattgtattaggtttgataaagtatgtgaattcttttttttttggaatatgtgggaagaggaaaataattgaatttattatggcacaaaggaatcaataaattatgtttcccgcaatcatctattttgcgaacgtgcaaaagtattacacgtccattagtccatatattagaacaagaaaagtttaaatacacatcacaatcagccagagtgcccgtgcctccctaaataaaaactgaaaaatggggttttcagttcccctccccaccagtcatcaatctccttgggttttttcagtttctagcaggttaaaatagcggctagccgagcgccgggcgagcgagtgcgagctaccggccggcggccggcggcggcggatcgatcgattgagcgcatcggcgcaggccggttgattttgcagcaagcagattcgcatatacggctcgttgcaggttgcgctttctactgtcaaatcctacagttagctagccaaaccgcaaacggagtgcgacgcaacacgcactgatcagatcagtacgcttttgcccggttgatttgagagtaattgtacgcaactctcgattgatcgtcagctgatgcagtgactgatgcatgatgggtgctaaattacgatatatatcacgttggaaattaaaaagagagagagaaagaagacgatcgatcgtgctcgctcttggatgcttgatggtatttcgtgcccccagtcaactgacaatgtttgatttcctactcttataaaaaggccgtttattttaggtctgtacaattgctcttgctcccagtctcacttcagcttcagcttcagcctgtttaagcagcccggccagcaagtcaaatccatagagtcaacctcgtgggtaaccaatcaacaaccaaacggcctaaattaagttaattacctgacgcataaccatcaaattataatatactcatatagggagtagttaattaatctttgcaagctgaagtagttaattaatctttgcgagctgaagaacaacgactccttaaagaaaacttgaaagcgagcgacttcaggactgaacaaaacaattcagtcaatggcgtggactggaccatccggtcgttaatccatagtagtacgagttctaaacacaattctcctcctccatcgtatgcctaactaatctctaaggacacgtcacatcatcagcatctacactagctagctagctaagctagcggccaattattacaccatggaattccactgcttcttcccaattctaccctgggttcggaagcttcttcggcgccgagcgtacaagcagtttagcacgcaaagcacatgggaattgaagagatgggggcaatggtatatgtatgttaggcatgacacacagataaacagtgtttaacgtacttaattaactaactatttaccactcaacgttgtcggtctctattaagtaacttcggacaattacagtttctttcagaataaaagctcctcaacaatttagttttcattcaaatcctggaaaactatagctgtagaattaagaaaataactagtacaagctagaagcttgttttcctagcttttccagatttttactagcaccaggtacttctcaaaatttttagcttcccaaccgataatgtatcctgattccttgaactaatgcacaaccatatagcacttgccactactgcagggatgcgtatctaccgttaaaaaaactgataataccaaaatcatttttgatagtgcaaagattaataacacatgttaaatttaagagcaaatttctgaaaatataagataagtacaaagagcattaccaaagcatcgtaacattgaactacttgtttgggcccttgacctttgtgacgctttgggcttagggcgtacccgtgcgtgctttgggctttaggccgaaagccttgtggcccaaacaggaacagaatcatagctacctctaacctaataataatgtccttcactccttcatcttcatacattcagttctttcatatatgtgtgtaatgtaataatcacaacttcacaagtacctcaagtttcgtatctgctgtaaccagttagctatatatggatgggttgcatgaagttttatgctaatagtagaaagctatatactatacagtagtacatgccaagatggcctagttctgacgatgaactttttttttttttttgaaaggaaagctctgatgatgaacataattaacgtttttcagaatcagtggagtcaaattcaggaggctaaagtctcgttgttagtgaatgttatttttatttgttagagcaggtttaatagtggagctagtaagcaccggcgccaatttatatccacgtcatttagagtatcttcacagaatcatttttttatgtgtgtgtgtgaggaccgccaggtttactcccattggaccatactggaataatgacatgcagccgtgtaaaaatcaacagagattagaagtttaatagtatagtcaactactaactccaattcatctatagccaatctaatagctcattcgtacaatagttacatactacactattaatacccggtcccacctgttatacacacactatgtcttggagtccgtactacagctggctataaatttgtagcccgctactcttctctctcatcatttatctttttaaaatatatttgtagctggcttatagcactaccctaggtgcttgcgcttggccggctctcatgcaagcgccggctaccttctctctccaggactctctttcttccatgtagatgtaggttggctattagccggttattatacccgctcttaagctggaagactggaataagacgcataccaaaccatatcactccaggtgacagatggctttggtcacggaggttcatagccagtgctgcttattactcagtctacagtgtaattttgtctagtttcccctcatcgatcttgtattcattcagcttggactattggacattagtttccagaaatgcagagtatatttagttagtcttagacatgactgtcactgtcttttgggatgagcattttttagagtttgttaaccatttagttggtgcacacactactagcaaagtatttcaactagtcgcggttagtcgtatactagccgtaaagtcagtcaaatcactcgactagagggccacgactcgaccaaaaagcaagttgtgcaattagtcttggttattcataaagtcggtcatagattagtcgtgattagttatagcaaatcataatttcaccatgctaattgtcttgttgtgtttagtactttagttttatgtcttgaacttattatcttgctggctactccattgtccatagtttgtaatactatatatagtgcttagtatagtataatggtagtagagactagaactgggacttgggccgtgctttctcaggccagcccacggcacgatggcccagcacgaggaaaagcacgacacggctatgggccaggccggcccgtagttgggccgtgcctgggccaaagttgaggcacgcgctgggcggcatggtacggctattgggccgtgcctgggccggcccagcacgaaaaaaggcccgaaggctggcccagcatgaaaaaggcccgaaggctggcccaacacgaaaaaggcccgaaggccagcccgagctctagccaagccgagcgcccgaggagtcaagagcgcgtgcaattcgggacttccgcgaggagatcaggaggcaggagcgccgagccgctgagcgcatgcatgcgtggtcagacttcagccgacgcattcatatatgggcttcgaccgcgaggagtcgcgttcagccggcggccgcgctgaatactgatcagtaactgatgagccgtgctttcaatctttcagaattcagagagccgtgcatgcatggaaagcatgattttcttggctaattaattctgggatcacttaccattggcgattagtatcgtgtatatccactattagtcaatgaaatttttgttcatggtttttaaactttttaaatggctaatgaaccgcgtccttgttcactgcaacggtgcatgcatggaattatggaaagcatgtaacgcagcaggcgacggcggctcagcggcggcggcggcggctctcggtgtcgacggctggcgcgggcagcgcagcagggagcaggcggtggcggcgcgacgtggccgtgcggaccccggcaaaaaccctaggcacggcacggctcctcctcaggtaatcctaggccgtgcttgggctgacacggcccgaagaggcccgacatgtctttgggccatgcttgggccttatcttctccaccttggcctggcacgacccggcacggcccgttctagcacgaagcacaacgggccgggccgtgctagcccagcatggcccaagtcctagctctagtagagactatataacacatctcatgttttcgtatgagcaagttgtggatttagttcattaacaaggagaagtaatacaacattgatatcatgtgtcagctgcactaatgaccaatgtccctggctccctatgaagttgtatctctcacgtcaacacttaagctacattagaaatacttcctccatcccataatataacatgtgcacgtatttcaatattcaacctttaaatcatttgaccaacacttaatataatatgaaatgaattttatttgttaaaaattatatcattagattgtgatttaaatttactttcatataatcttgttgctacaaactttattgtatatgagaaattataagctaaaaattagttttggagaccgtgccaactttgaccatgctttatattatgggatagagggagtatataagaacaatttatgatacttgatccttcgtgaactgcaagatcttctgtaagatcttcgtgaactcattttgaggatatcgtactattaattatgtataaagttgtgtgttagttttttttttgggaaggggggcatgtgccccttgccatacaattaggtagtagacattaagattaggcaatctaaaacaattaatttccttggttttaattagtagattactaagtggtaatagttattgatatgcatgtggtcatatggtaatttggtttacacgacatcttggtcgttttcatccattaaaagaatgttcctcctatatacccggaaatcttagtatattacgagcacctcgtgtgacacgtctataaccacacactgatatgaaatctgaaacatcaatatgtctcaatgagttcatgactaatcatatcttgatttatgttagtagatatctcattgttcataactagaagatttagatttaatatggtgtttggacttataagagttttatgaatgtaattagcatatgtgaagattgaaaatagacaattaggaacattagaacaccctacaagtgcatctggcccctaagtgggttttgagtgattaacgaaatgtaattagagatctgattgtttcatgaagtaaaagtgcattgtatagtcccgaaaagtttttgagatgaaaaaaacctccaccggcatttaaatttttgcaacttttaagatgtggcaattaaggatttgtcactcacaatttatgacatgtgggccctcgtgtgtatatgacatgtggctccagtgacaaatccttaattgccacttgtaagagtggcaaattgttaaatatctcacgcaattgtggatctctatgatgtgaaaaacagagtcataggattatcatactattaagagaggttcttaatcttagccaaagttcgtatcatgtgctcaattccaatcctttgatatttatcgagagacattaggcaccgcactcacaagggaaaatgagtgattttcttaagtttcgtcggagcgtgtctggtcaaaatgtttggaatctatgttcaaaacatgccgtctcacacttctatgtttttcctaccctgcgtttcaaaaagaccttactatgtgaggttgatacttgagctgataacgaatgattcatatataatgtcaatcactttatattgcaatgtagattgggttgaatgcatgtggtacacaatgacattgtagctctagagcttaagcatcaatgctatgcttgcaaattaaaccaaacatcagtaaacagaatcagaaacctgaacacaagcaaaccaaatcatgaaatcatgatcactgcgccgtacttggcgacgaacgcggcaatgttggcgtcggagctgccagttaagtgtaatacaagctatgtaatgttgatgagtccaaccaacctttccacaactgaatcttgcaagggagtctggtaactggcatttcccaagatgacagacaaaactatcatttattcattttgacaaacgatttcaaattcgacactcagatgacacggaaaattcaggaattctcagctgttaaagctagctcagagtattatgtaccagtagcacaatatgtactacctccggccccaaatatatatttgtccagattcatagctaaatcttgttatattttgggacaaagggagtatcattcgggaacatgcaaggaaaaaagggtaacagagggtgcagacacacacaaaatttttcagttgtttgatggtttgctcgtttaatattcatcaatgaaatttgatgtacaaggggtgtgtcactgataagtgatcttattagcataacgtgtttaactctaacatgagtaattctcagtaatctgtctatgaaatccaaatggttcagagaaggaaccattgcaaaacaaatcataaaaaacacatgtaagtttgacaccatcttgtatatccagcaaggaaataagactattctcatcctgaactctgctggtctcagttttgacctttgccaacaactcaggaaaatgggaaacgttgagcacagtagcaggtacctcaagagcacaattactgattatactgcatgaccttgctggaattgacggtttctgcaccatgttctgagacacagatgatgcatttacccaaaggtataccgtgtttctaccatgtaaatgaaggcaaaacataggtgggataggagccatgcttgcggcacaatgaatcgatggcgtcctctccagcgatttctccaatctcattgagtccaagttcagttgcatgaatccctccagtaatgaatgcagaagcgactctagatgcgtttgcacctttgatgtcgtggtgcagtgaatcacctactgtgatacattcatgaggattaacccctgccagggacattgctgatgtatagatcacctgagaaagcaatatcagattagcacttaggcaaccgaactagatatgttaccgatagatgttaaaattcatgaaggataatcacagaaaaaaaactgaaagttattcaagagaaaaataattacacatggttacaactataggttatcaaacttgtggctcatcataacacatgactgacatttcaacatgttgaagtagctgaaccattcagtaatatatataaaaaaatacatgtcctataccttatcaggcttccccatccatttcacctcaccaccaagactctcgtatttggctgccagagtgcctaaaaggacagattggccatttatgttatattacaacaaatggttgacatagtgaaaagcagtatagctgtagttacagtatgactaaactgatccatgcatcaggggaaaatgattgttattaggtatctgctaaattatcagaatatcatgaaatatgaaacaaagtaacataccaggcatgactcgcagatctcgtgcttcaacagtaacataatcagggttagctactaccattggcagtcgcttttctaggcatagcattagaacctgctcaagctcctcaagacttttgggaagtggatcccctgaaggtagacccagggcctcagtaccatgggctaatataaactctgcctcttcgacattgctcacgacttgcaaaccaaggccctaataggagaaagtaaactgatttcataaagtccattttgaatgcaaatactatcaataataattgtaaaatattttttatctcttgtttgtcattgtcaatattaattcttcaaatatgttaatctgccttactattggattgcaagtttgcaattgcaacatagcccgaacaaattctaatgctaaattgctaatactgcttgaaagagagaaataggaagagagatgtaacaggaacaacaaacctccagagaaattgcgcctcgattgccccatgtcagatggacgcactttcttccaagagctgcaaaccaaggatcatctctcctatagattatttcgaaattcagtgtaagctacaccaagttacctcatataaacatatcactgtaaggagtaatctccaactaagcgaaataaagaactctacttagtatcagaaacattgtttgcttagtgtaatatggtaaggtaactttaattctgatcataatatgcattgcaccccacattcctcaagggggctccactgaaacctatgtcagcagaagatatcaacagcaagaagctcacttctgaaggtactgatgtgtgagttccccgctagtaatggccctgaggaaacaggatgggtcaaaaccaaggctctctagcttctccatggttacagacgacctcctcgacgaattgctaatgattaccatcttcgcccctttctcagcgagcttctccactgcaacagccaaaatgaacctaaatcagtgcattgcatcaacgaaggggaaaatataaactgaacaatatacagtctgtataccaacatacacgcgagaacggcaccagggtaaggcttcttcccatcgtgaagaacaccaaactgatcgaggaaccacgcctgcaagccagccaaatgcagatataaacaaacgagcagcagtggtagtggcaaatgctacgcgcagaggaataaatttctagtcgaaatttccccccgttccctatccataactgaatcgaccgcgtgattcagttccagaactgggaatcccacgaataatcaatggcctactgattgagcaaaagcagcagtaattccgcgcaaagctgcttaattaatggtggtgggggctattaccttgaagcggccggactccgccagtgcccggatcccggccagcctctcgaacgccggcgccgatgccgcggaggccatccacccccaccgccgccgccgccgccgcccgaagcccagcagggaggagggagggaaggggagagaggagagtgggtaaaagtccgaaatgggtgaggttcgttgcctttggtgacctgtgggagacacgtagtactgtattacatactgttaattcagaggtttaaaatttaagcaaattttacattgagccacatgtttctctgggaaaaatagagtacgcaatgaaccattttcattagaatgtatccaaaaccttcacatctcgaaccgcttggtcagacacataatcatccacaagtttcagtaaggtgaaacattttcgtcgcaaattcacaatactagaactttaggcgcgcttcgcggcgccctaccatttgttattggtaaaaagtaccacgagtcagaatatatatgtacttatattggtaaatgttgagtacgaaaggacttcattctagcacaggctgtgacataacttgaattccgatgttacatgatgatttgaaatagaccctgaatactataagataaaaaatacctgataatttcagaaaccacaattatttatcatacccaaaagagcaagaaaaggtataataatgtataaaaaacggtttaatcattcatcctcttttaaaagaggttaattcagttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaagaacgtctttcggactaatctctgcttgaatatctggtatttggtacataggcctaagaaaaaaaaatcagagagaattgtccatgttctgatttgtgattctgacttctgcagttactaaacataatccaacaaaaaagaaaatattttctatgttctgtaatttgagtcttaattcagattagattgacctgaaatctaaagaggtcatgaatcttcagattttgcatttgattctctgagattatatcaaacagctagatgacaccttaaaaaacacaatgaagcagaatcatccaaaccctgtcctgaccacctccttaaaatatgtaatggagcagagcgacccacagtggtttcatgaagtgaacatctaagcttttggttgttggaactatatacaaacacaaccaaataaaaagatatgcagtacaaatcagaaatactgtagcattcttgataaaaaaaaaggtagactatcatttgcaagggaataatggtatatgaaaaagcaaagctaacgagggaactggaggcaggaaagggaagatacacgccaagcatacataagtgagtgtagaaaggaactggttgtggcttaactcaccaaaagtgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgtttcctaggcaagaagttttttggatttaaatcaacagcaactatgaaattgtaagtcccttaaatataattgcatgaaagcacataaaccatttcttgcatacttaattaaactcctactctgaaacattgatatggtgctctgcaatagttctttcaatcttgcaactaatgtcaagcaactttgttatggccttcttgttccatgattcaggtggccttgtaatgctagtatatgaccttcccatcgagaaaatacttagttaatgaggaagaatatccaaagtaagaccaatttcagaatatcaattagacatctaaatgaggccatatgataaagtgcgtgcagtaaaagaggatttctttttttgtcatattaacaaatgatctgtacaggtgctacagcctctaatcctcccatgaatagtttagcttaattagtttattctactgtgcacccatggtaaatttttagaaaggctaactatcacgtcaacagtgaacattagaacagtcattgacagttgcaataacatggagtatgtgcatgaggataactaaggataatggatttaggactaaggttctatgaaccatcatatgatgttcatgtgaacaaatgcacgtaagttcctattatgctgcatcgaaaaaggcaagaagcaacagaagaacttggaaatctggaaaaagcaaagaaaataaaggcaaaggcaacagaagaagatcacctgttcaaaaatatgaaatgtcatcccaattgccttgtggaggtagcaacaaatagacactcaacatttagttatgaaatcaatggcatcttgcttcacagcgtcctatcgtttattgagagcaatataaaccagaagtatatattgtactaatataaattgaagagtaccatatcaaactttatatgcccacgatcatatctatgactgtacataacaatgctattcaaacctgaagaaaaatcagacattcatgataaggctcatagtatcctctagaatcagatcaagtccaaagatagtcattcagatcaatcgataatttttttgattaatttcaattgtaagtggtcagctcaaagtgtcacagcatttacatcattcaatattaagttctggaggtcttcattccaacacagattgtcacaacacctgaattctgacatttgtgtcacttttaggaatagtggttgaattcttcaagatagaaatcactgaagagttagttcagaaattatgaaaacttatcatgcttaacagagaaagacatatcaatgtatataatcaaagatgattttagtgagattcagtttctttaaaaaaaactaatttagttccatcatatgcaaaactaaatttatatgttgcatctcgtgtagctgaaagcatgaataccaagatagaagcatccgcttatgtgaatgaagataaaggaatttatagaacaaccttcgctaagaataattcccaagaaactaaatgatttctagatttggcaatagaacggtcagttgatcatccaaaatactcctcaaagaactaaatgtagcatccaaaactcttctttcactcaaaagaaaaggataatacatctattgaaatataatgtgagaagtaatcagttaaactaccgtagatgtgggtgtcctaaagagtatgtggccacaaaatctgacatcatgttcataaatttctaaagattgggtataaaatgatacatcttaaactgcaatgcaactgcttagcatagtataagatgagaaagcatagccacaaggttgctagatagccaaatctactacacatattaggaagaaacatgccccctatagttttgacatacctgagcaccatatatggtagcaactaaccctttttacatgaataagacaaaaggagtcatcagatttgatatttataataggatgcacttattactctctaaaaaaaggttccacttatctacatgcataacaatacctttgtagagaataaattatatccgatgaagagctatagaaatacaatgcatatttaagctgaaaggagcatagaggacacatacacattaacaacgtacaacacccactaaacctctttgattacatcaagccactgaattatcagttataatctccctcaatcatacaagcttacaaagaatgtttttcagactaatatctgcttgaatatctggtattcggtgcacaatcccaagccaaaaataaaacacagagaaattttcttgttctgatttgtgattcggacttctgcagtcgatctacacatgcggctgttcttcgttcgcgtcattgtgaagcaatcaagcagaagcagtagcatcatattgtccacatcgtcgtcgctgatctggagggcatggccgacccgatctccaccagcaccccaacgtcgttggtaggccgcgccgcccgctggtcgtcggcctcacctggtgcgaggtcgccccgatgccgccggtgccatctccatcaagctccgccggcgtcgtcaaggtcgtcgcggcgtcgtcggcgcggcacagggtacgggggaacccgtccctgccggctcctcctctgcggccgccaccgcctggggagctcgtgcccgccgcagccgcctacgcctgcaggccgccggttcaccgtcgatgcatcctccgccatccacgctgccgcccggatctggatgtcgtcgtcgttgcggtcaatcccatctcgccgagctccggcctcgccgtcgtcaccatctccacccggccggatgacgccggcacctgcctcgccgtctcctgtgccgctgcggggggactcgcctccaccgccgacttgtgcgggtcgccgctgcccggattcctcgctacccctcctgggactccacgatgggcgcccgccggtctccgccgcgttgctcccggcggcgccccgataccgccgccgccggggggacggattccgccctcaccgagcacgagctccctccaccgcctcccgccgtccgccgcctcccgccatccgccttgctacgccggcgccctccgtcggcccgatgcccctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcggtgaggagaagcgggtgagggggagggaagacgatgcagcaccggcggcgccgcaaaggcagggaaagagcaatcgagagaagggtggggtacaatggcggctagggtttcggacaagcgaggggatggaggatggggatgttttcttttgcaagaaaaccctcttactttcttgttttagagcgcgccccctatattcggaatttcttctctttcacatataataataccagtacatagaggaccactacgtaagaatacaaaatacagagaagtacgaccaggcagttaggaatgattatcaaagaaagcgagggtttttttgcaaaattgccagctccagcgcagggtgacgtggatatcaccggaagcgaacacgccagccaaaaaagccccggagcgctgtggtggctccatttcgcggtcccctttaatctctccgatactgtaaccttcacatctcaagtcacttggtcagagaatagaagttctcagcagctagtttcggcacaacacttgaaagctaagaacaagaaggcaggtttgaaaacagattatgctatttcataatctgatcccaaacattcaggtacgctttcagaaataaaggtacaatcggctaggctattacaaagctaacaaggtaatggattcatcccttgcacacaaatggcgatttggggcatgttctgcattaatttaacttatcaattaattcgttgattttatcttcacggtctcccaaatcaccaccaatccaccatccttgtagggtttcttcttcatctgtaacctccttcttgacacttgagcttgaagggcatgaggaagtttgaagcttgtctgaagtgtggaccgactgttgcgatttcatgctcatcttccaaacatatgatgccatgttctcctagagcctgttttcagtgaagtacagatggtgatgttacagtgtacattaccaaaccatgagaaacagctagaagtatcttctttactccaccaaaaaaagggaaaccaaatatccttttttttgttttcctttggagacagaaactgcatctttatgtctgggaagttacaaatgatcgagacggttatcaatgcaaaaatttaagcataacccactatgatttttatacttgtggcaggacaccaaaaattgctccaccgaacaggtgacaatgaagatgatcctaaattaagtcctggtagcattttaaatttgagctcttgaatccaacaaaaatattaattgagattagagaatcagatttcaggcattgttacacctagtgatttttatttttattaattttttttttgtaaactagacctccaaaataagtccacgcaaaaaaaaaaaaaaactgagagctatgtgttattgaaagttccaaatttccatggttaacataaatttttagaaggtgcaacaacagaaataccttcttaaatagatcactgctggtaagccaactttaattctgatcataatatctattgcaccccacattcctcaaggagaccccactgcagcttctgttagcagaagataccgacagctagaagcttagttcttgtgaagatactgatgtgtgagttccccgctagtgatggccccgagaggaaacaagacgagttgtgaaaccaaggctctctagcttctccatggttacagtcgacctccttaacgaattgctaatgataaccatcttcgcccctttcccactgcaacaaccaaaatataacttaaccagtgcatcgcatcagagaaggggaaaaaaaagtaaactgaacactagtgcaacaaccaaatataacttaatcagtgcattgagtcagatgtagaacaaaataagagaaatggatatataagttagagaatataattatatacagtgtgtaccaagatacatacatgcaaggatggcaccaggtaaggcatattcccatggtgaagaacaccaatctggtcgaggaaccacgcctgcaagccagacaaatgcagctttaatcaaacgagcagaagaagtgctagtggtaaatgctagtactacgcgctgggtgggaaatcaactttccccgtaaattttctagccgaaatttcccccaaataattccatatccacccctgaatcgaccgcgtgattcgcagttaccataactaggaaacgcacgagtaatcaatggttaggggaataatcacaagcacaagcgcaactgaatgagcaaaacgagtagtaattccgcgcaggtcggcggttgctaacttgatggataggtgagggggaaaagagagggcataccttgaagcgggcggagtcggcgagtgctcggatccccgtcagcctctcgaacaccggcgccatccaccccgccgcctcctccgccgcctgaagccctgaacaccgcggcggaggagggaagcaaggacagagcggggcgagtccgcgagaggtgagattcgttggtgacttgtgaggggcaaggcagtgaagggacgggacaaaaaactccaaactagaccagcgaatgcatcagaaagttgagaacagcagcaatggcctaatgtttgacaaatttaagtcacttctggatgaaatatttggcaaatgacgaatcagtgaatcatgccgcgtactttctgtcgttgactcagtttaacatgcggtgccaagccgaaatactctccaccctcttggaagcgtcttaccaaaaatggacagtcacgtatcatcagggatttcagggccgggagacgtcgaacgagaccctcagggaacttctctatcggtaaacagttaaaaatctccaattcctcaagagctgtgaagccattcatcccatcgggcagcatctccagcatatccatgcaatacgtagtaagcgatctgagtctgggcagatttcccaggtgcgaaggcagtgccactaaacttcggcaatgtgaaacttccaaattcacaagtgacgtcggcatcttgggtatgtccagtaaattgtcacaatgcgatacttcaaacctctctagttggggcagcggaagggcttcatccgatgatctgcacttcccctccaacttgccacatgcacgaaaagacagatgtcgaaggcaaatcaagcaacggagctcctccattggccactgcacaagatcatcacaaccatggacagtcaaatccttcacaaaagcaaagcactcccagagcccaagatgcacttttgacaaactgcacgttgcgagaacgaagactgccatcatttgcttgtgtcctgtgattatacggcggcggtttggcgcaagctgagacgttggtacaacattaacattgcaatccctgcggaagatggcatgccgcttgcagattggtggatcgcgacaagacggcgttttcagaacacgtataggacggatttcgatagtctgttcatgctaatttgttggcttatctggaaagagcgaaatacaaggatctttcaacacatcgccaagtcggttgaccggctagcggatgacatcaacgaggaaatcgcaatttggagggcagcagggattttttcccatgctagcgagtaatcccgattagaggcgggacttgccccattttttctttttctttccgggcttgagtttgcctgagaccggcgcgacatccttcatgtcgttgtaattaaaactttatttcccccaatcttaatgaaattggccggcctacctttggccgtcccggcaaaaaacaaactgcacgttgctaagaagcagttagaaccacgcagagtcaagctccgtagggcttcgaagggtctacggcttttcttgtcttccagaggcaccatcatgttcgctggtgagctaacatctaagctcacgggagaagcccaacaagggtccaaaggcatcctcatagagtcaatatcacctgctttgtaataaaggtcagacaatgatgtgagatgtgaaagtgagaaaattgagaggctgtgacaccccagagcctccagccttttgagagccgggctttccggaacacttgaaattttcatgcaactcttcaattctaggctttcaagctccgggaaaatgatcacatcattattctccccctcactgttttctgcccacctctccaagttcggtaaaacaaataatatcaactccttcaactttggaaataactgcactggggtgttcccatcaatgttcttacataatgagatcaaactagtcatataagacaaggacaaatactcaagagaggctgatagccacactgttggaatgtccttacatcttggacatcgttcaataatgagcctttttaagcaccggaacatttgagggtctctcatccacactgaggctttacttccaccataaccatataaatccaaaattttaagcttgctgtgaggtttaagagattccaacatttcttcctcattattgtctttgtctccaggcatgtaggatgacatgcagccccaaaataatcgtaatatactcagctcttgtttctgatggagattggcttctttcgcgttcgatgtactctttatttttctcaaattgtacagccccaacatattggtaaggtatctcaactgtttgagctcctcaattcccctgccagcatcggtgtccacgacaaacgttgttagtgtcaatagattgttcagtagactaaaatttgggggcatccgttttaatctatcgcatcccaacagataaaggtggttgagtttccttagatttgccatgccttcaggtaaacattctagatagctgcagccattgagcctcagtgattgtaagttatacaatgcacatattgaatctggcagtctatgtatattagacctagaaaggtcaagatatcataattgttttgtatttatgagatggctagtgataatagaagaatcgtacctacagtgacaccacagtcctctcaacgacctcagttttaacctttctaagaaaaatgacctcagttccaacacttcaagacccctgtataatggtaattccatcaacaaagtgcggagagatgttgtacctttgaatgatccactgatttgttttaattcaccttctgatatttgcacatgccaaacatcttcagatggtgctttctgttgaatcagttcttctgtagttgcacattcacttgaaacgtcttttgctaagtcatgcattaaatcatgcattttacatacaacaaagtcataatctaagcttctgaataatattgttttaacatcttgaagaaatgatctccaaaccaactcattgaaaacaaactcgcctttttgtgacaactcaattgtgccctcttcttgaataaaaccatttgctatccatagttggatcaacatgtccttctccatctcatagtccttgcagaaaattgcacagaaggtgaagcattgtttcatttcagatggcaagtgtttgtagctcaattttagtattgataagatttcgtcttttcctttgacactatcaccaatattacttcttgcgatggcttcccattccttgacttggtgtttggaactcattagaccgcccatcgtcttcagagcaagtggcagccccttgcatttatgtacaatacatttgccaatggtgaccaaatcttcttgctcttgtacgtctctaccaaacgctctcttcgagaacaattcccatgattcatcttcacttagacatgctggcttatagggttgaagggtttccattatagatgccacccgccgattgcgagttgtgatgactataatgctccctggacccccgacagaattcagaagtggccttaggtgttcattccacttgttgtcgtcctcattccatacatcatcaagaacaagtagaaaccttttcctgtcaatgactccttcaagtcgccttcgcaacaactcaattgagtcaggtaggtcacattttctatttgtagccaactcaatgatggatttcacaatagaaataggttcaaagttctccgaaacacagtgccacatcttcagttggaaatgtttctggacaatcggatcgttgtacaccatcttcgcaagcgttgtcttgcccaaaccgcccatccccacgatggggagaacctgcaaattctgttgatcatgctgatccagcatcagtttaaccaacacctccttgtcatgctctcgcccaaatatgtctgctgactcgtccagccccgagtgtgttagccgataaggaagctgtggcgcctctgtgtgctccatcaggccaaacttgttcatctcttcaaccagatcgttgatcttcttgaggacatcgcccagcttcctactcatggtaacacggaacaggagtgggctatgcggcgtgaagtagccgagtaccttgcgggtggtggagtcgccgatcttgacctcgcggcgcagagcctcgtactcgaagtcgtcgaggacgtcgtcggcctcgtaggcgacagccttgaggtccttcatccagcgcttgacggcggggttggtctcgcttagggttgtaagtggctaacccgtgaaacccacttataggctaaaataagccgcgagcccgcttattttgacctataagtaggttcgcggctgacccacttacacccttagtctcgctcttcgccttggcatcggccagcttgcactggacggccagaagctggcgctccagcttgcggcggtcgccgtcgacgccgcacacgcgcgtgacgctctggacgagcgcgttcgccgccttgccagccaccccgcgcaccaccgggaagcgattccgccatgttgcgttctcagctgcaaagcacggtggaatgaatgaagatgaaaggcaaagcatgaagcgctctgggcactctggtccgtaattcaagtgggcatgtttggcccgtatgagtataatatggagaaaatttacaacttgacttacttttgcgtccttctcaaaaaaaaaaaagactaacttttgcgtagtgcattcatgtcgtggaatccaccagtttggttggcagtttcgttgaaatctcctcggccctcgccgtcttttcttatcagcaaaaacatactttgctgaaacaaactggcacggcagtcggcaaatcctgggcttcgaatatgatcctgttgagacgaatgcatcagaattcagaatagcaaaggccaaattttgacaaagtctggatgaaatatttgctaaacatacttccaacgaacaaatcccaaacaaacatgacgaattctcccaaaaaaaaacagagcacgaaaccaaccatttccatgggaatacccaataacgagaacctttacatctcaaaccacttgggtcagatataatcagcaacaagtttcagtaaggcggaaacattttcatcacaatatgccgtagtaccttccaactcaagttacttggtcagagaggttctcaaaagctagattcagtagaatcacttcatcaaaactaagaacgagaaggcgggtaggaaaacagattctgctatttcataatctgagcatgaacactctattaagctttcagaaataaaggtacaatcggctaggctattacaaaactgacaaggtataacggatccatcccttgcacatgaattacgactgggcataggttctgcactaattcaacttctcaattaattcattgattttatcttcgcggttccctgagtcaccaccatccttgaagggtttcttcttcatctgcaacctcctctctggacacttgagcttgaagggcatgaggaaatttgaagcttctctgaagtgtgggccaactgatgcgatttcatgcacaagatcttccaaacatatgatgccatattctcccagagcctgttttcagaaaaaaagcacagatgggtatatttcagtgtacattaccaaaccatgagattgtcttcaacatcgaaaactgaaaccaaatatccttttgttttatttagagactgatgaaaatgtatcttatgtctgggaaattatacataaccgagatgataatcaacacacaaaaaaaagcataaccacagtgatttttacacttgtggaaggagacagaaatagctctaccaaagcagtgcatgcaacaatggaattgatcctaaatgaagtattgtagcatgccaaatttgaggtccagaacccaacaaaactattagccgagattaaagaatcaggtttcagacagcgctacacctagtggttttatataaactatatctccaaaataagccagcccaattcccatgctcattgcaaaatagcctgttgtagacaaatttactaatgccgtgcaacctcaagttttataaggtgtaacaaaacaataccttctcaatgagatcattgctggtaagagggaaaggttccttgtccaggaacccacggcccttcttgtaaataagatccttcacattcttcaaatttgggaacctatattacacaacaataaataaaatttcagcactgcaagctacagatggacaaatcaatatgtttttgtacaaaagaactgttaatagagaagcatgtttgagttcagttacccataagtgataaacggctccacaacaagaagcctcttcatagtagcgtcagtggccttgaggaacacgccggtgaggacctgcgtcagccgcagcttgcgcaaaatcctcctcatgtgtggatgcaagtccattgtgctgcagattacacacaaacaaaattgttaaaattgtgaaccgcaatcatcaccaatgaaaagagacaaaccttgcagaaacaaaaacaagaactcctcatcacttgtactgctgctaaaatacagtaataatactgacccagggatgcgaatcgcgaagacgagcttggagttgagggtctcggcgggggggagcttgcggaccttgaggcgggtcttcatccggacgaagtcgagctccttgttgcggaactccctgacgaagtcctcgggcctcttgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgaccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaagtcggttttgaaacacaggaggcctcattaaaagcaagcaaagttgcagatagcaaaggagctccgtactcaccaccagaaaatgatgatgatgcagaagtggactatccgtctcaagatggagcacaaggtgacaactctgacttgcaagctcttattgctgagttcctcagctagagttgaagcttttgcaattctctttagcacttgctattaaataatctcattccaagttaaaataatctcattgcaaggaacagtaatagctgccaagaagaaaaagaagaaaagcaaagcgaagtaagtttatgttaaattaagccattactgttccttttctttttagaaccatgctttaatttatttattctgtagaaagaagaagggacctcttcagcagacagatcctccatcgatccctgttgatgaactcttcccatcaggagaatttcctgagggtgagatccaacactataaggatgagtaagtatgcatttatcctcataaaatttgtttttttttacgcaatcctcataaaatttgtatataatagcaaacctggcacactaatttcttagccattttcacctctaaaaattcctaatggcaaattcaatggactgtaataacagtgagcatatgtttgcataaattaattgtgctattgctcatcagtaacttatggaggacaactagtgaagaaaagcgggaactggaaagattgcaaaagccaatgtacaatgctgttcgtcgggcagcagaagttcatagacaggtttaaaatttattgatatctttgaatatttgcgaattcatttgaatatgctctatatgttacaactctgaaacatatgttgtggtttgctaggtccggaagtatatgagaagcattttgaagcccgggatgctaatgattgatctatgtgaaactttggaaaacatggtcaggaaacttatcaaggagaatggattggaagctggtattgcctttccaacaggatgctccttgaattggtacggtattccagtattttacatttagtacttcgtaagttccttactctgcattcccttatgaaactaacgaaaacaaaaatgcaatgcttagtgttgcagctcactggactccaaatggtggtgataaaactgtactacaatatgatgatgtgatgaagctggattttgggacacatataaatggtatgtatattgtttgttatacgcgtcagagttttttgtggctttgtccttgaaagtataaagtcacaccttttctactgccaaaaataatttggtatttcgattcttctcagggtacatagttgatagcgcattcactgttgcattcaatcccatgtttgatccattgcttcaagcatcaagagatgccacaaatgctggtgttaaggtaattctctacacttttctgtgcattttctgaagccctcaatatagcaaatcaatgggcttggaaatggccccttaagaaaacacctttgtcatgtcacttgttaagggcttgttttaacggaatccattcatagttgttcattaaactgttagtcaaattgttgtgtagcatttatacagtttttttggctagttattgcatggtgttcttcactactgatttgatggatgtataatgaatctattgttttattttctctaaattgtaatagaatctaccattgtacttcagtagtgttttggttgttcccttcattttaggaagctggaatagatgcacggctatgtgatgttggcgcagcaattcaagaagtcatggaatcatatgaggttgaaattaatggaaaagtattccaaggttagtgctagtgcatctttttcccatttcacactggtaacgtaaagtgataagttgacaacgcaaattaaattattgctatgcggcagtaaaaagtgtgcggaacctcaatggacacggcattgggccataccaaatccattttgggaaatcagttccagttgtgaaaggtggtgaacaaacaaagatggaggagggggaattttatgccattgaaacttttggatctacaggtatgtcaatctatagcttaggttgtcacattactaatagttgaaattcagttttgcatcaaatataacaagtaactactaatatgaccctccttggctaaagtgtagaagttttcaagtgttgaaattatctttttttaaataatgtatatcaatccggcctctatatgttgaagttcttgaagaattttatgcttactgtctgtcataatgtttgcaggaaagggatatgtcagggaagacttagaatgcagccattatatgaagaactttgatgttggccatgtacctttgagggcagcaaaagctaagcaactacttgtgacgataaacaacaatttcggaacacttgccttctgccggaggtatctggaccggcttggtgagaccaagtacctcatggcactgaaaaatctgtgcgatgctggcattgttgaggtatgtatagaagtccattctctactccaatattgttgtaggccttgccataaccatattcgtggttgctcatagttgtatgctttaattgttggcagccatgtcctccaatgtgtgatgtgaggggaagctatgtgtcacaatctgaacacaccattttgctccggccaacctgcaaggaagtcatatccagaggtgatgattattgattgcaatggctgtccctcttgtactggttttgtgagatcattgctcgccattttttattttgggaaacctgtatacactgttgtatgtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattacgctgctgaggagatgccgctttgtctgtggcactctgttccgttatggtgacaggaatgtgggaggagattttgagttggctgttgcttcagtttatgatgttccgtaactttcctgtaaatctgtaattggttgatatgtgccacttgttattctattgctaggttcaatttgaggaacgagtgcttggtagtttttgcttgcagtggttgcccatcgctaccgtgttccgttttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataattttatcaggctctgaagtttagttcatcccagattactgtaatatagcaattgttaagtggtatattgactggaaatgaattccaggttgtgtaatctacacccgtttacctagtttgtaggtaggatttctgtatgctcaccaggactagttatgttttcccaatatccctgtcatggaacatttattttcttcatgctactgcttgcgtggtttccttgatgtgcatgtaaatttcaaatgtgatatgatgctagaatggagccgattaatttgttatctactgtcatcctgtgtctaaactctaaactaaacaattattatgattccgtagccaaagcagattcgtgaggtcaaggacttctttctcactgtgagaagaaggatgctcgttcagtgaacatcaagaggagcaaagatgttttcaagttcaaggtcggctgctccaagtacatgtacaccctctgcaccttcgagctgagaaggcaaacaggttgaagcaatttatcccaccaggtttgtaaaaagtggctctagttctgtttagcactatctcatttctgtttgggtatctgagtagtttgtgctggtataaatcttgcttacaattttgttcttcttattgatgggcattctttctctgcaacatgatgctttgttccaatatgtttgttgtttataatgctggtattgcttatatctgttggttgatgtcccagtacgataaaattttgctccaaagatgattattctctggttttagcttcaagccctctgtcataccattttgacacggatggcttgtggctaaaaccattatcaagaatcatcaatgatggcccataatagctatgagatttgagggacaaccctacagtacaacatattttggtatctcaattctttgttatccttggttcctattgaactggatgtgttattggagatgtcaacacattctggtatctcagttctttgttatccttggtttctcttgaactggatgtgttattggagctgtccccaaggaagataaaaactttgtaccaaatatggatttgcaattagttttagcttcaagccatccttcctaattcatatgatgtgtgtggcttttggttaaaactaggttacgcttttaagttcatcagtgattggcaatagctatgagatccgagggatatgggttatggttttttcagacaaaaaaaaaactattagcagatcaagaaactatttgagctgtcaattctgttttttttttaaaaatagagatgtttttaatgatgtagagattttctttatataaatttctgcatctgataattttgttttcattgatccatgtctgagcgtccaagaggtataaagatacaaaggcaacatcttaatgaagtatccaaggtctttggtgctgagaatgcaaacaagttgaagcaatttctcccaccaggttcacagaaagtgtctggtaagttgatgccctagcgaagataaagttttggtccaaagatgtttggtgtctggttttagcttcaagccttctgtctgaccattttgacaattggatggcttgtggctaaaaccattatcaagaatcatcagtgatggtcaataatagctatgagatccgagggacaactgtacaatataaaatattatgatatttcacctttgttatttgggatgtccccatgaagataaattgtttggacctaagatggatttgcaattagttttagctttaagccatccttttaattcttatgatgcatgtggcttgtcaaaactagttcaatttttaagttcatcagtgatgggcagtagctatgagatttgagggacgtggactatggtcgtttcagacacaaaaggctgtcaccttttgttctctgtctcgttttgtatggtccttcactgttctgaccaagaagctatttgagctgtctgttttgttttgtgaatgcagagttttttttttcatgtaccaaagttttgcatttgatgactttgcattccttggtccaggtttgagcatccaggaggtctgaagacacaaaggcaacatctttagtgtccaagtttctgtctgttagcagttcatgcaatgtgttgaatcttttggactcctaagcaaattagacctgcctgttcttgatctgtaatctccgctttggagaaaaggtgtcttttgccacagttctgtgatgcagattttcagcttattttaacccagcagattttcagcttattttagaaataaactgctttctggataagatttctctcttacagtttacattgcactgaatgaagcttttttttttgtcaaagtaccttctgggatgaaggtgatcaaatgcgatataaaatcgtcctgtgctgctgtcacgtatcaccctgccatatattctgggatctcaatcatggttcatagacgggctacagtgcttcatctttgattctttgtttaacttgtgaatcatgcatggataatataagtagctattaaatccttgattctcactggaagaattgaagctactttggccgtgtttttagtttatttaccggactgtgaaatggattactttgctccatgttttaaaaatatattttcttaaaagtacttcacttagactgcttattttaagctatttattaaatttatttctaaaaactatttaatttattcatatatttaagtagataatccataacaataatctaaggcaaacatcggctattgagagaaatctaactttctctgttttttttcgatgggccggcgaatagctggccgatgtatattaagagtaaaaaagggaatgtacaaggtagcgcggtacgtcaatgcaccaccattatagacataaaaagaaagctaaaatctcacagaatgagttgttacagagtgacatatgaggttaacaagtcgtgcagctatccaagtctctcattcatccgccccaagtcctgcagctatgcaagtctcctgttcatcccccatggaaccgttgccacgatcccttcgaacacccttgtgtttcactctttccaaatcaaccaggttacaaggatcacccccgcatcaatgttttatcgtcaaccttagcaacagatttttgggctgtaagccaccaatcagcaaaatcagccgacggcgctcgcaaaatctgactctgtgatttcttttgtgatgaagttgtactttgggcatgaaaatctttcactatatcgaaatgcacaatttgtaacttcaaactgccatttttcattgtctttgaaaggttaccactttattttattttacag

SEQ ID NO: 37512 - DNA, 39286 bp, Oryza sativa
ccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgttgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaaaatcaatacagggatttgatgcacaaatacttgttacaaatttcacaccaagcacaatctatccaaatacaaaaatttggctcatacatagctcattgctaacatctatcatcacttgtacgtaatgggcatccatgtacatcatcggaatttttttccccaatggtttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatcgcggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattctttttcttcttttaagatggcatccggaggccgatgcgagcgccgcgccggcggagagggcggccgacgggaatggagcgacggccggcaggagggagggagaggagtggcggccggcgggtgggagggagaggaacggcggcgcgcgccgcgctggcggagagggcggtcgataggagcgccacgagggaggaggcgagctcgtcggggcggccggcgggagaagaggcagcacgcgccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacggcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctatcaacagtccatggaacacagtaatttcacagtacctacctaccatgacaagtcataaatatttctaaaaacattccggtgttccaaatggcacattaaatcctgaattaatgtgcatgatggatcaatgggacagatctagtacatgattaatatttcaaaacaacaaatttatctgatctgtaaaattatactcctactcctgtttatttcgttacggttgtctgcatgcagtgtgatgcttgcctgtcatccagtgattattgcagaagcagcagcagcatcacattcacatcccacgttggcgccgacatcctgtgcagcagccacatgcgcatgccaaaaccgagaggtattaaaaaggagattaacttagcataaatccaagattaaatccgtttttgtatgcgttgagattggtgggaggctgggagaaagcacatgctcaccaaaccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgaggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaattgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaatggcttcgctggtacccggggtccttctcaagctccttcagcacatgaacagcgatgttaaagttgccggcgagcaccgttcgtcccttcttcaggtggtcagcattgttccggcccttgcagggagtgatctgtttaccaaccagggtttctatctcaaggtgtccgattcctcgcacgcaacatacgtttccttaccagaagagcagcatgatctcatattgagcgacacaattcagttgggacagttcatccatgtagaccgtcttgaggcagccactccggtgccaatcttgaggggagtcaggccagttccaggtcggcatgcttgtgttggcagtccagaagatcttgtggtaacaaactccacttttctcggaagtaagaaggcacaacaatccatcaacgggtcaaaggatgccagtactttatcactagaaaaggagcagagcaaattggagaaattaaaaccttcagtgaaaaacaatggggcagaaatcaagaaaccacagttaaccaaatcaaactcttctctctcgaaacaagcattgaatagcattatagacaagaaggaagtagtcagctcaaagacaaaacctaccagtgctaggtcgacaccttcatctccgaccagcgtttattctctaccggcatcatttgagagattctcgaatgacataaagcagagaacaaaatcaaaaggagcagataagtcatcaccttctaggctttccttgttagagaaagctgcttctgttttgaaggctactacagcagggaggaagtcctctgcaggtaactggcttagtaacaccatgtcaagtattgaatcgggaccaaaggccctgagaagaagctgggaagggaatgcagaagcaaagagcaaaggaaattcagattcaaaggcagccaaaactgagaaaaagtctgagaatagaagcacatcggtacgtgcggttgttgtcaacgcttatcagttatatttgtctacaaatgtggcgtgatttactttattgagtatccttcatgtagtacttaagctattgccttaagcccttaacacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggacaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaaggaccccgagccgactgacatagaggcaaacctttcaaaagaaaccgggccagctgcagaagatcgtccgagtgacaaacaaccggcaaccgacaatgtagaagccagcaacgagcccccgactgggaaccagtcggccgaaactgaagtcggtgctaaccaggagcccccgactagaaaccagtcggatgcagggtcaagccaaaagattcccgaagttgaagctcaaacgaacagtccgctcgggaaggatgctgacaatgaatcagaaaccagatctcctgtgaaggcaccaaagtccactcgtccccgaccgggaatcatcacaggtagacatgccatctgaaattattttgatccaacagactttatttggctgcttcatcttcgttcatggatacactagggccaataattggtgatgaagaagagatcctccggatacaagcagctgaggattcacaccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatctcaaccatcttgtttgccatttaattcatgcgctaattaaactgtcttgcagaggatttatcttaggaacgaagccaaaacggtaaccttagagaggttagtccctcatctcgggaccctcgaagccaccaggaatcgactgcacgaagcgaaacaacttgccaggaagaatgaacatgatctgagggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgactaagccaaagaaatcaaacagggcaatgatacatcaagaattgggggaaattttttaaccccccaatttaagtaagcaaattgaattataaaaatcacactccattattattatagtagccccctgactgaaaacttcaagaaaaaacttgaagttagcagtcaaagaggaaagatacaacgaaatgccaagcgtaaattacgaaggtggcaatattcaagaaaaaaaatttttttggggtttttttgaaaaatttgggaaaaaggaaagggtacccgttctttcgcgcttgagtcgataagaacccggccgagtgacttcagcaattatgaacggtccttcccataagggagataatttatgccgatcctgtgttgtttgaattttccgtagaaccaggtcaccgactaaaaaggctcgcgatcgaacattccgattatgataacggcgcaacgcttgcaaatatcgagtcgactgaattaaagctgcttctcgggcttcttctagtcggttgatgttgtctactcggccctcttcatagccctcctcattgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcataggggcgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaacgctccgccaatgaattgagtgccattatcagtgatgatccgattgggtaccccaaaccgatgcacaatgttgatgaaaaaatctctagctttatctgctgtgatcgtaatgaccggtttagcctcaatccacttggagaatttgtcgatagtcacaaagagatgcgtgtaaccgccgactgcccttttaaatgggccgaccatgtcaagcccccagaccgcaaacggccaggacaacgggatggtttgcaattcttgggctggcaaatgagtttgtctggcaaaaaattgacaaccttcgcatgtccacacaatcttgtccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagtttagcttcatgaataatgtaaagtctgctgcgcctggaaatccgctcggcttcatttttgtcttgagggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaaggctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccattgccccgtctttttccgaactaggactgggttagccagccagtcgggatgaaggacttccttaatgaagcctgctgctaacagcttggttaattcctccttgatcgcatccttcctgtcctgttcaaaacggcggagtcgttgcttgatgggtttggcgtcttccttaacatgtaaagagtgctcaatcacctctctagggataccaggcatatcggatggtttccacgcaaaaatatctttattattctgaagaaaggtgatgagcgcgctttcctatttacaatctaactcagcgcctattacatcagtcttatcaggatcggagggatctaggggaatctttttcgtcttggcatcactttcttcggtcttcgtcagcttggttgcaggcacttctcgctcgcttgccgtggtcgcagccagtcggatctcttcgcgggcgagagcagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagggtaagcggtcggttaccctttctcaaagggaccagttggtattttgttctggaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttaggtgctgagattagcattgattagatgattaacatttactaatctcatcgctaaacatgatcatgtatgtaatcatgcatagctcaagcagggttgaaaacttgaaatgttcctaaccagaaaccagatcgatcaccctggcaagaaagaaatttcaggtaaattttttttaaaaaaaatcgatcagagtaagtacattttcgaggtccttctcgcagccggcgtcgcagagcttgggcttctcctcgggagccagcccggcggcgagggcatcatcgaacgcggccaggccgagcgccagcgccgacgatacccccacggcgactccaagaacgctcctcctcggggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttacaagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgagtattctatagtgtcacctaa

SEQ ID NO: 37513 - DNA, 667 bp, Oryza sativa
  unsure (1)..(667): unsure at all n locations
tttcttaaccggcggatgataatcgtcgcgcgagatgaaggaaccgaagcaagctagggcccgggaacttcagggacaggaaacgacggcagttcacgtgcgcaccgcgtcgcccggtagcccctcctcgcattcagtgcacccacctcacgggaccgtctcacagcactctgcaccctgcagcataccgggcaccacgcgaaaacacccgaataccgcaccttccaaacctacgataatcgagcagtcacttcccaccgttgatacctatgtctcgaattagtccaatcatgtgctcaatgagagactgttctgacatcgtcgtcatcaactggtcttgggcatggacgagtaaaagcgacatcggcagcgagccgttgagatcacgcgtgatgagctcggtctgcatatcatgggctttcttcaactgtgtgtccgccctaatcatgcactgttcactctcagtcatctcgccagcccgtgctttgtcaagagcctgatacagcgacgcacgcgcctcaccagcgctcgtgatgatggtaaaaatggcggtttcgatctctggcatcaccgccccaccatccgggctgtcactcccacaatatgaagtcatgctccaccttctnnnnnnnnnnnnnnnnnnnnnnnnnnnnnnnnnnnnnnnnnn

SEQ ID NO: 37514 - DNA, 620 bp, Oryza sativa
ttgaaactgcttctattgaaatgctgaaaggaatatatgtgcatgtgtggtagcccccggctaaccctgcacacccgaggggggggtgcggggttagcccgagccaaaacctgacacccgacccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccaaagcaccgctggcaactcctcgatccatgaatcgccgtgct

SEQ ID NO: 37515 - DNA, 639 bp, Oryza sativa
ggggctcctggcgtcatcggacaagcgggcaaagggccaactccggtcgtcaggggccttaggccaccgttcggctcgggggcctcttctccctgctctctcccgggtcgaatcggtacagggttagcctcagggtcagagggtgataggtgcggcctccccgcagtggcctcggggccttcctgtgggtcgggggcacccggcaccgtctgacaagcgggcagagggccgactccggtcgtcaggggccttaggccaccgttcggctcgggggcctctcctccctgcctgctctcgggcctagtcggcacagagtgggggtgcgcagaatgaggattgtcctcatcgcgctccacaaccaacgctgcactaactacttggggggtcgctgctaaataaagagcaggggctcatttggctccggggcgactagaaccgggggagagccgagatatgcctttaactgagtaagggcatgttcagcttcctccgtccaagtgaacggccccgagcgcttgaggagcttaaacaagggaagcgccttctctcccagccttgatacgaaacgacttagggcggccatgcaaccagtgacgcactgcacgtccctaagtttgctgggggggcggggctgcagga

SEQ ID NO: 37516 - DNA, 8797 bp, Oryza sativa
  unsure (1)..(8797): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgggggaggcggcggcggtggcgagagcggagcggaagcgcaggcggacgcggcggcatgaggcgagcataggatggggggcagttcctaccagctgcgatgtgatgttcgattcatgaggaggacggtgatgccggaggcggaggtggtggtggtggttgggcggcgccgccgacgcgcgggctgtggaggagcggtggcggcgccgacggtggcggagggaggcaggaagcggcgtgtggaggaggaggcggcggcgccgcgtcgcgcgtcggcgtgtgggcgtggaggaggcggactggcggttgctgggctggatggttaggtttttcggttaattgtctaattgatgggctgaatgggccagtatagtgtgtcttatggccgaataaaatggaataagttcatcataggtcccttaaccgaatccgattttcgtccttcaactggaaaaccagatcgggtccctcaactatcacacccggtgcagatgaggtccctcagcgttttagatggcggttttggcagacgtgacgcttagtggctagtttgtctctgtcttcatctgacgtgacgcttacgtggcaattcgaaccggaaaagtaataaaactcgtgggacccacggatcagtttcacacataaactaataaaaaatagtgagccccacatgtcatcctcactcccttcttccctctatcccctctctctcttcttccctacaatgtggactggggcggcgggcggacgagcgcaaccgcggccgaagcagcagcgcacgaagccgacggggcggtggcaatcctccgccgacgccgatatccacagcagaggtgcgcgtcctcctcctccttaaacccgtcaccatcggtggccgtcccccctgggcctccgcccgcggctcctctccttccgtcggccggcaagcaagatacacaaacaattagcagaaaggccgaccctatcggcatcggcaagcattccccgatccaagctagcttctaccaaacatcgactcagtggatctcaaggatgtgtccgaccagccagattttacttaggcctccatccaaacagtctctaaaaccaccttctacctatggcctgtttggcacagctccagctccacccctcctggagctagagctcagccaaacagttttagctccaccaaaactgagagtggagctaggtggagctctctcacaaaatgaactagagttgttgagctgggtttaggcagctccacaactttactccagacccaacttctagagctaaatttaggagttggagctaaattgagggcttgttaaatttgtttggtttaaataattaaaaatgtcaaatgtctggtcgtgtaattcggatcaggagcgaatccagaaaatgaatggtaggagggcttgtctcattcctcctctaagggcatctccaacagcttccccaaatcgaactctccaaacactcatatagccaactctccatctgatttagctagtcaaattagatactcactccaacagactctctattaatcctctccaaaataaaaatagaccctcagcctctaccatcttctttctctctctccccccaccttccttctctttccttctttttccccttttccttccttcccgtcgaccacgttgatgccgacggtggctgacacatgacgcgcggtggtgcagcaacgcggggaggcggaaggcggtgcggggaggcggcgctcgctgaggtgctctccctctccctttgcggcgacgaggcgacggcggcggagctcggagcgggatggcgatggcggcggcggagctcggggtggggatggcaaaggcggcggctctccacaacgacgacttggcgaggcgacgacgacggcgaggaagatgcagccacgacagcacatgggcagggatggcactggaggcacatggcggccacggcgacggagtcgagggagaggcgcgggaagccgcaaggggtggccctctgctcctcgccggccttgcctggtcctccgccgccttgtcgccgtggctccgctggttccgggaggcaggggcgagagagaggagggagggagtgaggtggagcgcggggactcggttccaggcgatggtggaagggggacggcaggggaggcagggcaaaagaggcgctcgcgcctccggtccatttcggcggagggcggcgatggaagcagccgaggcagcgttgaagagtttggggacagagagaatgcgagatgtgggaagaaaaatatggttgtgggtcccacaatcccacagttggagagccagttttggctggccaagtttagccacctagggagcccctttggccaaccaaatagcttcgagagtaggatagccagtatgttggagctcgttttttttttcaaaatttctaaattttagtttggggagtgaaatagctatgctgttagagatgctctaagcccctactctttttctccctcttcttcctcctcccatatctccctttctcttaatggtcattcagcggggtagggggcttgagctcctagcacctacgctggatccacctctattcagaccgttacaatctctacggcaatagttaaggggcataatttagactttttctatatttttatcctagttctaggttagaacttagaaccaagcaagccctaaccatgcacgttattattcacgggtaaatcgtaatcgtactctcagctaccaaaacagttaacgtgcagggcaatacaggttcaagaatcaagagagagaagactaggaaatatccgcacaaattttttaacgcgagcgatgcggagttaggccaagtaatccacgatctccacgaaacagattgagcataaatatgggttattatttgcgaccgcgttcgttgaaaccctacaacgatcttaattaggagtggtacgtaggagtagcgcgctaacctcttctcatcccatgcagcacgccgacgacgacatgccaacccaccggcggtgggccgacctccacgccggcctcgtctcgcgcgtcgccgacctctgcgcgctccggggctacgcctcctgccgcgccgtctgcgcctcgtggcgcgcggcgctcccgccgccgacctcgcggccgctcgcccccgtcgccgacacggcgagccgccacgggccactgtcgctggccgtctgctccgtccacgcgcagcgctggtcccgcctcctcggcctccgccagccgtcggggctagccaacgccaccggcgccagccgctgcgtcggcgcgcgcgacgggtgggtcgtcctcgccgccgccaacgcgaagggcgccgccgccgccgccgcgagcgtcgtcctgctgttcaacccggtcaccggagtggagatcccgctgcacgcgtcgctgtacgatcccaactgcgagcgcgcgccggcggcgtcgacgtcgccggcgccgaaggtcgtgttctcgccgtgccccacagcgcgtgacctcgccgcggtgagcatctgccggccgaacaggctcgccgtccagaggacaaccgacgggcactcctccgccctcgtcctggacaccgccgcgctcatggacagcgacgacctcgccgacgtcgccttcgacggcaacggcagggtggcgtactgcctgacgaggcacggcgccgtgcacgtgctccgcctcaaccgccgccgccaccgcggcaggctgcgacccatcgagatcgagccactcgtggccggcgccgtcttcccctcgccgtacgacaccatcgcccggttcacggacgccaagaacctggtgctctgcggcggcgcgctgtaccaggtgtggaggcggccgagcggcgcgggctccgccgtcgcgccggccgggatctgcgaccagcagctgctcctcatcccggagggcgccgtcttcgtcctgaggtacgagccgccggcgtcggcggcggcgggggggagccgccggccgccgtgctggtcggagtcgaaggatctcggcggccacgcggtgttcctcggggcgaacgacgccgcggcggcggcgcgctgcggcgacggcgcggcggagctgatgagaggcgactgcttgtactactgggccagccgcgcagagggggactacgaggccttcgtgtacagcatggcggacaggatgtccacgcggttgccgccggcgaccggtggcgtgtcgagcccgctttggtacttcttgccggccggcgcggcgaacgtgcaagcaacgacgacgaccgctatggaagctgcatcagaggaagtgagcgtcgcagttattacagtataatttcatggttcatatcacaccggtctctctatataggagtatgtgctagtactagctactatcttagcttagtagcttgttaggatgggtggtttgatcattaattagccaagagttctttgttttttttggtgcgaactatgctagtatatatactatttatattaagcttcatgttgtcattttgggttcgatttactgtatgcttgctcaaaagtatgcgtgagcacgggaagagtttatcccgtacgtcctcgagggaactttctcgtgtttttctatgtcgcccaaaaaatcgtcaaaaaaaattaaaatgatttagtaagatagattagtatagtgtgtatggcttcataaacattcaagtcatatttaacatatacaagtagacaaaaatatgacaaatttgaccctaaatataacacataattcatggttaaatttattattttgcttgatcaaccttatcattttttttcaaattcttttgatattcttttagatagcatgcataaaatagggagcgtcctctcgagggacaaaaatcaatctccacacgagcatattaattgtcatgttgttagtttcgaggtcgattaatatattcttttcttatataaaaaggcatactattagttcacatgggatacccttacaagcatcgcatagatggcgtgatgctgagcgtagtgctacaaccaaaggcatatcactttcgatggtaatactgaaagcaacttaggtgttccaaaaaagggaacgggaacatcgtcttctcgctattgttctttgtgttcctaaaagggaacataaagcaatgcctctctttacgggcttaaggtaatgaggagtgtgcgaaggtagacaccaaaggcagttaagagtgctaaagtgtttaggagtgttgttagtggcacacaattctcgatatatagaatcaattattctctatccacctttgaaactaataaaaattcactgaccattattggtgggaatatctttacaattttgatgactatgatttgaactttacttgtagatccagtgagttgggcttctctagttgaggcatggattagggcatgttggttgcagccctggtggttttgtctgacctgatatgcaagcctgaggtccgcctatagcttgtttggttgacctcctggtgcactcgctcagttgtctaacttgacaaccggtccatgttgattagcctggctcaggccaccaaattgcaacgcctcactcatgcaactaaggaggcaagggagataaaggtgatttggtagctatgggtccaattataattgctttcttactgatctcctcgagcatatgtcttgaaccaaacaatctcaggcaacaagtcagggatctatcttcaatttctcctgctagcttcaggcgttggttttcgttaggcatttctcttaggtcagcaaccaaacatgccattagttttgaacccgtgatacctctttttttttaaaaaaaaaaaaactctggttttggtcttcactagttgaagtcggtcatggcatcaacctaatcaatattttcttcttgaaggcatcacacatgagaattggtaggtaaaaaacttgattttaactctattgattggatcgggcagtgacgatgcaaattatatacttttaaaatgcatttcatgaaaccgagacttcaaatacctctttgttgcgatcttactttccgcttacacttggtgttgagattatagacatataatgatttaatctattccataaataaatcatgacattacagatgaaaactagcatgaacacatcattagatctatacatgtaaactacacagtataacatgaacagatcaaatatgcacaacatattgaacacgtaccgaggtgacggaaagaccggttgcttggtcgaaacttttcgccggtgtctacgaagacacgaaacacgcaagcgaagaggaaggcgagccgtcgcgaacaaacagggagcagtcgcgcgaagcgctttccaaataccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccctagattgatttcgcttatgttgcgtgaagacggcaggtcggtttatatagagaagggtcgcttgatcagggcgcccgcacgatctctactgcgcgtaaccgaaccggataagtcgcgcgtaactatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtatgtttcccctcttctctccaccacacatgcttcaagtggctaggagggcatcctcccttttaaggaggtccccctctcctagaataagtaaggtggtactaaactccacatgcatgccatcccatgaggtgggcttttgtgattttccaaagaattaatctttgagtgggctaaggcccattcattaattccaacacttggtttcctattggttgcgatggctgatgacaaggctatatattttctttcttttcaagaccggccataactttcggtgttagtgtttatagttagtaatggtgtaacctgtaatgcatgtgtatttgtacttgatgaaccctttttttattttttttatgatgttggttagttttttttagataatagaatataatatcccggtctttacttaaaaagagttacagtcaattattataaagtagcactctagaaaagagtgtagttcaaataaaatagaacgcacaaaacacacaaaagagtgaatcaaaccaaaataagaagaacacatttattctagcctatttgtgaatcaccatctatagttggtaaaaggttgcataacagtcgtctccatcttgcgacatgcaacttttagaaactcccaatcattatcacacctttgtaactgtgcccacaaccggagccagtgtgttgccctgaaaattacctgcatataggtgatagatgttgatttgtcaaaaaccatatcatttctactcaaccatagagcccaacaaattgcagaagctccaacaagtatcagttttttcttttccttgtcaacacccaaaagccaccctaaaaaatataagatatacttgtaggaagattaaaaccaaaagaaaactgaactgctctccatatgaactttgcataatgacaataaaaaaagagatgttgagtagagatatacttgtaggaagattaaaaccaaaaaaaaaaccgaactgctcttcatatgaactttgcataatgacaatccaaaaagagatgctgaatagactcatttttcataaaaaaaacaacacctcaagctgccattccgattccgtctcaccaaattatctttagttaacacaactcctttaagtaactatcacacaaagattttaatcaatggtaaatattttgaatgggagggatcggagtagatgacgagtttataactcccttatatagaaaacaagtttctttgaggtcaatttctgtaacttgcaaaagtatttgatatgcgtacgtgtttcttgtttttatgtacataaccttgctctgacgagttagcttcagctcagtctgcttagataagcatatcgttgctacgacagctgcaattgcagccacaaacagctggaataatattttaagatgcgttgctaaaataacctcttatatatatgcttatcttgcttctaaccaagaaaataagttatgaagaacaaataccaagtcggtttgacttacattagccaaattgtaagaaagtttaacccaaatcaaacaagcaacttttctattagtattttgcaaataaatgtcactcttacatgacaggaaaaaaaaaactatcttataaccgacgttgtcaatatgactttgattttttttcaccttaattaaaagttactactcacttatagactaaatactcctgaagcatttcttattactccttaagggcctgttcacttttggcatgttcactttgataccatttttaagcttaccaaattttggtaaagttgctaaaaaa

SEQ ID NO: 37517 - DNA, 9888 bp, Oryza sativa
  unsure (1)..(9888): unsure at all n locations
tgctaccagaaggcggcggagctagggcaccccgtcgggatgtgcaatctcggcgtctcctacctagaaggtacccccggattttggcctacgggatcaatagctttcttggatactcgatcgagactgtagccgaaagctttgacgaatcttaggacgaattgggtttgctcacagcatgattagaaccattcgtgtttagggcaaagttttgaccttgctctgtcgctggcgtttgtctttttgtgattcttttagtaacctttaactcaagtctgattctaaactagcaggggagaaacctactgggttgttgttgttgctgcaatcatattcttcatctcaacgaattgcaactgattgttgctgccaaatcattttttagctgatccacccaaggctgaggaagctgttagatggttttatccagctgcggctgctggcaatgctcgtgctcaatacaacctgggcctttgcttgcagaatgggaaaggaatcaagcgtaaccagcgggaagctgtaagatgcctcctcttgttacatttacatctgcatatcgcaaattttccccgaaacagaaatacgcagttactatagatgtatccaattgttgaaccagcatcatttattctttgttgtggtatcttgtttctactcctacaagctatggactgtatgaactaaattatagtcaggcaatttagagctgtacgatttagggataatttaccaatttatcagctccgttgtggttttttagcgagttttattttgatctcacattccattgtttacaatgtgatctatcaaaactgagataaccagagtttttgacagaaaggagctttttgatctggttgggtttccctaccgatgtactcataattgcaccatcatgatcagtctgaatttgctaaattggcggtctcaagattaccaccactgtagcgcacaaagttgactgtgtgctttattgccttgaatctgcttgtttaaaataaggaactttgcaaatgcaggcaaaatggtacctgcgagctgcagagggaggaaatgtgcgagccatgtacaacatttccttgtgctacaactatggtgaaggattttcacaggatcaagtgcgttcaaagaggtggctgcaattagctgctgattgcggtcacaagaaagctctttatgaatgtggtattaaactttgtgcggtatgtcattccatttcacctaatgaatgaatcatctaactgtgtggaaacaacgtattaattatatattccttttctgttagccaccatgcagttcttccaattgcacattttagtgcataagtttaggccatgtaataaggtaagatatgtaaatacttgtcataacggtttggttaagggcgtttcaagaaacagaatacggtgtgtgtgctattttaaattttaaaaagccaatatctttaataacagaattagtttgaaattgccaaaaacttgtatgtttgtactgaagtagtatcagctgtataacttatgtcatcgtcgttcgtactattcctactgcttcatcaatgttggcgtgttatgcatttacttatgccttttttttatgatgattcttctcttatttaggcaggagacaaggtgaggtctcttatgtatctagagttggcgacgcgccgtggagaagctgctgcctcacatatgagggatgtaatacttgaatcactttcccttgtgaatgcgcaacgtgccctgtcagatgcggataaatggagaccaagagcactgtataccagaagatgagcaaatgggcccatcacacgtataccaagttaataaccccttgatgccaaaagtaaaatggaaattcaccacctgaaggcccaagtgagcaatatgcatctgtggcatactctagtgtatgtggaactgtgtatatgttaactttcaagcccctctctccttttcttttgtacagaaattatgacagcagaaatactgttacagaaggtcaagtggcaataatatccctgatgcagcataggatagaactttatagttgaattgtttcagattgtaataaataggaacaactggtgtttttttttcgctgaaaaagtgtggatgtaggtccaatgcagtgaaaagtaattctgtgatcagctgttctaaattgatggttggtggaatttgcctttgtgaaatttgaagggttaagggaatctctgtgcgactgtggcccatacattgttgacggcaatgtactagtgaacaaattctaggtgattttatcgtgctatatagtcatctccagatggatgttggttatgatcgcatcaaattcatcctttggtttctattttgaacatcagtcttccctacggtgcatcagttccaatttagctcaaccgttttatgcacatggctgcttttgatctgcagatgttattgatgtcacaataattgtactactaaacggtaccgtatgtctagttgagtctgcagttcccatcgcaatcgctgtatacatcagcaaccccacagaatctgcaaactgcatctagtttcttcacagagaaaatgataagcacatgacaaggctgtctaacacgcgcttttattaatacaggcattaacgtcagccatcccaaatttcaccagacgtggctcaagttcacaaatcaaatggcgcaacaggacacatttcacaaatcaaacagcgcagcaggaaagtcataacagtacagaacacaggaataacaccatgggagtagcttttatttggggcaatatagtgacgagaagcatacgtagcagtgacatgccacagttgcatttcttcgaaacgaagagcagcggaaagctcttcagagcttcgagatgaggccgttctggatggctttgggcgactcggcttccttgatgtcagcgtcggaggagccgggaggcacgtcgaccgccggcgagcagttgaagaacccatgtggctgaaaagaattaaacaagacacaaacaggctttgagctgatactgtaaaaaccagaacggtggaaactagagaagtcgtctgccaaagaggagatatgaaaggctacaagagaaggtctttgttctaaaaaaaaaaaaaggtctttaccatgagcatgaagccgatgcgttccactggcatgacaggccagtcctccagccttgggatatgggtgagcccaaacacatacctgcagatgcagtgtatagttaacaacaatattcccagtcgtgaaccgaagaaagttacacagatgcatcgtagtagcaagtataccagagaacaatgtcagtttcctccaggggcctatccttcttgacccaggtagctaagccctcgtggatacgtggattctgattggggaactcccctccagggaacacctcgtcgctcttgtactgcgtgacccagagattgtgcttcaggaaacccgctctcctcagaaactttgcctcgggtagagccagcggcaaacagtttgaaccaggcacgagcctgtagccggttggctgcccagtacgattaacagcccttgtgttccttacctgatcagatgtcaacaatgttaggtaggaaagaaagatcggtatgtatgatcagctgccacaacacaaaataatgttctttactctgagagttagagttgtggcctaagctatctgttattaggtcaagagtaatgcagctaataagtgcaaaataatagcactgctataaagcagcaagtcaatgcgtcatttctgaagaaagaaaacaatgaccaggtactggaaacgttatcatggtacatcaacaccggcacaatataaaagggatgatactgaaagatgatgctcttacgatccaatgccgtgcagatgaagggtcacaatctcgcattgcttgcagctcagatttcagtagtttttcctcggcatagaaagcgttgttgtgcacattatgtgtgcctgcattttcaactttcacatttacctcaaccacctgtgatagaaagcaacatatcagactatcaatacatgccaagttcaagcaaaaggccctactactactagaactaaacttcaccactgtagacaagttacttgtacaaacagcaggtctaaatcaaagtaacattatgataggccttattgtggaactaggtggaaaacttctattcagtatatccagcaaaactttaattgaaatgcataaaaagcaacccacctgattatgagcctcgttaggtttacaatcaacagccatgtccatacgggcaacaaaaaagtgttggtgaacaggtgcatacagaccaggagcaatggttgtaccatattttcttgattccccaggcatcagagctcccaaactaagaattccagtaagttttacttctgcttctatcttgccatcctatatccaacagaatgaacaaataaattatattgcaaaaatatgtggtagcagaaaattaaagcatcaaaaaattcattaaggaactaaattcagatatgtattcactatctcatgatgtttgcaacagccaaatcggaaataattcatgcataaccgtaccaaaagctacagaaggaatatcagccttaataggttacagcttaatcgttgagggcattataaggaatagtcagttgaaacaattacntgataaaagtgccagtaaaaaccatattcatagttggcaactgtgcagataaatgaaacagtaagcctccttgacctcctaacttctgctaaaccagttctccaatcctggtgtttccaaaggattccgtggtcttcctcatgcaaacatacacaattctcaattgtttccacaccacccgtaaaattcgtgaagtgtgcatcaaaatactttatgaaacctaaacagtcacatccctacaaaaaaaaaggcatataatagtcagatgaaagttaaaactctctggaggtaaaaaatcattaagaactgagcaagcaccctcttaagagaatgagcattcttcccaagtccatcttctccagcatcaaaagcattcttgcgataatgtggttcattgggatctccataaggaacaaccatctcaacaaagctgagcctatgagctatcggccgacgtccacggctgccatcaacatatgcaacagaatagatgaccaaaccctctttaggggtgaagccaatacggaagttccactgctcaacatcattaaaagtgttattaattccagggggaaatatttttttgtttatctcatcataatagagaaaagctttacacaacaatgcaccttctgccattccacaaaatatccgttaatgcggaagctcgggccctcaggttgattgataataagaggtttcaaatcacttcgatcaacaccacctctcgtttccccaggagtgtagtttctcagatgatctggtggggggagaggaaccaacttcctatcttcaaattctatgacaacgttattctgcatatcaacaataacatggatcccttccacaggacgtgcataaccattctccatgggactatcactgtcagttctgcaaaagattagaggcttgccaagtctgcggctgggagcatcagcatcactgtagtagccagcacacctgatgatttagaacaatgttcacattatcattttccatatgatgattctaagacaacaaagccagctatgagatataaaacaaaagaagtttcctaaagcttagcttaccaggcatctaccatgacaagttccatgtcatctacacctcttctcttcatagcttcaataaatggaggatagcttttgacagtagcttcacattcagcatactccatagcatcctgtgaaatatagaaatttgaactgagcgctccaaaaggttctaaaaaacttcaaaagaaaaaacagttcaagctgtaatacaagcataaatatcggaaaactaataaattgtgtcctaaaagcaatgacagcaaacaattcaagctgtaatgcaagcataaatactggaaaactaagaaatcatgttctacaagcaatatttgcagagtaaatttaaatgttgtcttgaagaaatttcacagactaaatgattggaaaattgggacaaaacaatcaaaggaaggaaaaaaaaaactaaacaaatttattttaggcaataccattgcaggctgaacttctggaacaacttcagatgatatcactttccctctgtgatgtccacccctagtagccgcatgcacctcagagagttctactatccaaatgctagtctcatttgattgtctattgtagactgtgagcttggccctcctagggggcaacctgcttggaatgacagcagagccttggttctaggaagcagtgatggttggaatggtgggaaaaagtaggcatcagctaatgccacgacattcttttctggctccaatagcaccacttcaacaaaacgcatgccatcacgttcctgcaaattcagaaacctctatgtcagctccttttttttaaggttgtagacaaaagtacatggaatattattttgacgaacctcaggcgattttccagcagctcttacagttgctatagccactgcaatttcagcagcagataatggatctaaagggtggcttctctgggctctggtcattataggtatccctgccattttgttccatccagcagaacattagaaacgggtaataataatgaatataattcaattaagacatgtatgctgaacaggtcactcaaacaacttccaagaaattacaaaaatatacatgcatagaccaacaacaaataaccaaactcctgcatgaacatacagacctcttcaataacataggtcaacaatcgataatagataatttggcaggtcaagtagaccatgctagatgtgcttatcaggaaggctaaagaagcaatacataattttttttgaacgaatagaagcaatacataatagttaataaaaaagcagttgttgacctatctgaagatacagataaacaaagcagcggtgacatgaatcttagtacattacagtgcagatatattcattattgttctatcaacttatgtcccccatcttagatctagttgttaacaggaaataaagtcccttatttatacaccacatagacatgattggagaattgtttgatctaattagacgaacacgtaggggtatcaactgcattactgtaaatcatcccttcatgtaacacagttaaaattaggaaggcacgatctattttgaagttaaatttgacgaggtagagtcttaagagactaataattcttctcagtaacccctgccaacatcaggtgaagtattacaccagtgttcaaccgttttcagaaagtatatctgttcaaaaaactgaaaatgactgtctgtctgtctttttagcttataaactatgaagcagaatttgtctaatgcgtaacgatattttggatgagatgagaatcaaagattatgctcagaatcttaataacatttggatggccttttctacggccatcccggcaaagaatagaagatcgtgcccagtgagtttcaaaggaaagcctatttggggtttgctacacaaaaattaagcgttcaacttacgtacactgcacttcttcagcatcccgcaagcattactactttgtgatggccccgtggaccagcctgcatgatcagcttacgaccagtgcctagtggcgcatacagataaagtgcagattccatattgctgatggccccatgattcacatagtcaacaagcctattggtccatcgctgtacgggcatcgttatccatttcagacattttactcgtttccctatatcaaagaatttattggcccatcactaaacagacatcattatccatattcagacattttccttgtttcccatatcaaaactcaccatcaaccaaaaactatggaagaagaaagatagaagcgatcgctgctactagtgatcaaagaaaaagttgaaggttgcaacgcacgacgacaaagcagaaagccagaacagtaaacaacaagcccggactaccggaagatatgtgacagcaagtcccacaagtaggtgtcgcaacatcacgtcatgcccccatgatccattcaccaatgatgttgacatggagtggggacaacctcttcttaattttttctttgcgggggacaacctctttttaattgataatttgtttaaggcagattaatgatttagtgcacctatagatctaaacaaatacatatgaacagttcgcaagctataatctgcatactctgcctgcatgcatcgatcgagaactacgattgagcaaacgtacgtaacgagaactgtccgatcgtacgcgcaaataaataaatctgcatcctctacttgcatgagcacgagaagtccagaactatgcactttgcacaaaactaactgactacatttcccgaactcacacctgagctcgcgaggaaatcatgatctcgagttctccacgaataccactgtcacgtaatcacgtccttatcctactgtcttttacgacccatgcacggcacggcacggcacttccgcaacatttcccatgacccaatcgccaaccactcacacaaatccaccacgcatcaccagcaaaatagcgcaaaatgcccaatccaactcaatcgagagagagagaagggtggagatccccgaatacctttcgaggagaccttcgcggtggtgggctggaccgcggcggcgatctcctccatcacggcgccgccgccacccccggccgccgcggcgacgcggggatcatcgcccgagaccatggagaccttcccagcagcagcagcagccgcgggcgccgcgacgatcgccccgcgtgacgacgacccggggccgccgtcgacgcgccgagcagccgcagcgccgccaccgccgcagcagacgacgaccggcgccttttcctgagttgcggccattggagcggattcgcgagctgaccgtgtccgtattctccgcctccgcctccgcctcgccggctcacacgatctgacatacagcacaggcctccgccctcccgcgcgccttcgtcctcccctcccctcccctccccccacctcccgcttcctcctcctccggcttctggggtttctacgggcttagggctaccgcgaaccctaggacgaaggggaaggaccaggccggcctcgtgcgtttcctcctcctccgcgagagaagccgacgaggaatggggaagagagagagagagagagagagagagaagccggtggcgagtttggaatggtggtggtggcggtggaggaggaggaggaggaggagacgggggctttgggttgttttggagggcgaacgcctcggggctcacgtgcttttataaaggcgaacgggggaaaggtggctgggcgaggccgcgaggggaggggaagtgggtgggctggattcttctgggctccctttcccgcaaatgctacatgcacgggtaaagctgtaccccacattgtgttgatcccggtatgtaagtttttcttctttttcatttatttccttttgagacgatccctccatgaaaagttggcattttcgccaaaacgccaataagaatgccttttctgtggtggtggtagttgatttttgttaaaaatgtctagcgacagctggaaattgatttttgtttttttttcctgggggtggtttttttttatcatgtctcgaaggaaattgaggttgatggcttatcaatgtcattgcaattgccgtgatggtatcctagtggtaatttttgtggtatcttttgtattctaaagaattatggggtgctttgatatgtccctatactcgccggtagctatcaagggaaataatgcaggggctgcaggaat

SEQ ID NO: 37518 - DNA, 4753 bp, Oryza sativa
ccggtagctatcaagggaaataatgcagaattgtgataactttttttcataatcaccaagtgctacttatggatttgtgttattttataaacatgtcagctttggatactttagtgatgtgattgaaattattcctttatgagatactagaagagatcattcgatcattccggatcctatgcaattgctagatagtgtgagaagtgatgagcctgaggtcgcatgaaacgctctatcaacatcgtacaataaaatcgggtagtacaaatggtggaatcatttgaaactattggatagaaaataaatggtcataactatatggaattgctattatatactccctacaccggatctccatttcaaaaaagattaccgtgtactttgacaatatttactatggttgttgaagtgtatattgtggctgcgcatccacaagttagaggatatgaggatcatcaaacttttctatagcccttaatcatttgtcatcttcattgccattgccgtgatagcatgttaatgttgtgtatcacataagttattgaaaaaactatttcgacgataataccataaagacgactcgattgtttttttagaataaagtactcctattaagcgaaagtatttctatgaactacttccgctcaataagtactcctacagagtactccttacaactattttagcgacatggcataaagtactcctacaaagtatcatttcaaaatgtattaaaggactatctcaattttaggttataagactttctagcattgcacacatttatatagatgttaatgcatttagtcacacatatatgtctagattcattaacatatatatatgaatgtggacgatgttagaaagtcttataatatgaaacggaggaagtaggatttatcacctttaggaagatatttggggatttgccgcctatatatctgtggtatattaatatgtgatctcaaaacattgcagatcttgaataaataatagaaccttacctttttgaaacagctcataaaaatcacaagagagcgtgacaataaataatgagtgaaaatacttaattggtctctcaaattaattaaaaaaaccggcaactaggtagaactggtcatattcatgcgccagaaagcacttttgtctgcgctgcttgtcatgtatcccaagaggaatattgcagcatggcgaacgcagacaccgcaacctaatcctaacccgttaaagtgctgagtgcttttgcttcacgagattactgcatcgatcgatcccgttaattacatactccttgtatactaaattaaaaaggttaattgggtgtgcacctgacagggtacgtgtgagtacgtgagccgtgaggcgcgagagcacaagcatgcgcaccgagctccgatgacaaggacgggagatgaaggcgttcttatcatctgagccggaagcaaaacgaatcaggatgctcgagcccttctcacgttggcatgcattactcagcgtagtactccagctaggtgccgagcggatattttgtaatgcgggctgattaggatcgactagcaaaaattactacgtcgacattacttcacgacgaaaatttttgtgattaatttatcaggtgccagcaccgtatcaatcaaagactgaatcccaggggagaagtatgctgtggtacgggtgagaattaccaagtatccacatgccaaccagcggcggatctaaaaattttcttgagcctcggcaaacctatcaacgggtgaagcatgcacataaaaccttgaccattaatcacaaacacaagtagatttggcatgtaaaatctgctttgtgctggttgatcatgcgtgttgggctctattagattgaacgaagcaaggtaatagccaattaggtatgtacttaacgagcaatatgttgtaggccatggagtaatacgctgtcgcaggtctaggagcctgggcacccgcccatgctggccgggccctggctccaccactgatgccaactactatagttgatacggagtatgataatttagtgggactatcaatatggtatttgacagaacacacatccattaaatgtaaattatggatcgttgaattgcttttagatttatgcagcaatgcctaaccctaatactttattctcattccctcagtcccaactcacaccattgtcgcttctccttttcctcgtgtgcacactccactcgccaccgcaccaagccactgccttgcctagttgactgggcggaaggcttcaatggtgtcggtgaggcccctcctttccccctccctcttctttctggcgtgagctgttcgcatgtcatcgtcttccatgtctctggcagctccccaccaataccattggatccaccaccaccggtcatcaccacttaaccaatctttctgctttgtccccaccgtcaacaccaggtccccactctgcttctaacctcgcggcttcggtagcaccattaccatctcatcgctcgcccaatccaccgcccaccgtggggctatcacctcccattgccatctccctagagctaacgaactccttcatcttttctcgttccccttcctccacccctgatcccaacatgggacctaaaagtgtaggtcccctactgaagtttggagtaccaccgatgccgaaaaagatcaggagattgtcggacccgaaggagaagggcaagagcatgaatcacgaagatggactttatgacgaatgatatattagcaattttgtgatttaatttagcaatttatttttcttataacaatcttgtttgtataggtggaccaaagcccgagcatcatggagccacatgtaatggctcactgttgcgggtaagaggacactagcatgtctaatgcacctttcagtcgattgatgctgacagctagtagttgtagcgaggtttgtttgtactcctattcataaatatattccaaacgtactagatacattttgttaccaaacgttgaaaatggtttataagaaggcaatatcattttgtattgtacttcctccatttcacaatttaagattttctagcattgcccatattcatataggtgcttacattatgaaacggaggaagtagcatatgtgatgtgaatagatgcttgcacattggaatatatgaaaagaaaaaaagagaccgcccaccaaccgattacactatcccaacttaaaatgagtgtgctaacttaactcgtagcgcaattgaaagagtttatttcaaaatgtttactagatatttttttgaaaatataaaattatattttgtccgcttaaattcctgcagtaattatgcgggagggatggcgaggtttgatggctacgcgtctatgaattttgaaaccatatggtgtattgtcaacaggggtgagatgaacaccatgggttggaattttggataacgataagagagctgtctgataggagtgggtgtgtatgataggagcacgcactactcgatcacctgctacaacctctcaacagctcagtgttactggagcactcagcttgaggagactgccacctccatcgtttgtttattttttattatcagccataaccataaaattaattcaaaagttaaattctggttaagtagtatagtagataacaatacatatataaaaattttacttataaactattatttttctcaacttacaatcagctatagacaaaatgatgtgctcacccacaacaactatttttcacagctgccgtaaatattttggtgactggatggctccacgtcaccatgggcccacatgtctgctgccttttccgctcacgggccacatcaccagggtccaccagggcttttgagaaaagcgtgggctccagcctccatgtcggtcgcttttagcagcagcagcgcgccagcgcactccggtggctttggcttcgcgcgagcgaggagaggtgcagcggtgtacactgtacagtgcgctacaggttaacgcagcagaagtgcaggcgaggcagggcaggtgcggccgccgtggtggtggtatccagcggtggagcaaccggcggcggcggccgattattggttcctcggttcacgggagtggtgaagcgcagcgtggccaccggccacgtactcgcgtacgtactcacgcccgcacgcacgcacgcctgcgtgcgcttgtgccactttggcgacgagttgacaactgtgagtccgcgacagcgatcacccttcgagtgtgttgggtggtgcaccgacgttgctgtccattatatcggccaccatttgccaatttgctgattgccgattgctacggatacggcactggcttttcggctggttaatcgagatgctctcctttaatttgtgattcgctaaaaaagatgaagaaaaagatatgcttattctgatccatgattaggatgcacgaacgcttaacaaatgctactgatcacttgtgtgtagtgcggtacagcggtaacacccttgccgtgatgaggaggagttcagggaggatctacggctcatacgtacggtcgtggtacatcgtgaggtgaagtcatccgctcaggccaaatctgcgtgcccgggcagctgcaactgcaatatatgatcactcaaaaaactttccaacaatgtcagcttgtggaagcttaagtgttcaggggtcaaaattaaggaaattccatttcggaaaagaccaaagcgagatccccataaaaaacgtctcatcatgcgtccacgcttggggctgcagga

SEQ ID NO: 37519 - DNA, 5087 bp, Oryza sativa
ccatttccggagagaccaaagcgagatccccataaaaaacgtctcatcatgcgtccacgcttgcatcgacgtacagtactacgatcgtaaaatattatgcttctttttcgaaagggcccggctaatgtcaccagttcaagtatcctatccaactccaagtcatccaaccttgctaggatgagaacgacacggattagtgcactcagcatggcatgattatgtaggaatccaatgctaactatactcgtctgttttatgatgccatcgagcctagcttgcttgattgatttcgatcaggatgatatgccccttcaaccactctatcctgcatgcttagtttgcccacactccaccctccacagtggcaaagaaagctgcgtgagcgtgacggcctgaatattcctttttaatttggccaaatgaaagctcagattcgcgatatacgtagacacgtagtgcgcctcatcatgcacgattaagaaaaggaaaacgccgagggctggtggtctcaaacaaaacggtgtgcgtgatggaacacgcatacgtacgtactactacattatactcgcttgctccagctttagggcctctttaaatcacagaataaacaaacagagaaatagaaaaaacataggattttgacaggaataaaagtgtaaaatagaggattgcaaaacacaggaaaaacataggaatgaccgtttgattgaaccatagaaaaaacacaggaatttagggagagataaagactcaaaagatttcttccatgaggttctagctcttgttaaaattcctccaaaacttatatgggaagaggcattccataggaattttatgggattccatagggttcattcctttgagtcaaaaggctttataggaaaaattcctatagaaataaaatcctctaaaatttctataaatttccattgaatcaaattgccttaatttagtcccatcgatatccaaaaccatgcgtacgtgtgcatcctgccatcagcccattctgatgcacggcgcaccgtcgtccgtcgtcgcgacaagccaatatgcacatataaacgaatccaccgagcaagccggagcacgacgtcgtgctgcatagctggatgcatcatgcctgagtgcgtttgatacgtacgtacgctcatccaccaacgggcccacgacaaaacgactcgatcgatcggtgaacattgctcgcgttgccgtacgtgcttcgtcggtagtcgtgggtggggtcttggtcaccccgcatgggtaggagctgacgcgtcacgcgtaccgccgtacgtgtcgtatcgtgtagacgagaattttttttaatgttttgaacttttaaaaacattaaaccattccaaaacttattattagaatttgaaccttttttatcacgtcaacctgctagatacaacgagcgtgataattttgttatgccacgcaggatggcgtggccagataatgctgtcacgccaaacagaccgacatgacagtgttccaaaaggtttagagtttttgaaaatgtttatttttaaaatttaaaatttgaaaagtttaaaaataaaaaaaaattgtgtagacgataacgacggtcgcgcaggcttggccgatcccgacccgaccaaccgggggcgctgtcgcatgtgaagtgggctgcgcgcgtgggattctcagtggccttttctggagtagcttctttcggcccgctttgctgccatgggccgatatgtttatttccgtcttactcagagcccaattcgggatatgtggtttcgtttccgcgggcggaagcggagagaaacggcgcgggccccggggagagaaccggcatttcccgctgcgcgcattgccggcgaggcgccaaaaccctaccgcgcgataatcctcttcctctccgctgcgctcccttcccagccggcggcgccaactttagtagccgcaggccgcagccgcccacgaaccgccggcgacgagatccgagaggaggctggccggggctgtcgatggcgtcgtggtgcggcgacctggctgcgccgccccgcctcctcgtcgcccctcgtgagtgcccctcctccgcccccggccatcgttgtgctgtctggtctgtttaggctcgcatgtttcagggcggtagtgcgattagtgattctaattccaaatccccaattggaagcatctggtagcagtagtttgttttcgtcttcaattttcaagattcctttgagctcggtggatttatgtggcttggtcgaaatgccagcggacttaaaaattgtgcgaactgaagattaccgcctgagttttttggttgggccttgggggtcttttaaacactggattacggagcaataagtgtatcacatggaggagcatcacatgcataaatgtataatcagttaatcacatcccattttgtgttttccttgcaggtccttctgatggcaattgtcaagggaatgttttgtctctccgccacccgagatcaggtgctcttattcctccttgcttctgttttctttgtcggttattaaatctgcactagtaatgtagactaatttggtagcctgttagcatctgaagaatagccatgcagaagtagattatcagcattcaacagttttgcattaactcttgcctcatcatcaaacagatgaagaaacagggtatctgttcatcgacggtcaacttcacgagttcaattggtttaaggagcgatttggatcttggttcttgggtgattatgtttgtgaaggtatggcagacacatagctatgcagttgtcatttctaagaaaaactttgtattttgcctttatggtaaggtttgtctattattatcttgtgtgggctataggaagacattttgataggaattattgccctgcctctgaaatcacccatttagattttgttagcaagtaattaaaatatggaatcagacagacatgttgttaaaggagtggtgctattcttgttctaacacagcaacataaataacttccaaatggcacaatctattccagataaagtttttgaaaaatatcgtactgcggagaaattcaatacctgagtttattgacctgctgtccttcctgacttcttgtagatggcagcctctactactgcacagttgttgatcccatttttattcttctaccaattttgaaagctgcacgtatgtcggtatgccaaatcaaatcagaaatatttctaatatgaggttcacattcaacatatttgcctgttgaaaatttgaaaagctagtccctcaacagctttactgtgctgcagaatggtaaagatccaggaaaatttaggcaactggatgaaatattgtatgttgaaggatatcctggatatcaacacctcatgggtatagcaggaaaccatattgatctggtctgtgaagttaaaggtagatgtttgacttgtatgtttgttctgaagttaaatgttatatgtagttaaatattatagcaaactgctgtcagaatgctgcctacttgtatttgtagtccggtgattgtgcggtgcatttttaccgcttcattaccttgctgaactgaaacacttattggatatggatgtttatgtttcatccgtgctttcctgtgtgttttcatggaagagaagttttacttaaccatctcgcatggatgttttctttcctgcagaagttgctaatgtgaagttctttaggctggacgattccaaggtcttatcttggttgtgctgtaaggttagcttgtgtcagtaattacatctactaactcgatttgcactatgctattccgctgatacttattcttatcagaagctaacccaccttttatctttacttgtccttttcatattacaaaagcaaggatctaacatgaagttagggtggaatgttgcttatgtgggttaggaaaagaggcatcttattgtttttagactgtttgccttgaataaggatgcaacaatccaacaaactgagcacaacattgagaatgttgatgggctaaaacttaattcttccacaccatgttttaatttatatttgtatataaactatgtgcaccaaacattagtctttaagttcactttggttttgaagatgataaataaagcatgaattgggaccctagtgaatttcctatatatttaagaacatgaatgcacatggtcattcttgtaaacgtccctaaataggtgtcagagggtagtggctgctattccttgactgctgtttgtagcattctgcctaccttatgttacaaccttctacaaccattataatgtacggtgtgttccagtactgtttatttgttgcatatttcctgccattttccagttgaacaattttacttcataaatttcatttaactatgttcttgcaaaaatatagctagcatgtgttgtgcccactataacaccactgctatctgctgtaccaacactttgccacatgctacatgcaactcaaaacatcatacaatatttttgcatgattaacctagtaatggctattgttatctgcaagaaacaaatgccactttgggatatcacttagattttttaaaaaattatgctgccttgcaaattcaaaataacagtttgtcttggtagcatcatgagaacataccagttcatgtgccctcataatttatgttttgatacgtcctttagctgtacttaatattcatgcctgtgaatttcgaatcatattgatctcacttcacttgttactctgtagtttcgaaaatactcttatgaatctcatatacaggttcacaatctaaaagaggttttccccaagctaggcaaaaattatgctgcccaaggagaaaaagaattatgtatgttgctgcaactctttttgttaagtctaatacaactgtattagtctattataagaaggatatagctccttgtaaacttatgtttctgtttatttttatgagtgttttatcaaccgatatccaaatgtacataaacattttaccattgctaactttcacaattatatggtaataaaaactgtttgaaaatggatcgtcagtgtgatttacatcctattggatcacttttgtcccaaccttaatt

SEQ ID NO: 37520 - DNA, 12387 bp, Oryza sativa
  unsure (1)..(12387): unsure at all n locations
ttcctgcagcccgcttcacttatatccatgccacaattagtgaatgaacatgctatttctagtgttccattgtgtgctaattttaagcatgttgttcacattgctaatgatgttgaggaacgtaaattgataacttctttaaatactttgggctatgttcagtttgatgatttttgtgagctcgataatttggaggagaaattatttgctaagtatgatttgccatgtccaactaatgctatttttaatatctttggcgaatataatgatagaggaatatatttggtgcatagagttttcattttttcggatttagagaaacatgttattgttaatcacactacttcgagtttctctagttttgattggatgaaacaggttattttgaatgaactatgtgaagagcaccatatgaaaaaactgaggacgattttccatgaagaaggggaggatgatgtgaccatggctactacggatacaaccgttgctcacatcatgatgaacaagaaaatatcaagatcaagtcctccatgtgctggaatccgattcggccacctgctacactgttgacttcaaacagccgccaaatctacatacgacctccattttcatcccgtgagtacttgatggaaagctctcggagtcctctttncaacngatctagcctcatcgccaaattccatccaagtcatccttcacctggttggggcgcaccccacatgggccttggtcccaaacgaagttacaagcccaaaggtccatgacaggtgacgcaacaccttgtttcttcatatgcggatgacttggatggaatttggcgatgaggctggatctgttggaaagaggactccgagagctatttgatagatccgacccaggtggggttgacctaggcccaataaattaaggttgcccgaaccccaacagttcttaggcacacccactcgggaaaatgcccaatctccctaaaagactagtccaataggggaagggtggcactcccttttaaggtcgtttcctgctcccaagctaagcaaggtgggattattcagatgctcacacggtcgccgcccgactacaactggaccacttggccccttgttgtgtctttgccagcggttaatagtggaggatatcctcatcatttccacccccttaaacaagggcccagctctaataccaaacgatagatccggcccaggtggggttggccaaggcccaataaattaaggttacccgaaccccaacagttcttaggcacacccacttaggaaaatgtccaatcaccctaaaagactagtccaataggggaagggtggctctcccttttaaggctttaaatagctaggtaccccttcagggtttcttgggttatttttagatgaaagtttagccattgctacttccttgcggtgcgcgtgtcggctagaccatccgtcttcttgtatttggaaccccaacttatcattcgtattcaatttctatttgcaatattagattgcttttatcttgttcttacttgtttcttcgatttgcttgcaggaatagggttgatttgcaccggcaagattaacaacccacggagaggtgaatcgatcgctaaggcgcaacgcaacgtcttgtacggttgtagtcgggtcgtcaacgtttcttccaaatcatagttatctcaactcaccgaaagatcgggccaacaacagccttgagtttcgagtggaactcaaggtacatcatagccacctcataagcaacttgggactaatctcctgtactcaagctcaataaacgcattagcccctttaaccatttagtcattaataaccaaaatccactaggggatagatgcactttcaatgttcactttgattcccttaactagtggccagatataattcgtatccttcgaccgcaatatcggatatctcaaacccccaactattaaagccagtgcattttgactttctcagtgatttcactgacatggcacatacatggcggtgttgacatggttttcgttcaacgtgacgcttatttggcattagaattaaaaaaatatgtgggacccatttgtcaaaaaatattgtggggcccacatatcatcatctccttcccttcttcctcctctctctctcctctcttaggacaatgatggcgtatgtttatgttcagttccgatccaccaccatcgccgtcgccaactgctgctctcctctgacccacgtccttctgcctcggctgatccttctcctccgccaccgtcgctagttgttgcttcttggtgaatatatctgtccacctctttgacctgcctcctccacccgacgccgcggcgaccggcggtgcccttgacgtgatggccgcacaggctcatcatcgtatgtgacgccaaggcagctggagaggtgggcgccatggtggggatggaggagggggagagggagggaggacgccgccagagaagagctcgtcggcgcaggagggggaagcagcgggatcggtgtcgaggggccagaagtgaaacttcggggaggatgaggaggaggcgctgctcagtcgcctctaggcgccggctacggccacagccattgaattggtgcatgactgtttcttggaaggaagatggggggagaggggggaatggtgaggctttgtacgggggtgatgtggcttacgggagggaagaggaggaggaagaagaataggggaggtgggacccacacacgccctcccattttctgatgcagttaagagaagattaattctaatactacataagcgtcacgttggatgaaaaacatgacaacaccgtcacgtatatgccagtcagcgaaactgccctatagagagaatcaaattgcaccagttttaatactttggcgtttgagatatccggtattgtggttcaaaatatgaattacattcggtcattagttaagggagtccaagtgaatttaggctcagatctaaagtacagagttggctgggctgagctgaaatggtagcaggctgaataggttgggctgaatggcagtgcattgactccctcggtgcaacagtgctgtggatggtagcagcacattaagtaataagttcatctaaggtcccttatttttgtcaacgaatccgatttacgtccttcaaccgcaaaaccagatacaacaggtcccgcaactatcaaaaccggtgcagattaggtccctcggcggtttcgatggcggttttggctgacgtggcgcctacgtggctaatttgactcggtctcaatctgacatggcactgatgtgggcgcttacgtggcaatttgatccgaaaaaataataaaccctgtgggacccatatgtcagtttcacacacaaattaataaaagaatggcggggcccacgtgggccccacacgtcagtctaactcacccctcctcttctgcttcctctctccccatctcccctctttttatctctcttgcaacgacggcggcagcagaaatggagaagagtggccgccggccaactcgctcttgcacgcgctcggcggtagaccagggagctcgcctagctccttcccaccggtcgtcgcccttgtccccgatggccgccgtccgccgcccttctccccaatgaccgtcggcgagagaggagggaacggcgcgcggcggcgtcagccggagaggagggagcggggccaccactttcaccagcgccccacaacgacggcttgccggcgccgctcgccgcggtgacgacgatgaccgtggatgtggcggcgccagcgctggccgccggcgtcgtcaacaacgactcgttggaggacgaggtgccgtcaacgtacattccgatggcggccttcctaaccttgagcacgaatagcagcagcgtgaaccagacgatggcctggaagacggagagctggacaactgttagcattatttttgtgtggcagttagcttcgtgcatgcggctagctagtggctgccgaattaattggatcgcgtgctgcgtgcgcgtacaatgcggccgaagtttgtttgcttagtggtgtgtctgctgggctataaaagtcatgtaatctcctgagttaagtgtcaagtgaatgagaaaaactagataaggcgtttgttgtcgagaaattcttctgtgtttgtccacaaagatttttgctccagctagttgaagtgtgcgtgttgctgtaatcctgttaacgacccacttcaacaatgcaattttagaagtagtagtatcaaatccaacacaaggagctagtgaatctgttacaatagtggaaggttttggggtggaagatggagggatacaagggttagaaggttctagtaacttctagacaagtagaggaagagggaaggtagagatcgacaaggaggcaagcccgcctccaggttgttgtcgccgccgttcgccgccttggccaattgatcggtcgatcgatctcctgtaggctgctgctgctcatgtattgtttcaattggacttgtttgggctacatggccatgggctgaccagcctgtggtgcagtcagcggcccatgtgcagcccacctgagacactgacaaatccttggccagagctgacaatgacgagctgctacgcccactcgccgtacatggcgcgcgccatgggcacaccgacgacgagcgagttggtcagcgtggacagcgagaagctggtgatggaccagcgatggcgcagccgcctttgctcatgaaccgtgcccagacgccgatgacggcgacgggttcgtcctgactagatccagatccctcgggatccaccaagagaggcttgagctcggcagcggcggcgagggggtcgggtgaggcgcgggcagcacgaagtcgagcggcgaggtcggctacgaggaggcagcggcgaggtgctcctgcctgtcacgcccggaatttctatccaaaattccaaacgcttacatgtgtgtgaaccctcgtccaggaatcagtcgaggcacacaataacaaattgataatagagtacaattattactctaattaataagcgaataaaatgtcattacagaggtagatagttcctctcaatcaataaagatctaagcagcggaaaataaaaaactagcgaagctccggctccactccacaggcaacttgaccaaggctacacctaatcctccactccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaatatttcagaatttaataaaacagttaagtattaatcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactaaggtgagaagggtgagactaatcacgaaagacattgttagacccgcccataaccgcgggcacggctattcgaatagttttactttgatcagaggtgtaccactgtacccacaagacacaaccccacatcatgtcaccatgtgcctcaataccaccacggtatctcggaaaggagtcgtgacaatacccctcgcataacacaatccactgcaatgcaccctcccggatcatagtcacccccttataaacaaggtatggactccccagcgaacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattatctaatcacgattaaccatcgtgaactatcaataaactatcatgaaataatagtgtggcattagttatcccatgaatgtgctaatgtttctaagcagggctaagcaattatatctaatatctagttgaaccagtataaataaataaagctcaactagtcaaattataacccaaggtatcaaggaataaggtaatcaagaacaaaagggctatatcaaacaataggttaaatccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacaaaaacaagcttgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgatgcaataatgaattatttttgaaaaggaaaagagggtttattgcgtcagcgggctagggtttggtggaccgggcgcacgggcgacggttcacgcaaacggacggccaagattgatcccacccaaaacggacggctgagatcgatcgggtccacagcggctcacgggagacgattccgatgacgtcagcggtgacgtcaccgacagcggcggcggctcggcggaggagacggctcgggcggcgcacgttcgccggcgaacggcggcacctcggcacaaacggagggcaccagcacgtagaggacaacgcggcgaacacaccggtgaccaaaacggcggcggaggaggaacggacgacgacggcgacgaggaggaagcggcggctaccttcgggttgtcgacggcgacgatgctccggcgggttccgacggctgcgaaggggcggacgaggacggcgacgacttgacgagcacaacggcggtcttcccgagcgacggcgacggctgaaacgacggcggagcacggctgagattgcggcggcgacggcgaagctagggcacacggcgctagaacgattccggcgacgagaggcgaaggcgagggtggcggcgggtagaagagacaccgggggtccttttaaaggggctcggaggcggcggcgaaagcccacggcgacggcaacggcgaaggaaagctcggcttggagagagggaaaccgatccgaaacgaactcgactccgacgctttccaaagcgatttagccaaagattccaaaggagaaaaggtagaggagatcccgaggatcatttcccctctatcaattcggccggagaaggaaaggaacggccggatttggaaaggaaacggcggcggcgacgctagggtttgcgggcggcggcggccgaaggaggacgatggatccgacaagcgggacccacctgtcagcgacagcgagggcgcgcgcgcggctgcggactggccggctgggccgaggagagagaagagagcggttttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctggcccaattttatattggaatttattaattaaaattagattttcttttcaagacttttaaaataaattctaaaaattccatttaaacaacaatttatatattttgaatctttagggtgtgacactgccgctcgtggagctcgtggcgggcggcgaggaggcggtcggaagggcctggagacgaggagagcagggcgagcgccgaagcgagagaggaaaggggagagagatgaagagatgggagatggggagagagaggaggaagaagaggggtgaaatgacatgtggggctcacgtgggccccgccattttttattaatttgtgtgtgaaactgacatgtgggtcccacggggtttattatttttccgaattgaattgccacgtaagcgccatgtcagtgccacgtcaaattaagaccgagtcaaattagccacgtaggcgccacgtcagccaaaactgctattgaaaccgccgagggataattcacaccggttttgatagttgagggacctgttgtatctggttttgtgattgaaggatgaaaatcggattcgttgacaagttaggaaccttagatgaacttattccgcacttttgaacggggccttattccattcatgggccgatcaggcaaggcccaggaagcggcggggaagcggcggctagcattgaagcgcgggaaatccaaaatctcatcggccgcctccttccccaatccaaaaaccctagcggagaaatctctcccctcaccgtcccgcgcgctgctcggccgccatgagcgcccccatggaggtctccttctccgcgccgcctcctccggatgcggcatctgctgccgccgcggccccatcgctggtgcccgccgtgtcggcggcggcggtggcggcgaccaccgtttcctgctcgccgcagccaccgacggggtcgccctcggccgacgacaggatcctcgtttcaggtaggttgcctcggttacctcccgttctctagctatgcacggttgttgtggctagcgaatgctgaatcatggtggctgtgtttttttaaaccctgtgattgcagttgaagtgcttctgcacgccactagcacagctcgagccgaggacgtctgcgctgcggtggagaggttggtgtttatctcattttctgttaatttttcgggttgttgatgttgtgagcaacgtcaggcgggttggtttagaaaatggtggttttctagaaatggggagcgattgagtttgagcattgatggaaaacggtgaagctgaacactgaagcaacatggatttgggatatagtatattttctgggtatctaatgcataaaaaacctgggtcttctgtatgttctgaagttacagaaacttgtggtactgtaactagtgaaccaatgcaagtattaagagtgagttgtaaaatgcatcaaccgcagctttgtggaagccttggtggtgccatggcagccttgggcagaggcatcaatggttgctgcaagggacttaacatagtttccggaagagagtttctggattttatttattcgctcacataatttgcgtgaatactagcatcttattcatgagccattagcagctgttatttctcgaacttaatatctactacttgctttatcaatcaggatgttagaagctcgaagcttaagctatgttgatggtcctgtcccgattcctaatgatgatccttttcttcttgcaaatgttaaaaggatccaaatctgcgacactggtatggatctacttagcctggcaattgtgctttctttcctgacctcattgcttatgcatctctggtacttgccttttatgtagatgagtggactgagaatcacaaagttctgttatttcgacaagtcacgcctgttcatctgttgcacgtgtgcaccataaataatgttagcggcccactgcctcaacctcttccacctctttcaagaacagtgggtataagattttgtgttgacatgttggcttcgcgctatttataaattgcatgtggaatttcttaatactgtactaattttctcatttgttttctctagagtagagacttccaaaggtacattctacaggtgcatttaactatttgccacccatatctcaatgacatgtgggtccacatgtgtctatgacatgtgggtccagttaattgccacatttaaaagtggcaaatagttaaatatctcacattctacatcctaatgtcttaatactgatccataggaatatgttctttccaatagatggattgctttatgttgtttattggattgaagagacattgatctaattcaaatgtatttacctcaatctggtttgcttatgctgcagttgagcgaagatggtccaggtgaggagccgggtgaggacgatacactctctagcttcaatgagtgggctctgcctgccaaagaatttgatgggttgtgggaaaggtttggtttacattcaatttaaccttaactagtacaattccttgaagaagtacactatccttttctgttgtgttggtaacatcataagtctttgcagcttactctatgaagttggtctcaagcagaggttgctgagatatgctgctagtgctttgctgtttactgaaaagggtgtagacccatgtcttgtttcctggaacaggtaagcgtcttaagaaacacctagggtggaaatgcctgagctctttacgagaaaataggtcatcttaagttacctgtagttgcatatgttaaattgtacactgatttttcattcttttggttgttttgattttctttgtcaacacattgcaggattgtacttttgcatggtccacctggaacaggaaagacttccttgtgtaaagcacttgctcaaaaactttccattcgcttcaagtcaaggtttgtgctgaatgagatacaatactgtataattttggttaatgaatgtgcgttattcatttctataattcttttaggtattccatgtgtcaattgattgaagtcaatgcccattcactgttcagcaagtggttttctgaaagcggaaaactggtatgccttttttgtgctaaccgaaagactgttatatgcatgtgatgattcatatgctgaatgctattatctaatgacacttggcttgctcatgattttgcatgtggtggcttttattcttatgattcatttcgacctttttatactggactttacctggtataattagccaatggatatgcatctttattcgcatcttaaattccgtgtactctgtgcaatccttcattttaggtggccaaacttttccagaagatccaggagatggtggaagaagaaagcaacctggtatttgtattgataggtacgtcagtacgtccttgagcagtgacaagttaacactatatattgacaactaggcaactagcccaaagtgatgaaatgactatacgagtcttcactgtatggtctgtgaagtgattagatgagtccaccaggttcattttgtatatgaatagtttaggaaggttaattttcatgtcaaattgtcaatttggctgagttcaatttaagcttccattatctaaaaatgttgaattgtcaatcacgtttctccttaaagatacacccctatactaatgattatgtatcaaccttggccacctgtttgacatatgactatatgagcgaaggatccttacaatctatattatactctttcacatggagtttgatttgctcgatgttgtatatattgaatcttaaccttatgtgtgttattattgatttttcaatttctagatgaagttgaaagcctagctgctgccagacaggctgccatatctggatctgaaccttcagattccataagggtaaagtttttatttttccatgtaccaatttatcgtgaaatgctcatacctattccttcatcgtgcaacctgcaggttgtaaatgcattacttacacaaatggacaaactcaagtcttggccaaatgttatcattttgacaacatcaaatatcaccacagctattggtattaagttctgcctttttatacctttatgaagttagtaaatcgtccatctcctgatgatcaatttatcatttttgtgagcgaaagacacttctctagtctatagtgattttgctctacagggagtaaatcctaactcttctctagtttgcagatattgcatttgttgatagagcagacatcaaggcatacgttggacccccaacccttcaagcacgatacgaaattttgaggtcatgcttacaggaacttttgcgagttggaattcttacacatactcaggtatttgtctgtgcttgccaacttggttgatgcctatggtgcccaccttttcattattattatccaagcaccagagttgctctggattactctgtccatggggcacttgattagagcaaacaattcttttggatcttagttgatgaatcgatcaaaacttctccacaagactttcaactttcttgtaacccctgaatgctaaataaactattgtcgcaaattgtagggtggcaattctctttgccttttgagttattttagcctgatggagaaccagcactgtcctgaggtcgcagatcctcatggt

SEQ ID NO: 37521 - DNA, 6856 bp, Oryza sativa
ttcctgcagccccagagcctggtgctaaataccggcagacccctgcaatctttaggtttagaacagcagaagtccagaatagatctgattgttgctttgatacttttgtgttttgtagattattatatatatagtatattgtgcctcgaaggatgtcactgagttaaaccagaaacaagacttgattcgagttgctgaatgtttaaaagcatatgttatcacatcttgcgctctatgcttgtggaggtagtgtagtaaccaggacctgcttcacgtgctgcatatacaggaagcacactcaagtgactcaacatggtcatgtctcaagagcactggagctaaagcattcagaaaattgccgggtgtcgttcttaaccgggaattacagagattcaagttgaccgtgatctattcggtatacaactaattaaattcaagtatcgaaccaagagcagcaattcgatatacaactaattttcattgaccgctaaaatgtatagggaaggaatctacaagaaaaacgaactagagccatgctgttgttggcctctccaaggatcttactacagctacaccacaaaatgggtttagcaaatagtgatttgggtctgagactgaaactacgatttcacctctggcctgctctggttgggtcgtatgcgacaggataagtagctggtgcttgtcctgcattggcagctccactgcttgactgaacaactccagcaggatatccagcactactgatcgcgccatacatgcttgcaacatctgtagctacaccactgcttattggttgctgcggtgcagcatacgcactaggataaccgggcaaagcggcctgtgtgtaccctgcaactggataaccaggatagcccgcgtatgcatttgcttgcgcagcatgcatctggtaagcagtagcggcatcataagttgggtaagcatatgccccagcttgggtagatccttgctgatatgccccagcttgggtggtcccttgctgataaaccccagcttgggtggctccttggtgatatgcagagggatgaccggtaaatgcacttgaatatgggtttgaggcagctggcactgccacagcttgtgctgcccctggttgtgaagcagtcacatgtgccacccccgcctgtgctgctactgcttgagccgctgccactgattgttgcaagaatcagatggaattgaaacattagagtgctttacaaagcacaaaaggcataaaatatgtacacattgatagatagattatgtgtatgcatggaaataagccaatcataagcaataaataagcagacactacagcgagtacaaaatgggacatacataagctatatatatgttgagtggcatgaatatggacatgacaaaaccggagtaccagactaacgcgtgtgttgcatattacaaaagcaccgacatatatctatcacaattcaaaatgcatatgcaaatcacatataaaacaaaatgcatatgtaattaaatacatcagaggttcgcaagggaacataactgccgatctatgagtacaggacagtccggttcttaccatgaaccaaacactgagaagttatggtcaaacaataagggaatgaggataccttgagctcgtttttcagcatttgccacatcagcacgcaacttgtcagcctctttggtcatagtcattaaattcatctccatcgtccgcatctgctcaacttgcttgatgtttgtgtttttctcatattcaaaagcagatctatgcatggttacgggaaaacatcatattatcagaggcctgttcgccaccaaagctcaggagtgtatggaaaatgtaaaaaaggaataatatcacaaaccttagactctgatgctcttttcggagcccatctagctcagtcagtaattcaggaagtttcttactgtcaccagagaacttatgtagctctttagttactttatccatctcaacagtgagcatctgcctctcagcaataagtctctttgcctccatatgcacttgatgaagttccttcttcactgcatcaccagcttgtatatctgcttccatcaatctcattctctccatcaaatctctcatatgcatatcagtctctgtctgaacatcacctaggtgagcacggatcatttgcatttctttctcagtatcaacaatatcctgcctcaagacgacatggctagatgccaatcgctgattctctctgataagcttttctgcctcggcggtctgctcagcaagtttcttttccaagatctccagagcggtggcagcgcgatccaaaggttggcggccagaaaggctggctgcagggaaggcgccatcacgcatcaaacctgaagcttggcgtccatccagctgtccatggtatgccattatactgaaatagcaagtaacaccaaaaggagtttaaatcgggaaatcgggagcttcaaccaaaagtgaaaaatgttattaagtagtcatgctaagccatgcatgcataacgacaattaacatggcactcaacattaaataccaggcacgttgcggtctcatcataggtgatggtaatttgaaatattgtactagatactatagttacatccatgaagttgttcaaaaaacatgtggtgccaagaggttaacttacaataaaagatacaaagactccctattaatcaacaaaacaaatagaggagattacattggagttaaaatacagaaacgcaaacggctcacacgtaatgcaggttcgaaatgcaagcacaaaaataatccccaaatccacacaaggctgaactcccgcgaagctgacatcaaatctctaagctaaaacctacatcaacaatccatggccctacactgacagattaacagaggcaaacctaaggccacctccaatgcaaaatacttcaatgggtgcttaggaaaatagaaaaagctaccacaccactaagctgagaacgtcctaacttagggcatggggtgaattcagctcaaccccaattttttttccttaaacaatactgcaccacgcacgtatcaatggacagattaatcgcgaagaaactagatggcttaatcgtagtgaaaagaaaaaaaaacaatccaggtccggatagatttccccaggtcacggagtgacgcggaagaggaggggagactgggagagggggctacgagaggagaggtgatggataccttcaattcgactcaaccgagacagaggccgatggaacgagggctcgtcgcgtcgagtcccccaccccccctggttccgagcctgctcgccggcggcgggggccgtgcgcgccgaggagggctcacaagggagagagagggggtaggatgcggtcgggggaggagataagaggagcccgtccgcaccgcgggtaagtatacggcggccgttcgccggcggcgcgcgcgcgaggaggaggaggaggagaggcggcgggggagcaggtcggccttgccgccgccggaacacagaagagagagagaagggtagcggcggcgacggaggaagggaaagagatggagggagggcagagggaggaagaatgtgggacccggtaaaggcagaggaggccagatgtctcacccctcgcccctcggagtcacgactcgagtcacgaccttgctgcgtggcctactagaccatggccctagccttagggcgaaggccggaattttgacgcgaatattaaggaataaccacgattttgaatccatatcgtctaagtctaaccaccgttttatagagctagccggaatacctgagcgtttctttagtaggctggaattttggctatttatttttagtcttttatttattttaaataactatactaaatgttaggggtatacaattgtatttattttataataaaaatattagtttgaggtagtttaattattcttttgtattgaatattaaaatatgttacgtctcattaagttatcttattttggaacgagtgagtacttatttgctggagggttggctagcgtaacagagttacttcttgatccgatgaccctatttgtgttcataaaagatcagccgagagccacaacccaaccaggaaaggccatctaagtttttcataatcataccgtgtgttagtccgatcgctcagagcgtgcccagtacaagccaggacttgctcaaagactaaatgtaaagatgcaaactaaatgtacgactgcagatagcattgcaaagaatcagatgataattggaaacaacggtcttgaggtccatggagacacagccgcggctgaggaccgataatcaactctcataatcatttcagttaaaggaattaaggctgccagcatttccctttgcaacaaaaggtgttctctttaccttgttacacagcatcgtgtgaagaatactcctcgtgggttcctgaattatttgtggaacagaactaagaaacagatattgcctcacgattccttcctgggaagcgtcgtacaaattgacgatctaaactctatacgaaacaaaaataatcgggagtcgggacaaatgagctagtcccccaaaagaattaatctctcaggcgtgcaccggctggtatctaatccagattggcgattactgcatcagtgacttcctgggtggtgctggtgccgcctagatcctttgttctgtacttgccttccgcaatgacacgcttcaccgccgtctccagccggtcggcgaatgacgggaactgcaaatgcctcaacatcatggcggatgatagaagcagcgcaatagggtttgctttcttctgctctaagatgttctcgtttccgacgtttcctgcagaagcaccttgctcaaagacagcatggtcctgacccacattacctgcaacaggatggcgaatataaggattagtaaaccacgttgaattaattatggtatacaaaaatgaaccaactgggtggtccaaacatataaaatgggtggcaagtgatgactgatgacaagaagtaataacgtaattgttccaaaagaactgatgaaaggtacaaccatgcgtgatgcacagacaacaaactgtctcccagtaagaaaaatattgtcggtgacagaaaaatattgtctcccagccgattgtttagtgtgctgttgcttatacgaattaaaggaacaaggtaaaagttaagatcctacctccaggcataacacctgtccctccagcaatacctgcagccgtgttagcaaccaaattgccataaaggtttggtgtaacctacaaaacgtaccaaagagtagaaagttagaaattctgcaggaattacacggggatacttaacaggaatcatttgggaaaaccagtattcaggaaagtgtcctgcggaacagaaagaaaaagtaaacaaaaaaagggggaattcgacagttgtcgttagctaacatactttatagtacatcatatcaagctaactaaaactgcctgtagctgcatgattgcaacgcttacatactgtcagctggttagaagtgctatagattgtcaaaagattgttttctcaatccttataacaacaaaatttcatttggtttctcttcattttcacattattgagtgtttgcacttttctctcctcccataaagatgatgcaaatctaagcattcccaatttctctgatgttgttcaggacattaaatttctcataatgcttttgaaattctacatgataaataggtcaaatttatagataaggaagcggagcaaaataaatcgtacgatgacactacttttatttcctaatgcaaatgacagaaggaattttaacctggagactatatatagcaaatgtgtatcattagattcattatttatcttgcatcacaagcaaaatttcaatatcctagttgctaaagcatttacaggaatgtatgcttcccaagtacaacaaaatatgttctacaatgctaaaaccacagcatctacaataacttctgataagcttcctcattcagaactgtactttctgagaaagtattacattcattcttcggacataaaacaaacagattaataaaaacagatgtttgaattgcatcataaaatgcaaagcacacgcaaagaaactcagtgcagttcaaacaaggcagctccaaagtactgaacagacagtgatgctccagatagaatgtatgaagtaaagagcataccatgacatcaaattgctcaggctttgcaacaagttgcatacagcagttgtcgacaatgatctcattatactgaataccaggatactttgaggcaacctcacggcaagattccaagaacaaaccatcagcaagcttcatgatgtttgctttatgcactgctgtgactttctttcggttgttaaggtaagcatactcaaaagcatatttggcaatcctctcagagcaaaactttgttatcacctgacaaaagttagtcagtgagactaagatggaaaagaagctcagagaactggaaaaaaaaaagggtgcatttcattccattggcaatcatgtaacacaaaactaatcaatggttcaattgaaagaaaagaaataagcacatatctgatgagtccatgtgccccaaatcaataaatttaaccatcagtctacctattccctctattccattccctacatcccaaatccatgaagctgacctgattacacgtcatataacagtctggccaaataatcacgtcattaaattcttaaagaggccagtgtttgatgcagaataaacaaatcaggaactaaactagcacgttttacaatttaatcaacacgcaaataatgtaaattcatagattgtaccaaacgctttaccaggcaaacagcaaacaacaaaccg

SEQ ID NO: 37522 - DNA, 8298 bp, Oryza sativa
ttcagtataccacatattgagatcataggctagtgaagtcccaatcaaaatgaacaatgtggtcaaagcctcgcagttttgcaataggatactctcatctatacaataagtatgatctgcaaaatctaccatccgtatgagcagtaccagcaattacgccaacgaaattgcagcataataataacatcacaaaaaaggaacacattagacgtcaaaatcgatgcacgggtggcgattctccaaccaacacacaacaacagagcaaagcgcgcgtcacgcgagattggcccgtaccttgaggctctcgacgacgccgggcacgacctcgtgctcgagccccgagtactccccctcggtgttctccctgatgacgacgatgtcgacgtcctggtgcctggtggggaggccggggaagttggagcagttgacgagcgaggcgtagaggtcgagctccttgcggagctgcatgttgagggaggagaccccgccgccgacgggggtggcgaggccgcccttgaggcacaccttgttgcggcggatggactcgatgacggcgggcggcacggtgggcatgtcgccgcggacctcgtaggtctcgaagtagaccggcgcgtgcatcacctccatcacctgctgcacggcccccgtcacgagcggcccgatcccgtcccccgggatcagcgtcacggcgcgcgggttcccgtcccctggcctgggcatgtaggtcaccgtgcggcgcgcgccggcgccgccatggtgcgccggggcgggggccggggaggagaggatgcggcggaggaggggggcggatcgccgcgccatgggtgggaggaggaggaggcgaattgcgatcgggaaggcggaggcgaggcgaggcggccgggaagagaggaggaaggagaccgggagacttggagaggggaagaggagagaggaggagaaagggaaggcggagatgtgtactcgagttgttttttgcggtctaatcccttggagatttttgtatttggagaattgcatttcgaagttagacttctttcacaagaataatgacgaggagtccctgccaaatgggcccatcaaaaggccaatctatatttatatatcccgtaataatttaatcggcaaaaaacacataaatgcgtatcaacttgcagaacataagttgagcaatggaagagatgagaggtaaactattgcttgcgtgcttgctggaatattatttttttggttcagcgaatgtatcgatcaattgccactcaatccatccaatattccagtaaactaacctaacgcctatcatcaactatcagttggagactgaggtctgaaggtagcaaatttgggcttttgttagataataatagcagagagaacaagtagaatatggaacgaatttgattcgctgaatgccacaaaagataatacaggagtgtagtatacttcagccattaagatggcagtttcaaaaacgataacgtgtgcgcctcgtctttttagatttacacaaatgtttccacaatttctttcttggtgtctaccatcgaatctgtttacaacgaggagcgagaacaggattgtcagccctgaaagcagcttcttcggctcgagattatactcaaggctcatagctcccaacttttcttataaccaatgcacactagcaaagaaggtgagaagtggtcagcgtgcagtgatagactgatagctagctttaaaacattgaagaattgaactgtactactactagtactagtaacgattcacgaacacctttggtaatgttggcagcacaatggaaccttacaaattaccatttcatacataatacaaagtaacttgctcacaatgagaattcctaaagagatatatacagcctacgcagggatagagcttctactaggctagcaagatccgtatgctctcacccgacccccaccccaatgtttgaagatttttatgattagtacttcatatatagtacataattgggtgcattctcttgttaattcctccatctacttaattgattttattatttttagagatatttaattgtgaaacaagtcgctgcgattagagtgtagaaatcaagaatatataatgaagaaacataagtatgcggtaatgttgtaatttagtatagatgcttttgttttagagctgctgtactcatgtattgcttagtcatgtgttttgtataactccaatgtctataaattccaaagaaccgcaatcttattttggcccctcttgagatttattagttcaagctccactattgtgtgtattgcttaacagcaaaaataattatcagcaaagacaatgcccttataatgcattttaaacaatcgcatgcatacagatagtacaacaaagatgggagtttatcaaatggctgattctatcaaataattacacttacagtcaaggaataatcactataataaggaaatagtgcaacaaaatgagcagccaaaatagtttggcaatttggaatgaacaaacagaaccttattgccttaatcttatcagagtaagtaacagggtaagtcagcaagcatataccttgttgttgctgagaacaaatcactgtccttatttcaatccagcaacctttttcctgagcaatgtattctgtttttcctacaaaacaatatcagaatacagatcagaaataccacatcaaagaataggctagttgttactaacagtagcatatctaaatgcaatccttgcaaaatttgtggccaggcatgactggatgaagtagtagtaataataataagacaacaataacatgatatagaccctgttaaatttgagttgtattataatgtagttcaatcacatgcctatgcaagatgaaaccatatatatgtgcagaaccttaaattctgcgcacagccaatctggatttatcattcaagtattcaatacaacactttgtactgtttctaaagcccttttcaaactaaaaaaacatggataataattatgtatagtccaaaggccccaaacaagttgcatgctcgtgaccatattcatttaccaagatcagcagcattccagggcttaaatcgtgattttgtggcttctgagcaaccaccaaaaagggcataactgctataactgattcttggaagcatatttttcaattctatttttagctttttatatatcataatttattaataatttaatatgagtcttatattgctcaaagtttattacgaagtacataaaacaccttttttacacataaagcatgtcaaaagaaaagaacaacgggtcttaaactcttaactgacagtttagtatcaattcacgtgaaattaagggtattcgagctacaggatttctcaaacagaagaaaattatccatgagaaatacagtatcagatagaggtgctatagctatagcactcacctgtactgctaattgcaattttagttgcctttgcagcttttcacaagatagatagcagtcaccgtctaagaaatgtgtcatggtactatggcggactatctagaagactagaacacagcagcactcaatctcacttagacctaacttgttcagccagactcaaccaaagcagactgcctcctggcaatcagaactgactcatgatatggatgaattacctctttaactattagtctatcaacaagcaagtaaaaaaaacagcactagttaaattagaaatcacaaatttcagatttatacatggttttggcagagctgtcaaggcatagtttcattcacactaggaccaaagtagagcgtggattatacatgtggttactcaaaactcaaactatgcaatttcttccatctcgcatatcaccacagtaatccagcgaaagagctcaccaccttattttggcttatgacaactcaaatagccacacttgtagtcaaaacaaaataatacaacacattgctacaccagaaataggtgttctaaaaagatgtttggtgaatgccttattaactatttagacctcccatagccacttggatcctgcagacctgcatggctggattcacgccctgctccaactcttcatataccactttatctcagcctcaggagatcccagactcccagttacccagcatatcctagctaaatcttattttgaaaatttccttgaagtgggcgatgccacatagcagattaagaaattaaagaagggtaatacaatctgcttccttaagcaaacacggatattcaaaaagaaaattggtttcaggaggcaatgttattgcgttaagcagaacatgaattctttggaaactgatttagcctttctatctagaaaatatttcataccccctctgtccatgatggcagattcatccaaattgttcgatcgtttcttctattctgatgtgaataaatcttgcctaattcacataacagaaatattgtttcaagttagcctaacaattgacacaggatcaatcaatttgtccatagagacaacaatatactccaaaaggcaaaattctgacaacacaaaactcaggatccaacaatcacctgatcgagcacgcgttcgttggtccgctcaacctgccgagcaagcccctccagcttccttagcatcccactgtacatctcctccatttcggaggtcagcgcagaggccgaggtcaccattgcccctaccctctccagcccgaacccttctaccatcccatcaagcgccttctgctcaccaatgctgtaaccctgctttacaggctgctccggcagcgacggcaacggcgactccggcgcgaaggcgtggtactgctccctgaatccgggcccagcgttgacgacgctgagggaggccggcacaaggcgggagtcaacgaggaggaacgcacggtagtcgaacgagtgaacggagaggccagcggcggaggaggatggtgccacgaggaggaagacgagcgggtgggcgagcaccagggtcttcgagagggagcgcgcgagggcggcctcgcgcatggaggggcgcagcggcgagcggcggcgggaggaggagaagaagccgatggcggcggaggggtcgggggagtaggacgacctggtgaagcggccgagcggatcggcgagggaggaaggctgcgcgaccgaggcgtgccccacgacggagatggagagggaggggcccgaggaggcgcgggcctggtcgtcgtcgtcgtcgtcgtagaaggacgggggagccgcggctgcgcggctagccacgccgaagaggagcccgtcggagtcgccgtcggccgagccgcagcaggcgagcagcgccgcgagggcggcgccggagacggagagcttcgcggcggcggcgggggccatcgccgtgagatgggattttctgggggaagctttctgttccggagttcggcgaggcttttccgagacgtgacgggcgagacgaaggtacagcgccttccagacttccacggatgagtgatggcacacgtgggctactaggctgggccgtattgaattctttgtttttcatttggattacgtctattttacctccctcaactcttgctcttgattgaatcgcctccctcaaccgcaataccatatataaccgccaaattgagcccctcggcggtttagctggtgctttggtcatatgtggcatccacgtggcatgttgactacgggccaacgttatagagcacgttgttgcctgccagagtagcttatcccgcggtggtggtgagcgagtgaaaggggaagatgacgtgaggctatggttgtggctcggagcggattaggggaaagcggacgctgcatgagggacggacacacctatagtggaggtgtgtcactcccgtgatcggttgattgtgccaccagaaccatcgtttaatcctcatgcctcctcctccgccgtcgacgcctacatcatcctcttgccgttgccattaggaaaaagggagataattagggatagggaaaagaagaggatgtgttaatgatatgtggggtccatcgtttttttattactccctccgtttcaggttaatggtcaaagtggaaatgacttgtaaatgagaatgagtggctttatgaacctctttgtaagcacttttggtagtgcaacctccggatggagtatgcttccagcaaagtttgtctgggtcttcatttggaacaagctgaacattctgaatggcttggattgcttcttggtcaaaaatttgttgcagcttttgtgtcccattttttgttctcatcccataattctgcaaccttagagggcaagtgcatattaatagcccgagagtttaaatgattatcaatgttttcccagattgaacatcaaggttgattccagatgaatacctgaccttgagagagttgccaaatagttgaagaatttagaaattttctaactttaaggatagaggaccagaaggcagatttggaaatgttttcattagctttccagaaagaggtattattcaaatattttgctttgataatagtagaaactagatcattgggattactaacaattctccaagttgattgaataagaagacttcgattaacattgagcaaatctcgtatacctagtcctccttggtctgtaggtttgcatataccctcccacgatcgccaacaaactcattttttactgtcctcagtttgaactcctgtccactaaaatttcctgataatagttgttagtttattaagcaagcatttagaattagaatagtggacatatataataaacatggatggaagcaaaagtggacttaataagagagtgcatgagaaagtttgtttgctttgatcattgtcaactttgctctaaatttattagggggtgtttagatatatgggggtaaagttttagcgtgtcacgttggatatacggacacacatttaaagtattaaacgcagactaataacaaaacaaattacagattcgtagtactagaatatatcatatctctccaaaataacttatattatgggacgaagggaatagtaaatataagcaccagcatggccatgttaaatataagatttaaattcggatgagctaattccaccacagaaaactttactagtcgagctacgctcacttcaatttgcctctagttttattcttggttttttttatcaaaaagagaaaaaaaagttattattgttggtattttaattgttgtcttctgcggtgtgagaaactaaatgggccatagaaaccgaaatatgggccaatacatgtcaagcccatttctcatgggccgccacaaccatcatctcactccctctctcgattctccgttgccacacgctcgcaagcagaggcggccggcgacggcgcgatgccgccgagacgagggtcgcaggcggcaagaacaaccggctggcggcgggagccgggcgggcgatgcgagcaaccggtgcggcggcggtccaacggccggggagggagtggaagtttggaaccactcgaggtaaaccttccgaatcggtagaaaccccccaactctgaatttgctaggcttttattctggggctgttcactttgatgccaaaaaaaaatcttaccaaattttggcattaccaaaattttagggcctgttcactttgttgccattttcaaccttactaaattttggtaaagttgtcaaaaaaaaagtagctacatttagtttgctgccaaattttggaaactatataagaaatcctgctaaaattttgttgccaaaattttggtaactatgccaaaattttggtagaatttcttatatagttaccaaattttggcagcaaactaaatatagccatatttttagcgactttattaaaatttagtaagcttgaaaatggcattaaagtaaacatgctctttatctttcctgtgaataatcgtatataatcttaggaaccgaataagcccaaccaatataatcgatataaaaaccatcatgaactgaggacataaatctcgcacccccaataaaaaagctatcgatcaacagatcaactgatacaacatttcagccatctgataacctgagctaactaggctatacagtattctgaatttctgacacaattcttgcgttaaaacggataaagtggcctaacaaagtaacaatgtaccaaaacaactcatttaaaagttccgacattggagaaaatccacgaaggcgccatccatgttttcatctgcatcacagaagcctgaaactctatccctgttctattagaaaatcatgctgatgaatacaatactagtaataggtgaaatgaaaaagat

SEQ ID NO: 37523 - DNA, 1597 bp, Oryza sativa
acaaacaaataataacacatcctgtatgtgaaaatttcaatcttggaccaaaatatatgttgtactacaaataataaacattaaacaggtctgataaatcagagagaaagctttgtccatctaaaattaaatggaactaatgtacattggaccacagccataaatagttaaggaaacaaatcttggttcatctaaaattatatggaaacagcattgtccgattgagatgatgtttgcactcttcttctaacatggcaccggctgcaaggttccagaacagtcaaattaactgtagatggaactttatcctcaatgtatgttctgatagccgcgagcccccttggagcttccgtgagaacaccatctatcatgggaaaacaccgcctatacttatcttgatcacacctaggaccataaatggtatccaatgtaagacactcaagtgacaccgcattattgaggatataacatgttagttccaccaagctcttcgcagagctgaaaccagtgatcttcacactcttgaggtggccatggtggtgttcaggtatgtgtctcagttgtgaatccgtgaaaatcgattcattcaccatacgtagagtcacctgaccatgaaaaggatgatatgcttgaattagacccagagtgataaaaaaagctttggaggatgaaatgaatgaatgaacaacactagtgccttacatttaatatcaaagtctccaaggaaggagatgcattgataaaagaaaccagagagaaatagtcatatggccgggaaatggtcgatcctgttatcatacgaatggtcaggtgcttaaggtagatgaatttggtaggtagcattggtgcatcaaccacctgcacaacaaatatggcatgtatcagatttattatacaccaggtattattaatgtaatccgtatataacattccctaatgtaatccatatatatggttatactaatgtaatctgtatatatcgctgtactaaagtaatccgtatatattgctatactacaacacctcatcttttagagaatatatacctcattcactgattcaatgacaagagtttcaagatttggcataatggatggcagattggcacgagcatcatggattgcacatcccatgtctagtttcttcatttgcagcgtttccacaactgagaagttaaccctgaatcctctatggaaaaaactagagagatttggagctttgctctctatcactttcaagcttgagcattcaaaaacactaagtctgctgggctgctgtagggcgaaaggtatcttcaggcaagttatcttcgtgcattgagtgagctctaaatgctccaaagcaagagagttggaaagaaggcactctaactcagcccatgtagctcactaaccacagagacagacttgttaggcttctcaagggggcaagttcaggtgtgggatggagggcacaaaatcgaagtttaatgtaccgaagtgagtctcgaaccccatcagacaaaagtgagcatgggaagttgtattgtttgtttgtgtcaaacaaaaaaagggtgagttcttcgatccctggtttaagagcaatctgaagccaactg

SEQ ID NO: 37524 - DNA, 3930 bp, Oryza sativa
attgaatttctcatcattttgccagcttgagaatgaccatcgccatcatgttcacacggtgatatctttcttttacccgttgaggcaataaacccagctgctgcgacacgaaagggattgttatggtagcagagacatgaatcgaagaaaagcaagaaaaaggcacttcaatcccctgagatctcacaaaaaaaggagctcaaacgaagaatgtggaaaggcaataatctgagctgttcaccaaagtgaaaaatttgaagccaaacaaatgaaaaatgggtatccggctcacatcaaaccagatgagccagttattagttaggcaataaaaagagcagctttttatgagctgacaatgacaaacacatctaccgagccaaacgtgacagaaaaaaagatgggcgaaagagttgttcctgttcagagaggaaggaagcttacagcgggctcggatttgcggccggcgatgccgccgccgccgccggccgcgccgctgggacatgagccggttcggcgccaacatccccaaagacgagctcacgaagatacccccttcctccctcggatctgaccgagaaatcacttccgtttccccctccttcagatctctcctcttctcctctcctgccaatttgcggttcggttttgaactcaaattcgcaccggcgacggcgacggcgacggcgccggcgaacggcgggcggagctatctactcgcctacagaacgacaaaagtaaccaaaccctattcagtgtggggactggggagtggtttgatcttcttttttttttttttttggcttttggagatgatctcttgctccggtcttattggattgcggaataagtctattctgactccctcttgggcttgttgaatcgcatccccaactgtaaaaccaaccaggtataacgtctcccccaactttaaaaaggaataagtcaactttggatccctctattttgtcgcccagtccgattttcatcccttgaccgcaaaacgggtacaacccgtcccccaacttacaaaaaccggacaaacgagatccctcggcggttttggctgacgtggcgcctacgtggcttgtttgactaggtctccgtcccacgtggcattgacgtggcgcttacgtggcaattatatctagaaataataaaaagcgtggccccacatgtcagctgcacacaaaaaatatttttaaaatggtgggacccacgtgggccccacgtgtcagcctcactcctctcttcttcccactcccccctctctctctccttcctgggcagcggacggcgcggtaggcagcggagcaggcgagctccggcggcggcagcgggcatggtcggcgccgccctccgaccggagcgccgcggacagcgcggcgtaggcggcgggtgaccggagaagcgcgcgccgggcagtctgagtcggcgagcacagcgacatcgggcggcggaatcccggggtgcttcccgctgccgtcgcaacgagggcaacgggggtccgcctcggcgatgagcacgtaggtgaggcaggacgggtaggcggccgcacgcatggacgggctcgcgggcgtcgccgcgccccccgccggcggcgagcggtggcacttgccgatggaggaggacgaggaggtggacgccgacgatgacgacgacgtggccggggaggcacacgcggcggcggccgacctcccggccgtggcgcgctcgagcgcggagcggaccattcctagcgtgcagaccgcggccaatgtagacgcggccgcggcggtgtaggacggcggcggaggcaggttgaggtcttggtggccgacatggacgccctggagccgaggagtcagaaacgtcttccctgactgcaagaagaagaacaaaaaaaatcagtaaactccatttcttcaagattaacccaagaacagggcaagatcagagccttctgaaactaaattcagatggaacaagtttttttatgttcttcatatgaagaacagagtgcttaatctcctaatattcggaagaaatacagcatgcaacacatgaaccgatctctgatagttgcaaacattgcaaaattgtttccgatcaaagcaaaaaacaaataaccgaacgaatggaacagttcatctcaaaattcgtcgacacaaatagaggcgcagaaacataaaccgaaactctgaggagcggtggggaaggagcggtgggcgcgggcgaagaaggccggggtcaccgacgaggtggtggaggaggtgtgggggcagagggcgaggggccaggagctcgccggcgccccttgccgccacaggaatatggaggatgccgccgcccccgtccctggtattctccgccggcgcccccaactcgccgccggggcagcctcgtcctcgaactcgtcggcggcgtccgcatctgcgcctaccccgtcctggtgggagacgatgaggtcccacatcctcgcgctctccaacatcctcccgccgccggccaattccgacgtcgcggcgctcgccgactccgaccgcccagcgcgcgcgcttctccgtcacccgccgcctacgccgcgctgttcgaggcgctccggtcggggggcggcgccgaccatgcccgccgccgccgccggagcttgcctactccgccgcctacccacgccgtccactacccagataggagagagagaagggaaaaggaagaagagagagaagggagagggaagaagagaggagcgaggctgattatgtggggcccacgtgggccccacatttttaaaattattttttgtgtgcagctgacatgtggggccacgctttttattatttttccgagatataattgccacgtaagcgccacgtcaatgctacatgggacggagacctagttaaacaagccatgtaagcgccacgtcagccaaaaccgccttcagaaccgccgagggaccttgtttgcccggttttcgtaagttgggggacgggttgtacccggttttgtggtcaagggatgaaaatcggactgggcgacaaatagagggacacaaagtgaacttattccctttaaaaatcggtgcaaattgattcatttgtgggcctgccactagggagggtactggttagcctatatttatacccaaatttacccatcctcactacaatgcgtgcccctgagcgtgcacccggctcatgttgtctgtcgtccgtccacgaggtgtgcccctagagggaggcgcgacccccacgaggggaacacgcgcccttgacccctcaactccgcttttctggagccactccttcgaggctatgcgttgggggcttggggtgctcatggacacttattctatatctgcgatttccccttctacccttggcctcgtcgctgggaggaggtggacagtggtgggaaggaaccagaagcggcgaggaggtggagacgcagtcgacggccctggcgaggacagatttgcgacgacgacggcctggggacgacgcaaccgactagatctggactcctgacacaccgctcgtcgtcggccaccgcaccccacacgccactctccgtcagcagtgacaggagagagaggcggcgacaacaggtggcggcgaaagagaggtgacgggagagagagagaggatgtgagagagtggatttggctgccggcgaggtggacggcaaccggcgacgagagagagtaggagaaacggcgacggccgccgagatagagagggagacagcagtgacgggtgagagagggagagagagatgcgagcgatataggcaggagagagcgggaggcggcggcgcatctgggcgaggagggagaggagaagcggcgaggggataaaggggaagaaaaaccgcgaaaagaaaagacagaaaaagagaagagatgggaagaagctagtgggtgctcggtgggctaggggtagggaaggaaatcca

SEQ ID NO: 37525 - DNA, 7506 bp, Oryza sativa
cggatgccaagcaaaaagaagccagcaacaacaaagtctattgtctatttaggcctcctttaattcaaagaaaattcataggaattttagaggatttcattcttatacgatttttttcatatatagccatttgaatcaaagaaatgaattctatgtaatcctataaaattcctatgagatgcctaataccatgcacatgaggttttatctcatggaaacttgcctctgagtcatctctcctctaatccctgcatcggcggcccaatcaaatggtcaatcctgcgattcaaatggcccgtagcatgttaaagtctattgtctatttcacaatataaatatttctttcttttgtgatgataagatagtattttcttttgagggataaagataatctattgttttatagtaaaaatgttgaggtatgacttctttaagttttctttttataaataataataaattacccatgcagatgcgcgagcttctttcctagttattataaagattactagccagaatcacgccctacgctgtgtgcatgggtatgaatgtttcaagctgtgttattaagatcaaaacaacacaggtgacttcttttcccaactttctcaactcaactcaatcgttttccacgtgcccgcttttcaaactactaaacggtatattttttgtaaaaaaatttctatacgaaagttgatttaaaaatcatattgatctatttttcaaaaaataataataaatacttaattaatcacgtgctaatggaccactccgttttccgtggacaggagattggttcccaacacacccaaacaaacacagccacagtatctacagttgtaacttttaagaattatatataaacattgtctaaaagaactttatgtcagaagcatacccacatatgcatgtacacattgtgactatcaccaagatttaaatgtgaatacaatctgtttgctcacataattgtttgtacaatcatgtacacttacaaaaaagtagcaatgacagaggacaatggatcttacataatgtggagtataggttagaaaaaacaacaatcattaggtgatatgagaattgcagcattttctcatagataccttcgtcatgaactaattgaatcttttctcatctatagcactgcagcacaaagaaaaatttagtgctttagctcaataaaaacaacagtacatcacttacaacagattagtagacgattggtacctcctttgcataatggcacagaattttgaggtatcccctacagaatacagggcatctttggatgtcatccatatattgctacacaatgagtatatagtaggtagtacaaatactcatataagaaaccgtgttgaaatatctctgtagctttggagaaggggcaaacataacatttcatgaattaaaaaaagttataaaatcatattttgaagtcagcttataatgaaaactctataagtatatttgcaaagaaaaaattcaattggaaggatgggttattagaaaattccaaaacaatgcagcgctgaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtaaagctagagatactaagggttggattctttggaatagcacatatgtattgttaatcggtatggactacacagatcaaccgataatggaactatgcaggttacaactcagaagtacctgtggctttaattctctcaggcaaccatggtttcagtgtcactgaaacaccctgcaaacaacgctaacctatgaaatcaatgttccattaaatattaaacaatagtagcagatatagaaatgactctagcacaagaaaaatgttagctaatatacatagggcctgcactgattttaaaaatgtagtaattgcggtctagtaaagttcacaaatactgaaatcttcaatcgaaccaaataaatatttgttcgctagatgtacaacataacctgtgattaatgccttgacttatagacccaatattgacccaatgtattggttacaatatgattcgtagaataatggagcttcctccagataggaggctaaaagacccgcaccatgaaatcatatcattaccttaatatcggcacaattatctgtctatactgagccctaaagaccctgaggtttgtctcatagaaaattaactgcatgatccaaatataagggtaatatgccaagattgtcaggcttacagtgaatttctgatgatgtatgcatcacaatagccaatataagtttgtcgacaaagaataccatcaatgcaaatgcgtatgttaccattatgtgtactgaattagcgcacgacgaattaacaaataaaatatgatttgttggagaggaaggaaattgaggcaaaaccttccgatagcataaacatgatatgctatcgtggaactaaacctaaattatctgataagaaatatgaagaccacatatatcatcaaaagaagacaataagaaaacattcatacctaaaaacagaagcatagaaaggtggcagcaagaaaactcattgacatgcccacaaaatattattaccagtattgtacaatgaaggaatactgacattacttcgcactcattaacatttacaggaaaaggacaactaagcaaagaacatcaaaacttgaactctccaactaactttttatattttgaagtatatatcttgggaaaaaaatcacatctgccatgtagtactatatcatatacatttatctacaatcctgaatgagcgtaattgataataataaaaaaaggtttttttaagtatatattcttgtagaccaatttgttaagattccagaaacaattggcatatatatgtaccgatgtacatcaggatttcattatgaaggatcatgtacacatctttaacctgtacatttctggtagttgacatagatggtgcactgtcatcttcaatattttatcattattagtgaaaagttttttacgcagagttagctggcataaaagttatacgacattataattaaaaagttgcaggaacaaatgtatttgagaataaacttagatttgccactaaaaattttaccaagcacatagaaggcttttgttaaagagagaaattttactggcgtcagcctaatcatttcttctccttatctcagaagcccgcataggagccaatcagccgaagagagcaaactgaaaagaaagaaattcagcagcatacctgaacgactatggtgttatgtgcggtgacaacggaggagcagattgctcccagcgcggcgcaggccttgatgtgggcttggatgccgccatcgctgccaccagcatgaacaacacatgcggccatggcatctagtgggccatcgtagcaggctattggtgaggggcacaaatgctgttaggagaagatggttgagaatccataataatatacatttcaaatccattttctataataatattttcatagtaaaattttgctgctcctatataaagctattttgatttagcacgacattcatatagtgtaaaaaaaacatatacagatgaccaagaaaatctgtcaactattacagtgcaaaagatcttaatcatatcatataggcagctgcagtaatcctcaaacttttgtagacataatagcaatcaacagaatgatgtcagcaacctgaaaacatatattaaattccaatacaatatatacaggacagaaggagaggatttgatctgtacctggacggtgatgtttaaactttagtactgaataatctagcattctagcctgcactcccttttttctttccttcctaccaatcatgtgaaactcataatgagcagcaagtcaagaatagagatcaggggctagaacagatatgtatatatgcatataatagggatttaagtagtagtgtaccaaattgtgtctgctgatggcttcagcagaggagtagaacaacaaatatggaatcagcgcaagcaagcaggctggatcgatcatatatattgattaagaggattaggcaaagggagtgtaaagttgacctggggaggagtagaatgcgtggtagcagatcgtcaggtcgccaggtcgcagaggtgacgaaccagtcccggcaactccctacggtggcgaactaatcccagtgagattcggcgacacccaaactgtcaggggaagggaacggagacagtgcctgcggcgagagggcgcggccggggaatgagatggcgcttccgccatcccgcggagagagggcgagtgaaaggagacggcgccaccatcgtcttgcagcgagagggcgaggcggcggcaccagccatcaggcgtgggggtggggcgcgaggttgggggcggctgggcagcgctagggttttgtgggggagggtgaaagcatgagatctaagccgttcattcccaaatcaccgatctgagggcagtgaaacatccgccagctgagccacacggatggtcagatcgagcctcacggcgatcgtacggtgaacacaaactcagacgtgggcaatattttacgaaagtaggagggtttttctgaaaaaatcgcatgacgtggcgcagtaaattccaagcattcccacggcgtttaagtaaatcaatataagttagatgaccttgattttacaaaatcatagcttaactagagaaactacttagactactggtataaggataaagacaaacttcatctacagttggcgaaaatatatttaggctgtgttcgcatggggtggatgggaacttattccctccgcacggaaaacggagcggtccattagcgcgttattaattaagtattggctatttttttttcaaaaatagattaatttgatttttttaagcaacttttgtatagaaactttttgtaaaaaacacactgtttagctatttgaaaagcgcgcgcggaaaacgaggaagatgggtcgggaaaaaggagttgcaaacacagccttaactgtcatttatcctagtgtccttaaagttatatgttgtcattgtctttcttgatgaatccgaaaatataagttcgaaaacaagccgattattatactgattgaatttcgctaacattaccactactaaaactacaacgaaatataataacgaagagtaaccgagctgtatatcatggttcattattagagtgagtagtttacacattcctcgcgagtccaagttcagttgcaacgtcaacttcagagacacatcgctcggttgaaaactatcatttcttactaggactcacatcagctagctacacgctactggccgcccctgatctcagagctaaaaccggtgtgcgagaccgaagcgctatccgggtgggcgatagcctgctgcatcccgcgccggcgccggcgccgtcgccgtcagcttgggttcaattctgaacacatttattgccgctttctgcttgacttttatgcttttggcgacttcgattggtgcagaactaaagaagaatctgacttgcatcgcaatatcgcatggtatggtagtagtacttgtgatctctggaaaagaaaagtagaggagttccttttgccaatgtcaaataagatattatgctaatattaacccctttatggctttgctttacttaccggcaaccgactgactctgtttagatccaaactttttcttcaaatttttaattttttcatcacatcaaaactttcctacacacataaacttttaacgtttatgtcacatcgttccaatttcaaccaaacttctaattttagcgtgaagtaaacacacactacgtcctgctaggcctcacatccttgtcaccgtcttttcgtcctgattagttccacgcattttgtggaaaaaaactggtggcactatcgactcagatatcagaataatgttcctgagaggcttcaacgacgtagtattaaaatcagtgataagttatatgataaactgataatgcgattaattgcatggactgtgtagcaaaattaacgcagcttttataagatctgacaaattaaaggttctgaagtatgcacatttgtgaattgcgatgccctggattcaggaacctctctgcaaattgttggtgaagcagacaaatgaattggacgggaaagggaacaggtgagaggatgaaaatgaaagaaagagagatcagagagagaaggaaaaccacgggattattctgatggtatttcacccggatagaaagaagatattctcctggtagtggattcgtgcccctcttttttcaatctgatgcgagacagagttcttagtttggcgagcacggttgacaaagttattcagaaattataatattctgcttgtgattcgccaactgggcattcatctatgcagacattgaactgataatctatagtatgcacagagataacgtcaacattacgaaacccaaatgagcatcttttccatcccaagctgcaagtctccatccgtttcatatcataagtcgttttatttctttaattttttaaaaaagttttatcaaatttatagaaaaaataacaatatctataataccaaagtagtttgttaactattatattgaacatattttaatgatatatgtttgttttgtgtttaaaacgttactatatgtttctataaatttgattaaacataaaaactatttaactagaaaaaaattaaagcaacttatgatataaaatggagggagtagattagccatgaatcaaagcaacttaacgagaggccatgcaacgtgagcgccacgtcagtgaagaccgagtcaaattagctatgtagacgtcacatcagccaaaatcgccgagggatctcatctgcactagttttgacaggacccattgtatctggttttcctgttaacaagttaagagaccttagatgaacttatttcaaagaaaaaaacgtaaagcatcaagacctccctagtatagatggccataaggtccaaggctcgacggcacggcccacgtcacggcattttggcatggcccaagcacggcacggctcaacgagggtcgggcccgtgccgacccgcgatggaagacgagggagagaaaatagacttattttaaaaaggcatgatgggccacccgggccttcggaccgagaatttttttcgttttaagatttttttttaatatttacagaaataatctatcgaccaaaaaaattgcagaaatagcccctgccgcccaaatggtgggccgcaagctgacgtggcaaacggtgggtcgaccgcgccgtctggcggcgtccggcaaaattgcgattaggcccttgccgcccatacagaaggcggcaaggggctaattgcaattttggccgcccattcagagcttgcggccgtactttttcatctgg

SEQ ID NO: 37526 - DNA, 7817 bp, Oryza sativa
tgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttaaacatgatacaactatttgcattgcggttacatagatgatattagattcgaactaggagggaggtagtgcaatagttgaacacaacgacgatgtaataatgggacaaggaagcatgacagtagaaatttcaatatgccaagttgtccgataatagctaacccctacgtgaggatccctctcctctctcaaaccgcgctttagtaacgctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatacgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgccacgccagtttggatcctcaacacaccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacatggtggggtatggtgggtacgcttgattggcaccgaaagatacatgcatgatcggcgccgaaagttacattggtcgtatgcgccaaatggcgggcaaatactcgtatcacacgcgaataaaggaggctgcatcggtgcagcagaaagtagtcgtgcatgcgccgaaaggtatcgtgcatgcgccaaaaggtatcgtgcacatataacaacaacatagtcattacataagcatacagtactggaaagtgaagcaagtaaacaaaaagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcaaagagcacggtggaagacaggaaggggtccgacgaggtcccagcatggtccagtggtggaccctgactcgacgtgccggctgcctgtgacgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaagtagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatcagcgtgtacgtcgtcaggtgctcctctacgggtaccggaatccccgcgtctaaacgttggatagtcgttgaaccgccaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgaccctcgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaactccataacaaactcaggatacgaccgcctaacctggacgtgagcccatcggcgctgcaatacgagacgatcgatgtgatacaatgaacttagcaattaacttaacaatacgataagatcgatgcaacgtacctgacgacggaaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcactgtacagagcagccaacaacgcggaaccccagctccactgaggcacctcgcctaccgcggcgtcggcgatgctcgtggcgtagtgcacgagtcccttgtcgaccgcgtgcccgtgaccgccacagaacatcacccagccaaaaagccagagcaagtacgcctccaaacatcggctgtacgagtactcatcggcctccgcctgtagctgctcaacctgcaagcagtcaataaaatgttaggcaccttaactgcggactaaatatgtaatacgattgtcatttcggtacaaaaacactcacggtgaactgaagcagccacctcttcgtaggtccggtattgcggtggtgtgccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctatagggtaggggctacctcaccgcacggcaagtaaaaagtgtgcgtctctggcctccatcgatcgaccaaagctgctacgagggacctgtccacagtccatcgtctggccgggtccgcgtcgcaggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtaagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatgagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtaaccagacgtggcacgacgacgcctaggacgtggtcgagtggaggtagtgccttcacccgtagggcgagctccatctgctgctgatcctgataatcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccaaccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgtatctggtatgccacactccgctgcggcagcaatgacatgggtgcatggcctgtggagcagcttcggctttgcacaagagcaatgacatgtgccgtcgtctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggttgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcaaaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcattctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgtgaccggttcgacttggcaaccctaaactctctatgaagtgacactgcaaaatgttttaccgcctccttcatatcttctgctctactataaatcgctccctgaataaccttattttctttgtactcccatctcacactatcctcttcagagacgatcagtccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgtccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagtttaacattgattgttatgtcacttgtctgtggatcaactctcaagcccctcattaaccatccttttatagaaggtacactcctctcagccggtctctcaattcccctttctgttacaataaaatctaacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttaactcaatagtcacatataggatctatgaatattacctgaaatcggcgtctgaatccggcagggcttcgccccttcttctcttctcctcccctctcttcttttttttttcactggaattgaggagagaagaa

SEQ ID NO: 37527 - DNA, 4096 bp, Oryza sativa
cgccccaccagagggcgacaagggttttcctgcaaaaaaccctccctccgtcaccgcccgttcctcccccgtttgccacgtcagcttgccgccccagaggtgggcagcagggtctatttttgtaatttttttggccgatagattatttctgtaaatattaaaaaaaaatctaaaaccgaaaaaaattcttcggaccgatacggcacgacccgactgctggtgggccatgcctggacagaagtgcagcccatgggctggcacggcccatgcagagcgagccttatggccatctatactccctagtccctactcccctcttcccaattttccatacctaatacgtagcgtttggttatagctttagctccgcccgccgccgccgccgcctgcgcgaagttgagttcaaaaccgaaccacaaacagactgggattgcatttgcaataggcaggagaggagaggagtagagatctgaaggggggggggaaacggaagtgattttctcggccagatccgtgggaggaagggtatcttcgtgtactcgtctatggggatgttggcgctgaacgggctcatgtccctgcggcgcgaccgccggcggcggcggcggcatcaccggccgcaaatccgagcgcgctgtaagcctctttcctcgctgaacagctcacccgcccatctttatgttaagtttggctcggtggatgtgttcgttattgtcagctcataaaaagatagtatttctttttaatacctatctaactcgtctggattgatgtgggcctgttaccgatttttcacttgtttgacttcaaatttttcactttggtgaatacggaatagcaaagattattgattctccaccactttctccgtttgagctccttttaagttttaatttatttttttttcgcacaactaagcaacggggtatttcagatgggtgataccctgcataggttcctcaggaaaaaaaagatcaaattaattttgggagatatcaagggattgagtgcctttttctgcttttcttccgttcatgtctctgcaaccataacaatcctttttgtgtcgcagcaggtgggcttattgcctcaacgggtaaaagaaagacatcaccctgtcaacaagatgactatgatggtgattctcaagctggcaaaataatgagaaattcaatcccagaccttcctgaggtacgaggcattgaattccgatgatccagaaattttctttagcctgggcatgcttaggctgcgtttgagatgacatctatgatgagattatggtccacatgcaaaacgagacaagtgattagggtatggttaattaggtattaattatccatagattaaaaaaaaggatataacaaaacagaagagagagatagtgacctctgacaataatctatcagcatcaagagtccaataacatgttctgcttgtttgccattttttgctacctgtcttaaactagtgcacaattaaaaggctgctttggtgctcaaatagtcgtgcaggacaccatactaaactacagactgcaccatatagaagcatgacgcctggcgccgcttgttgcccaggagcgaatgccattggctagcagaggaacagcatcagagtccacagcggcaaaagactgggagcccgggcagctgcccatgctggccgggccctgaatccgccgctgcttagatttcaagcataatatcaccacgactcacccatcggactgattatcttgctgactgtgctaggctggctgtatattactccattttttttatatgaccatatggatttgcaatataaatgttgatctttacgtcctccattttttcttcacgcattctgatgtttgtgtatgcaggacatattgtttcgtatacagtcctttatgtcaatgcgtgaagctgctcgtgctgcttgcgtatctcgtgcttttctacattcctggaggtgtcatcccaatcttatctttaataaagatacgattgtcttgaagagaaatgcgtttggagagaatttccacggaaaaattgggcgcattctcaggaaccactcaggcattagcttgaaaacgttccagcttgactacagtggtatgtgtgggttcgatggcactagttatcttgacagttggcttcagattgctcttaaaccagagattgaagaactcaccctttttttgcctgaaacaaacaaacaatacagcttcccatgctcacttttatctgatggggtccgagactcacttcggtacattaaacttcgatgttgtgccctccatcccacacctgaacttggccccttgagaaacctatcaaatctgcatctgttgtatgtgagcattacatgggctgagttagagtgccttctttccaactctcttgctctggagcatttagagctcaatcattgcaaggggataatttgcctgaagataccttgcaccctgcagcagctcagcagccttaatgtcgttgaatgctcaggcttgaaagtgatagagagcaaagctccaaatctctctagtctatttgttagaggatccagggtaaacttctcccttgtagaaacattgcaaataaataagctagacatgggacatgcaatctgtgatgctcgggccaagctgccatccattatgccaaatcttgaaactcttgtcattgaatcggggcatgaggtatgtattctctaaaagatgaggtgctgtagtatggcgatatatacggattactttagtacaatgatatatacggattacattagtataatgatatatatggattacgttagtgagtgttatatatcgattacattagtgatacctgttgtgtaataaatctgatgcatgccatatttgttgtgcaggtggttgatgcaccaatgctgcctaccaaattcctctaccttaagcacctgaccattcatgtgataacaggatcgaccatttcccagccatatgactatttctctctggtttcttttattgatgcgtctccgtccttggagactttgatattaaatgtatgacattggcacgttcattcattcatttcatcctccaaagctttttgatcactctgggtctaattcaagcatatcatccttttcatggtcaggtgactcaggtacgtatggtgcatgaatcgattttcacggattcacaactgagacacatccctggacaccgccatggccacctcaagagtgtgaagatcactggtttcagctctgcgaagagcttggtggaactgacatgttatatcctcaataatgcggtgtcacttgagtgtcttacattggataccatttatggtcctaggtgtgatcaagataagtataggcggtgttttcccatgatagatggtgttctcacggatgctccaagagggcttgcagctatcagaacatacattgaggataaagttccatctacagttaatttgactgttctggaaccttgcagccggtgccatgttagaagaagagggtgaacatcatctcaatcgtgcaatgccgattccattcaattttagatgaaccaatatttgtttcctgaactatttatggctgtggcccaatgtgcaatagtttaattatcttagatggacaatggaccaagctttatctctgtattatcagacctgtttaatgtttattttttgctgtacatgtataagctgaagatttatatgtttttgtccaaaggttgaaattttcaggtgcaggatgtgttgtgatttgtttgttactagcagttacaaagttagtgttcaatctgctgtaaccagggtttgcacttttaatttcagcgaaaatttcggtagcatcggtatttacaaattttttgcactttttgaccgaaattatttgaaattttaaccatacttgaataaactttaaccaaaatcaacaaaaaaattgaggaaatccaaaattttcggttgatataagacttgctggagatgtccaaaaatttcggttgatataatgacttgctgcagacaggaatctcttctcctgggccgaaagcccgaaaccgattgcaagcaaacttgcattccacacgctcattcatgggctgcaggaa

SEQ ID NO: 37528 - DNA, 18612 bp, Oryza sativa
aaacgaaaggggagtgtaacagacaacattcgcactcttaaagttttctcattagatcgcagtcttaggtactctaaagttttctcattagatcgcagtcttaggtggagtgctttgtattatgtttggtgtacatgaaacaatgaaacaactaagtggcaatgagaaactattattgcaaaatactctatcgaagatgaatggctacagaaggtcttgttatgagtgtgtgtactgaattcttggccaggattaaccaagagattttgtaatcccctataactcttggttttggtttctggtaaggctgcagcctgatcctctttgaagcaaacaggtctgccagaattaaaacatgcactgagagtcctagagacactaaaatagtcatcagatcacaattcacaaacttcaagttggcatagcaaacctgttggtatgatataccaaagggcatttggagttggagacacttttccttgatggatggcactagaaaactcagtttccatcaggggcttacaaacctaactcttgaaagggaacctgaatttcagccattaaaaataaaataaccagcatttctctgcattttaaactgtagaagaaacccatagaaatatttgccaagactaaatcatgaatcaataacaaaccattagagacaacacgacccaaacaatgacatcaaactaggagaacgaacccaataagaaaagcaaaacttaactgggctggctggggcttcctcaaagaagaaaatgcatttggaaaaatatgttcagtcctccatctgaagtagcctcaaatacacccccccccccccccctaatgtctctttcctgacactgaaacacaaagagaagcataccaactttgatcttctttatggaagctacagcgtggccaggaagcccaaaatgtttttttcactaccatacggcatacactccaggttttgattaaatctattcagcaggtactgttgcagattcctttaaaatgaaagaggagataatgggacaatgcaaagtataaccaatgcaggttttgttcatcgaacacttgcggttgctattctccagaagattaggcactagtaacaacaagcaagtcactcacatttagccttcgcatttcaaaacaaatcaaatcaacaacgatcatgaccagtatacctgaagaacaatgtcaggaccccaacacaacagtagccaaaataacaaaacaaaagcttctatggtttcaataaatacctcaaatcatacaagatcaaatatcaatcaggtacaggtactactgtactagtgcttcagtctccaaaattagatgatgcaagaacggtaaaaaaaaaaggcatacaaactgaaaagagaactacgaaaatgaaggtcaaatgtattttccattgcaaatggagaggaagaacaaagagttatcccacagtttatcagctcaaatgcagatggtttgttttggaccatatggtgaaacttgatgccccgatccgccggtagtcagaagaccaacgcagtcggtgcagaatgaaatagcccgtacgccatgagagaaatactagcacgggaggaaatccagccgacgggggaagctcgctgcagcaggatctacaggcgttggtgtcgtcgaaattcatcacataaatcggctaagctcattgccttccctttcaggtgaatttgggaaaaataaatggcacggtaaccaaggaattcgagagaaaaaaaatctgaaccctgtggatccacagtttccgctgcaagaatttccacgaacgatctgatggcaacaaaaaacgaacgacaattgaagaacacgcaacagaaatgcagcaaaattcagaaaggggatttcacgacagatggaagaaatcattcaacgacgtcacaagcaaagtaaaattctgatggacaacacttagatcgggtggacatttccatttcatggtataattgcttggattcaatttacagtgctcgaagcgatctgcatctgctactagaataagcacatggattcatgtactactgttgacgagattctaagaatgttactcatatactactaaggtttcaggatcgacagtcgcaaaagcaagagaaaacgagagtagtctactggaagaaaatgtagcaaacaaccctcaccacacgctcggcgctcgtactcttcacaaacacgccccatggtcatgcatcgtcagcttcctcgttgtcaccttgcgggctgccgaactccgggccgtcctcgccgtcgtcggatccatcatcgccaccgaactccgggtcgtcctcgccgccgtccggtccatcgtcgaggccgagctcggggatgaagaccaccatggtgttgaggtcggcgaccttgtcgcgaactctctcgacattcgcgacaagctagtcccgatcgcgcgtaccattgatcatgtggtcgacgtggtggcggaggaaattgcctgccgtgaccgcgaccgcgtggaacggcccctccggcccatcgacatggcgagcgatgtgggggagtgaccagccttactgaaggaggaggcggccggcgtcgtggtggagggcgttctcccggagcatcggcaccagaacgtcgacgatgacgacgatctcgttcgccaggcgcgcgagctgacgaagcttgtggtcacggaccagatcccacccgcgcgggagccgactggccttcgtcagcaactccagcaaggcgggcgcctggcggagctctacgtccgtgacgatgaccttgatggggtcgtcgcggctggcgtacagcatcgccgcctcgcgaagccccgagattgtgaagagaggcgccgccatgctctcctcctcctcctcttcctcttccgccgcctctctctcctccggacggataatgatttgtggcggtcacggcgacccatctcgtgtggactttatacagacgaggtgagggaggggatttcttccggaagtttcgatctgacaaagcggagatggcgcgggaatatttggccgaaaatttgaaggcgggcgcgcttgcgaaaaaacgaaaaaggaaaagggaaatgagcgcgctcgagcaacgaaaatcgaaaaatgaaaggaataagtccactctgagtcatttaaaaataggtcgaatctaatccatgacaaaaactataaaaccggatatctcgaccctcgaactatttaaactggtgtaatttaactgtcttgtggttttggaagacagttttgttgatttggcactgacgtggcaaggttgaggggttgatgtggcgcttagttggtatttgaattaaaaacgtatacgtggaacccgtttgtcattcacacataaaaaattcagtaccactgagttcgacacacttcaacaatatgccactgactttgtcgatatccataatatactatcgccttttacttaacctctacgatttaccatcaccgtctatagcctgttagtttgcattggagaaaagacaagtgtgcccttactgaagattggcagcactgagaccatgtcgtgcaaggtaccgagagttataataactgtttatttatgcaatatgattataaataattacgagcacatattttaagtattttaattatgagcaaatatctccaaggctacaggagggggcggagttttgttttgccgaggactgttgaggagcggttgaggattgcactaatcacagatgcagctctccagcagggccagggccaccgtgtccccttgcatgcgatggcagcgctgacgacggcggtggcacccgccaccagcaacagctctccaacaggggcgtcgtgtccctttgtttgcaacggcagcaccagcagcagccctccaataggggcgccgtctcccatcagatgtgaccacggcgttgacgacagtggtcggaccgccgctgtggatggcacgcggttgggccagcgctacggatggtgatgctggtgacgaaggtcgtgccggcgctggggacgaaggtcgtacgtgctggcgctagggatggcggtgctggggacagcgagcgggccgacgctagagatggcaacgctggcgaggacatgtgagcggcggtgggcagagatgcggcgtggcgccatgacggcactgggaagggtggcaatccggcgttgggagatgcgatgctaggaagaaaggggccctgggccatgcgaattagatgattcaaagggtatttcggtcattactaaaaaaattaacagtgcaaacagcatgtagcttgacggcgatggtaaatcgtaaaggttaaggaaaaggcgatggcatattatggatatcgacaaagtcagtggcatattgttgaagtgtgtcgaactcagtggtactgagcagattctctcaaaaaattatggggcttactaacatgtggcaccacatgtcattctctctctttcttcttcctcccctcttcctcccttccctctttctctccccttttctccctttcgaccggtcgccgccgcacgggctggagcgatgacgggcgggggccagagcggcggcggccggcgggagctgagatcagcaatggaaacgatggcgtgggcggcaccggggagcatggggaaggtgaggacgctgaggaggaaccagttgaggctgagcggcgcgacggcgtcggaggaggaggaggaggccggcctaccgccctggagcgcggcggcggactcgcggaggaagaagcgcgcgacgctacacatggacatatccactgtggcgaacatctccgccagcaacggcaagcacaacgcgtccgccgcccacaccaccgcccccactgccgtcgccatgcccaggctgaccatgctccaccgccttgccccgacgcatatgcacggacgtctcgaaatcctcctccttcgtggtcacctccgtcgtgccgccgccaccgccctcctcctcctgagcggcggcagcttcgtctgcttcgtctctcagtccttcctcttcctcatgttcgatgggcgcgtggacgccgccgagcgccgtcgccggcggcttcttgtcccacatggacttgcccctgtgctccagcccgtgcggcggtggctggtcgaaggggagagaatgggtgagaaagataggagggtggaagaggggaggaagaagaagagaaagaggatgatatgtggggcacatatgtcagtgggccctataattttttatgtgtgtgaatgacaaacgggtcccacatatacgtttttaatttaaataccaactaaacaccacgtcaatcccacaaagtaggtcaaccctgccacatcagcaaaattgccatctaaaaccatcaagggagtcaaattgcaccgatttcaatagttcgggagtcgagatatccggttttgcggtttaaggtcatggattagattcgggttagtaagtcaaagtggacttattccaaaaaaaaaaaaagaaagaaagaaggtaaagggcgtgctcgagcagaccatgccgggctggccagcccgttgctggtgcggcccaaaaacagcacggcctactgcagtactgctaaccggattgtgtcttgtctcggtcgtctacaaagtgaataagtctacttcacattcttcatctcgtacctgatcgaatcgactggcttaccacaaaaccgtataacacatccttctctttccccgcccattcattctctcaccatctctctcatccggatgggtaatgatcttgagagtgacatgctaaagaagattaattaagaagataccattgaagattttatttcgaaatacactataataatgttttagtgcgatgctttccaggtgaagattagaaaaatattcttcttccgttctattttatgttgctatgagtataaaaatataccatgagtaaaaaatacaattgttttattttatgatttactttctccatccatcctaaaataagttcacctaatatatgatgtgacattccctaaatctacaagtttaaacagataaatttttcagattcataatactataatatgttacattctatactagatacatttatatattaggacgaatggagtaagtttcatacttgtttttttcatatgacctccaaaattcacgggatgtcgcttctcctatctaccactccctccatcctaaaatactctctctgtcccagaatataagaacctagaatcgaatgagacatttcctatactataaacctaagatcggatgtgtatatgtcactttaaaatcttatatattataggacggatggagtaggaactatagcctttttcgtgtgtgcggtactcgtggtttagaaaaccatacggttaccatggttatcacgtgcggtacccttctcatttttaaaactatagtatatctcgtgataatcacacggtttttataataaccaggtaaccttttgggttttggggaaccctggcggtagtgcgtgtgcctcgcacgatggaaatgaaagaaagggagagagatggaaaactacgcatttcatggcttcattagaattacacactcacacaggctttgcaagtcaagtttaactgcaacgtcaacttccgagacccatcggccatcgctcggtagaagcctaatcatttcttcatctctcattttctcacatcagctactcaaagcataaaacagcgtgcgagacccaagcactatccgggtgatatcagtagctggctactactagctgctgtatgcatatgccaccgtcgctgtcagctggttcaattctgaacacatttgttgccgcttttctgcttgactttcaggacttcgattggtgcagaactaaagaagaatctgacttgcatcgcaatatcgcacggtatgacgctacttctgatctctgaaaaagaaaaggaagaggagttcgttttgccaatgtcaaatactccctccatcctataatataagagattttgattttttttttcaacgcttgattactcgtcttattcaaattttttgaaattattatttattttatttgtgacttactttattatacacagtactttaagcacaactttttgtttttatatttgaaagaaaaattaaataagacgagtggtcacatatttaagataaaaactcaaaatcctttgtattatgggactgaggtagtaaaagatatattaagctagtattaacccctttacggctttgctttacctaccggtaaccgactacgtcctggtaggcttcacatccttgtcaccgtctttttgtcctgattagtcccacgcattttgtggaaaaagctggtggtacgatcgactcagatatcagaatgctcatgagaggcttcaacgacgtagtattaaaatcagtgataagctatgtgataaactgataatgtgattaactgcacggactgtgtagcaaatttaacgcagctttttataagatctgacaaattaagagtcattttacggtacctcccacttaaggtggtagtagtgtagtaggaataaatctcaccgttgattttgttggtcattctaataatttgtttaagtgaggtggaagggtaatcttgtaattgtgctcccgtgatagatcaaacgggccaggtttgcagacccaattttatttcatcgtgagttgacgaagcagaagagaacaggagggacagccgccgccaaaatcttgcgctcctagccgccgtccgccttcaatctctcctcgtcgcgcaagcatggtcaccgcggaaccatgcataactgtaatcaatcccaaattcatgctttactgtaattaaacccacaacatgcatgcgtgaatgtttagttgtttttaatcaatttagttatcccgattggcaattgcatgtatcaatgtaattaatccagatgcatgtgatctgttgtacgctagtttttcgtttatttgatcacgtcggtcatgccggttaccgagcagattcccctcccgtcagtggccggccgtcacgatctcgcggacgccgtgtccatgaggaggaggtggcccttcagggagaagcgaacgcggccggaggaagacggccgcagcggcgaagccgccctgctgaaaagcttttatccctttattactctgttcgtcggacggatctacggaatagcgatgaactacgaaacccttcaacaactacgtatttacatcagtgccatgttttttttttctaaaatacccttctactacactactactcaatctaataggtgcaatctaataggtgcagtagaaacaaatatgatctgttggatcttatacaataaacggctcgcattcactcagaggtactctaaaaaaatccattaagatgccctggatgcaggaacctctctgcaaattgctggtggagcagacaaatgaattggacgggaaagggaacaggtgagaggatgaaaatgaaagatagagagagagaaggaaaaccacgggattattctggtggtatttcacccggattttttttagatgatggtatttcacccggatagaaagaagatattctcctggtagtggattcgtgcccctcttttctaaatctgctgcaagacagagttcttagtttggcgagcacggttgacaaagttattcagaaattatactattctgcttgtgattcgccaactgggcattcatctatgcagatattgaactgataatctatactatgcacagagataacgtcaaaattatgaaacccaaacgagcattttttccatcccaagctgcaagttcctccatccatcttatattataatacactttattttttcaaacttttaagtttaatcaaatttatagaaaaatttagcaacatccacaataccaaattagtttatattgaacatatttcaatgatatatgcttattttgtgttaaaaactttactacatgtttttataaatttgattaaacctaaaattatttaactagaaaaaaatcaaagcaacttatagtatagtaaaatggagggagtagtataatatggtttaaatcttagtgctcatgcgtagatagacttttaatatgatcttagtgagaatggggatgggccattggtttccatttgttagggtcttagcttagggaacatattaatgggatgtgagtgtgttgctgcagctaatgaatggtaatgcacaagaacatattccgtgtaataaaaaaactaaaagcgaagtgagcgtagtttaatttgttaggtcagctcgcttggtttaaattctgaattagatacacgtgctcgcatttacgactaattcagctcaatggcggagccaagaatttttttaagcccggacaagtctaatgaatggtaatgcacaagaatctttcacatatgtaagattgtgcaaataatatttttcactaaagtatcatcatggttccttgtatcaactaaacgccgtgacattaagtttgagctagagctagatatagataaacacagaggatcctaatccagtacaaatctgattgattaatcaaatatagatcacaataaagtaatgactaatagaaaaacaattcttattagcacttcagtgctcctgctgatcggccaaacgctgtgcttgctactgctcttgctgccaaaaaaaagtgcagattttcatgcagcttcgccagcaaaacagagcaaccgatgtactgatgcagaccgaggagcccgagcagctgcccagcctggccgggccctaaatccgcccctgattcagctgatgtccgtgctgaattcgtaaattttaagatgtaccgaacccgtaattttagatgagctcatagaaataagatatgtgtatgtttttaccggggttagtgcgtgcattgtgagcgccacatttgtcccgtgtttttataaaaaaaaaatacgcaatagcttcacgccaaggttctctggttgtgatcgatcggagcatcagacagccaggtcggcgcgccagctgccgccgcgagagcagcccgcgcgcgacacgagaggccgcgcgcgccgccacaagtcgctcgccaaagctgcgcgtgcagcacagcagccagccaagccaagccagccagcacgcaacgcaacgcaacggcgcgcgcgcgggcgcgcggcgatcccacccagtcacccacagctcacgccgccgcgggcccaccccccggcccgcacaccattttgccgttccgcccctggaacccgcgcgatttagcgcgcgcccctcgcatttcttttcccacccaacccacccacacggccacaccactccaccaccagaagcgcaagcgactcctctctctctcacctccgctcgcctccgcgcctccgagcaccaaaccctagatctcgcggcggcggcggcgaccggggatggcgaagccctggggaggcgtcggcgcgtgggcgctggacgcggagcgcgccgaggaggaggagcgggagcaggcggcggcgttcccggcgcccgagccgcccgcggccgccggtggcgccgccagcttcccgagcctccgcgaggccgccgcggcggcgggcgggggcaagcagaagaagaagaacaagggcaccaccctgtcgctgtccgagttcagcgggtacggcgcgcaggggcagcgtcggggcggcggtggcgccgcccccgtggatccgagggggctcacccccgaggagatgatgatgctgcccaccggccccagggagcgctccgccgaggagctcgaccgctcccgagggttccgctcctacggcggagggtttggcgccggcggcggggaccgccgcggcgggttcgacgacgaccgccgcgggcccggtaggtcctcggatctcgacatgccctcccgcgccgacgaggcggacaactgggggacgaataagaggttcacgccggctctcggcgactctggccgccgtgataggttcggcggcccctccccagccggccgctccgatgacatcgatgactggtcgcgcgacaagaagccgatgccatcgcgctacccaagcctcggttctggtggtggtggtggtggcggcttccgtgaatcacctggtttccgcgactcaccaggcccctccgactctgaccgttggtctcgtggtggtagctttgcgccgatgccgcacaacggcgagcgtgagaggccgcggctcaaccttgatccaccgaagcgggatcccttggctactgctacgccaccagctgaggtggcacgcaaccggccaagcccatttggggctgcaaggccccgggaggaggtgctggctgagaaagggttggattggaggaagatggagaccgagattgaacagaaaactagccgccctaccagctcacagtccagccggccgaatagcgcacattcctcccgccctgggagccctggatcacaggtctcagcagttgggagtgaaggggcaccgaggtcacggccaaaggtaaatccgtttggtaatgccaagccacgggaagtggtgctgcaagagaaagggaaagactggaggaagatagaccttgagctggaacatcgtgccgttaataggtatgtatatgaagtcacctcttgattgcacttggcatttctcatgaatctcatgatactgcaaacatgcaatgcaagtgtactgatatagcttagcgaaggtgtatttcttgtggtaatggaaacatgcaatactggaggactgatataggttagtaaaaggagtgcttcttgtgataatgtaaaacatgcgtattgcaatactggagtattggtataggttagtaaaggtgcaggcgtgcagccttgcataaagaattgtgcaagttctgcttagttcttttctaatatataaaaaacctagcaatttacgtagcatgtcctaacaataattgccctgctgtttttgttatgtaatattttggaagaattgcttttgtgataacttcataattgaaatccaaaaaatgagcaactagaagtgaaggtttacctttatagtatacttcagtgaattaagcatttaatgttaatgtcgaaccatttattgttatgaagttatctgcattaatcctttgaacggtgcagtggagtcaacaatcaacatttacagcaattgttcagttaaattcaatcttctcttgtgggtgctgaatgtagtgatgcatatgcagttatatgttgtcacttccattcaaacttgattgttcaccgttacgcttagttttgtgggaagtgaaattaactggggtcgctagcaaaatgtagcatgctattgtgttgataaagacataatttgcttttataagtcatcactcatggatggcaaggacatggatacttggattggttccttctgaaattctgttcttttagccagtgcaggtttgttttctattaattcaatatatctgtacctcatttttcaggccagagacgaatgaagaaaggatcttgaaagaagaaataaacctcctcaaggagaaactgaaagaaagtgaggccaataaaactgatggtccggaccaagcttcccctgaggatccagaggatttgtcggagaagataactcagatggaaaagcagcttgagttgcttactattgagttggatgacaaggttcgatttgggcaaagacctggttctggagctggcagggtttcagcagttccaccagctattgcagaggaaccacagattgtggtatccatcgtggataggccacgctctcgtggtggtatggagccatttccgaaaccagctgaggaaagatggggattccaaggtagcagagagaggggctcttttggtggaagcagaagttcagacaggttcgtgcaattcttgctcaatttctttccaggttaatgtttcctattgacagttgcatgtaatttgctggttagctgaaatgcctccttaatccttctatatagtttaattctttttgtaaatgtatgatgcatcacactttcatattgacgttaatttttcatgcctgccttgttgtgtttgtcatgtttagttgaatacggaaccttttatatagttattcttcttgtatggtgatataccatgttttgattataagccaagtagcacttcaactttggacaggtttgagattgaacgtatagtatactgttcgattgaagatgagagttggaatgggatatttgtctaggtaggacactagagattcatagagaggatacaaagctcagaattggggtttcttttttatttgaagataattgtctgcaactttgtataaccttttctttgtattttttttcctctgctttgtatttatctgtaattattctctatttatattatttaataaagtacatgaggagcctctcctgctgtttcttgtaaaaaaaaaaagaaaaggaaccatgatcaccaacagcttaaactttgtgaaccagtggtgaagtgttcttgtatgatggttgcttttttaatgggtagaaataggagcgtagaacctttatatctatcttgttcatcttatttgctttagttcttgatgtgatacaatctggtctatttaaaaatatgatggaagtcaaatcagtttctaaccaattgatgttgatattatcggttcatgtgcagctcttaatcggttttgttttgtttctgttcaggccaatgacaaggcagaggtggtgagatacggcgtttgagcatttgttaaggaaactctgggtcctcgttttttgtttcgaaagaatggggaagaataagtcattttcttctgtgttttgactcccattttgtctgatctagaaagattggagagaagcttgtcaatggaggttactctgcgtgaagctatttattatcgcctcttaagttgtagggtattttggttccctttttgtcatctcccatgccaaaacaagacctggcaaactttgatactaactattgttcctgatcggttcatgtcgcatgtggtctcttaagcattcatggatggagaccttttgtatggatattttgatattttgtacagttgcatgtgttagccatctgttctgttatttgttgctcctactattttgccaatgcttcttaacttctctttactgtgcccgttgtactggtgccttgcaatgacatgcctgaagttctctctcacaccagttccattgcaatagaatgtaggataatccctgcgcgcttgttacttatactctttttttttttacggagggacggtaggtgtttagtacctggaaatatgcaagtgattctcttcgctgttagttgcgtcttgccagcttgtggattactgctgctttggtcttggtgatttctgccgtactgccgttgcgcgctctgttactggcttagttggtcatatggtttctgttttttatgtcaatcgctacttccaaatcagctgcagcctcacctgtgctattggagaagcaattcgccggagcggggggagtgagggacccagcgctgtggtgaatcaggatcatttacattagaggttctaatgttctcccttcggctaaaaaaaactcaatcttcaggtttaaatctagacacacaccgattgagtgtttttttacgaagggagtagagaataaatagcagagtgtattaggtgagttgtatccacccaatcaagtatgtaaggctcagatgttgcgctacaatattttagaaacatttttattgtgtgttttgcttgtatcacgtgacctgaacaccgaactggaatggtgattactaggagacaaccggccttgttgtggctaccacttcgatctccagttccattttcagcggctagcgttacaccaaactcgtgcagaaagcgtctagccgccagggcacctaaatcgcggctcaactcgaggaggcgcgactacggcgacttgttcgcataaaacggcctcggagactaacgatagggcagtttctggtaagttatgagaaggatgcagtgaatgggctgatttgaggctcgccggaaaggcaacctccgagaaggggaagaaggttggtgatcgttatagtaacattttgaatgtacctttatctcaattcagccgtgtatccgtcatccaatggctactaaaagcgatggaatgccattttgcaatttatcatataattttgagttgctgtcattcatagagaacttagtattagccagtttacgtacggcgttgaccgaaagtaatcggtttttaccggttttccacggtttttggtaaccgatgaggagggtttttatttcaaaaaccaaaaacgtcagcacatcgctgggtgtcctgtgtttctttcatgcaagggtcttctcactcttctgcgcctctttgtggtttggagtacacttgtacttatgctgttgaattttgtgccataataaaagagagaaactgagttgaattttgtgccatcataaagagagaaaccgagtcaggaagtggaggatcatatgagcaggttatttgcattgcacttgcgcctgagtttttcaaagatccatctattattccgttggttttgtaggttgaacatacggaggtgtgtgtgctgggcgctgtagacacactccgtgctgtcgtacacagtcacacattacaattgtacagactactaacacaagcaaaccacaatcacttgttcttcttcttgttctcgaggacgaggaagacggcgagcgcggcgacggagaacgcggagagcacgccggcggcgacctcgatggacgcggtgacgccggtgatgcccgcgacggcgaagctggccgagggcgccgtctcgccataggccacccgcgcccccgacgcgtcgagcgcgtaggcgcgcacgtagtacgacgccgtcgggacgtcgcgtgccaccgtgtactcgaacttgccggcgccgtcgtacggctgctgggcgatcttgaactgacacgccttgtccttgctcaggtcgtcgtgggccttgcgccacccgcggcccacctggctcgccggcgcgtagcacagggtcaccttcaccgccttgtagccggcatccgccccggccgccgccgccgccgccgtcgcgttcagcgaccatgtcacggtgatggcgtcctcgccggcgtgcaggactggtcatcaatttgacagcgtgacaacgttacattgacatgcaacatgttgccaacttggagtcactattccacttgagattgtaagaactagacgaattagaaatttgtgagccaaaacgcttttgcaaagtcaataatatcaggctctagagccaaccaagtgaagaaaaccacggatttattcaagtatttgtcctgaactatatttcgcgtgcagattatgctaggatcgtccccattgaaagatcaaatcaaggtgcaaagtcacaatcctcttgatcagttttcaccaaatcaaagtacaccaaacacaaaacagcacagcaagggagaataatatatatgcatatggatgcacgcaccttggccggcacggggcgacgcctcgacgacgagcgccttcgcgagcgcggagaggcgcgcccccgccgccgccgccgccggcgtgacatggcaagcaccgagaactacaaggagcagcaacagcggtagaaacacgcggtgaattaccgccccaaaccgagccatgatcgttctctgctagaggtggaggccatttgagcggagcggtagcttatatataggcgtggtagcgtcgagtaagttgactcgtggagagggagggagatcgggggagttcaactttgtggggtcgaggagggtagcgatgggtggttccgaaagtcggagcttgatggttcacgcgggtctgactgtcggagcacgtacgtttggctgtctcgtcggctcgatggggcacctcggtcgaccttttgagggccatggcgatgtgaagcggcgaatgcaggctaatgcagctgtgtggtatctgtagtacactgcacagtagtagtagtagactagtagcagtaccacgttaacggtagtagtcagacagtctgttggtggtggtcagaacacggtacactgtttgccggagaaaaatcacgagccctccaatccaagaaataccattaacgaacacagcttcctaaaaatattattgtacaagcgcttttattctaaaaatatcatcgtcgttagattttcgtttgtagccattcgttgagtgctataaaaaaccattttacccctacaaattattaaatgattaaaacttttactctttcagtcaattttcaatattttagtgtaaagagcaaactaattgagtgtaaactaacgaaaagagcaaaatttttaatcaacctttaataatttatagggtaaaatgatctttttatagcacttaacagatggatgcaaccgaaaacttaacaacgatggtaactctagaacaaaagcacttgtacgatgacatttctaaagagattagatttatcgatgatattttttgaattggggagagtctacacatctgtcgacagatttttcatcataaatttgtcaaaatttgtacctttggattaaacccataaacgatagatggatgacacgtgtacagcactgctgaggtcccgcatctactaatcgatagtatggatgggcttccgacgttaattcacactctcgtttcttaatcaaaattagttggttatttatccatattaattattaatccttgagagctcatctgctcatgtatagtgtgatatctactagatattttttagtgcatacaaagatattaccaatccatctactaaagttacattgttgttacactataattacaccatagttacaaatgtaattatggtatagttacactgtaattttaattacattgttgttacactataattacaccatagttacatatgtaattatggtataattgcactgtaattttaattacattgttgttacattataattacaccatagttacatatgtaattatagtataattgcactgtaattttaattatattattgttacactataattgcaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacagacttgtctcttttatccatcgtattagttagcacaaatctccacgcaaatcatatggcccaaaaatcgacaaatctttaaacgaaaatctgtcgacagatggatagcgaattcgtttgaattgggatatttatcgatgacattttatgaattttctctttttactatggcagttcgcctgttggcaatgcaattttgcccaagtagcccataaaacctccggaccaacacaagcacaagcaacaacagaagaaaaagcccaaaaacaggtaaggcccaaaccgcgagacaggaagccgcaccaaaaacccacacggccccccacgagagatccatcatccaccgtaatcctcctcgacgtcctcacacgcctcacctcacctcacctcaccgccgtct

SEQ ID NO: 37529 - DNA, 2475 bp, Oryza sativa
ttcgggacggcgtcgcggaacccgcggatctacagggagtaccgcgactacatcatcagcaggtaccgcgaggacacctcccgccgcctcaccttcaccgaggtccgcaaggcgctcgtcggcgacgtcacgctcctccggaagctcttcgccttcctcgactcctcgggcctcatcaacttctccgcctccccctcccgccccgaggcgcagcagcagcagcggcagacggaggcggaggccgtcgtggaggcgcccgtggggctgcaggtgacgccacggccgccgccgtcgtacttcgcggaggagaagggaggagggggcaacgagaacggattccgtttgccgccgctgacctcgtatagtgatgtatttggagagtgggcgcctgggatggcgcctatatgtgggctctgtggcatggagtgcagagacgggaatgcccaaatattgaaggtactatcgagttataaagttcctttttgcattagctgggataaatgtgggatatcaaggaggaatgcggtatcaattattaagaaaatggaggtgatgagtggctacgtcatcgaacgcaggctggcgcaaagctcttggcagctatctggcaactgagctgtgcgccattctctctccgtttgcattaggttgtcttctttagcaaattttgggttagtaatcatgtcttgctagatttaggatgctaatggttacagcgctactgtgtggcaatcaaatgattggtttgaactttgtatcatgcatgcaaaaaatgtccaaaggtttaaattctaggctttaggaatgcaagtatttaacattttacaacctacagttttgaataaattacttgtcgtcttgtggagaaatagattcgtgaatatgttatgaaataacagttcttacaaaatattaaaggatatttggctctgaaataggtaaagcgtttagattatagattggatcgccatgtatgtgtctagcatgatgtccttctgcactaatggttttcatggaatacatactccgagatgccattattattattttttattatagtatttcttgcagcatcattactctatttatggcattctgtgagatgtatctattattgttttattataggatttcttgcagcatcgctactttatttatggcatcctgtttatgttgtcgtactccttgacatgatttttgttgcttatgcttcatagcacaccaagcttcgacgggaataatctgagaaaagtacatgttatatgtttgttaacatttggtatgcttgcttttcaggatggttttaaagtatgctcaaaatgttatgccaataatgataataagggtgaagcaaatatacatccaggtgacaaaaaggagcggatcgacaatcattcttctagtgcatggacagatgcagaaactctccttctcttggaaggtgtactaaaacatggagatgactgggatctcatcgcccagcatgtccgcacaaagaataaatcagaatgcattgcaaggctaattcagttgccttttggtgaacatatgctgggcacagtaaatggtaaattggataacagactccataaaatccaaacaaccgatggaaaagtgaacaagtccactgtgaaggagtcttcaagtcaaccaactgaaacagttgatgacatgcagattgatggaaatgaagatggcgctgataaatctgttgaagaacatcctacaaaacatagacggttgttttcttcaatagatatcactgtctcattaatggagcaggtaataaataaataacaaacagataacaaaaaactcgtgtgtgaggacacatagattttaaatggaacgaactgatgattgctattggtacctcagttagcgcatcttaccacatcgacaagcccagatgttgttgctgcagctgctgatgccgcaattaaagcactgggtaatgaaaacccccaagcaaggagagcttttcaactcagtgagaaagagtaccaaaccagggcattctcttctaaccatgcccggcagaggtaaagatatggtatatattgttcttatttgccagtatcagtgcagtttgtttgtattaactgttagggattattgcagtgatgatgttggtggtggtgatcgggatgtagaaatgcacgggcacccaggtaggccaaatatttggatcattggatggctaactattacagaattctttctatatctgttggtgcagttgatccaaccggatctgttattatgttgtctagacttgatctgaatcaccacgaccaactattaagaattacaatcagcgtgaaatttgtcatctcttgttattaacgatgagtagatgacaaatctgaacataaattattactaccagttcggaatcttggttttgagcctcctggcttgagttaatgttattatctactccctccgtttcatattataagactttctagcatt

SEQ ID NO: 37530 - DNA, 2329 bp, Oryza sativa
aacggaggaagtatttgtgtttatactgtgatcgtctaaaaggtatatcctttcttcatgtaatcatgtttcagataaaaagcaggggaagatgtttatttctaccacatatcaagtaagggcagctgttgctacgtccataggtgtagctgctgcccgtgctaaaatgcttgcagaccaggaagaacgggaaatggagctcctaatggcgtccataatagaaactcaggttaaatctcttgacctattcttatttacatctgcgggtatagtttaagttcgtagttctaacactgtttattcatctgaaagttacatatctgacacatcatgtacattcctgcaaaccatttcagttcatgacttcactacctgaacactaccataattcaatctcctagctgtttttatgttctaaaaaacatgatattgtttagagagggatgatatcgcaaacatcgtgcttaaacggttggggaataaatatgcagcatgttcttctacatcaaatggcagagcggagggacataactctttttttagttctgttgtgcgagccatttcctttctatctgtgtgacatattgtaatgtggctaaagggaagaggtccgtctagttaagtctgttcacctagatatcatttttaacttcgttctggatcttgcaaaacctgatgaatcatgattcaagttatgggtttgatttctgctgctagctgaactcctaccatggtggcacagcacatgccccttcctttcacagggctcaaagaaatgaaattcttattgctacaaattcacaaccttattcttacactattactgctgtcttgatgattgtctgactgttttgtttcgaaacgaaataaactctgacagaccttatctatactttctgaatgtatttccttaatgaccgactgctgtctactttatgttgaccagctaaaaaagatccaatacaagatcaaacactttgaggagctagagttgatcatggatcaggaatacgctactctacagcaaatgaagtcttcccttgtcgatgaatggcaaaaggtcctcaagcgagcatttgagactggagtaccaatatcgagggatgaagtgcttataaagttgttccaaaacaagccaaatctgtagagaaattgaccaaagtcggttagatctccatgagggagcattggaggttgggatatctgtactgagggatgtgctgttcgagtaacatccctattccttagagaagttgactggagtcgattatccctcctctgatctgcctctccatagagcagtcatctagcagtttaacattgtggtgtcagagcgtggctgtaaatgtgctgattgagctttgggttgatctcaaaattttgcgtttgagatcacatcgatcctctgtagtttgtatcatcctatgcgattgcacgtgattgctccgttatactatccaactaggttagacaagtagtgttgctaatagcttcctgtacctgtctacatttcgttgatttcatttgttgggatgtgcaaatcttcctccagctgggagtttctgtatgttctatcacattgtctgattggttactttgataaattgatagccattgtatctagagtaaatttcatgtaacctaaggtgttgagtttgtcacacaaaatcatgtgttttaacatctgatatattactctcggttgtacccagactttaacaaaaccacactatgaaacaattattctttgacccacaataattatgagttctaaaatcgaatcttaattttttgacattattgatctattctataaaaagttttatccaagttaacctttttcttaaaaaaatctctacctatataaccataataagcggggtactgggttgtggttttagttttattttgaaagttcataacacccatacccaggttttataaaatttactccatgacagttctgcacctctaaactgtgaaagtttaataaaggagaattctttctttatctgcgcagcaaagccagcaattcggtgtttggagaattggagccatcctgaaccgtttagggtttgatcggacggctggtatggaatctcacagaagggcaccaccatttttccccaacgcggagcggcggaggcggcagccaaaaacccctccctcctcccctcctggactctcggtttcccctaacctcgcgcgccacctctcctctcctcgtcctccgcctccggacgcgcagttcacgggcgccctaatggcgaaaaagggcaaggcggcggcggcggaggccgcggcgcccgacgcgggggtatcgagcccg

SEQ ID NO: 37531 - DNA, 19143 bp, Oryza sativa
  unsure (1)..(19143): unsure at all n locations
tgggcgtccgattcctagtcgtctctaataaattcttaattgccacctcttaaaagtggaaaaaaaaaagaaaagaaagttaaatgtcccaccaaaggctccgcgcgccgcggccgcacccttccgacgcgggctgaggcgagcggactccagtggaggcagagacgtgggctgctgctccggcccatgggcttccacctcgagcctgggccgtcgctgacgtcatcaactcccccccgtctccccacacacgcactcccctgtcccctccccccgctgctgctaggcccgatccactgctctccccaccggtggtgagtcaccacgctgcgtggcaaaccctagttaaccggcgcggcgtccggcgaccgtacactcggcggaggccgcagagcggcagcggcaggcggcggtgccgccgagggcagtcggctcggctcccgcggcaaagcgggaacgggagagagagcagggcggcacacgcgcgcgctgaggctgcgcgcggtgggcgcggcgtccggcgatgcccgggcaagagctataggaaggcgaagtcgtgggctacagccccagtccccagtgctaaggcagtaagctgctgctcactcctaaccatctccccctttttcccttgcttgatttgttgggggtactgacccttactagtagttttagaaatgagaagattgctgaaacgattgcggttctcaaccttgctcgcgtagtctcatgctgcttgagggcttgcccaggctccaaaatttcctggctccgcactttttagagggatgaatccgatgaaacccaacctggcattgtctcgtcgattctctagtggtaaataggagtttaccataatgaccgagcttgtttgatgattataacttagtgatatataggagtttcccataatacctagttgatttgctgattacaaattaattttatggattggctgaacatgggaatgaaaattggtggcaaattcttgcaaattccttactttctgatccgctccatggttcgtgcttcagtgacccttcccctccatctcggacaagctcatggaccaggcagcggcgaggatgataagttaggatttggggttggggcgggggcagtttcctgggtttggagggaggtctgggcagtactggcacaaccagagtcactgagtcaggagagggcagtgggagggctcagcagcagggacgaaggggaacgagaagttccgaggtggatgacagcactagccgccgggtatggggaaggaggtggcgtaggggcagcggatgcaaggaagatggatcggtgcagtgggatatggaggaaggcaaagtggaggggagggggtggggtgcatcgtctgtagaggtggcagcagttggggatggatttgctgtcggcgacctgacgcctctaaggtagagggtatgcagtggtggagattggttagcaggggtggcgttgagtgatggctgggggatggtgtttacattattggaggagaagatatgggcctttggatctcaatcaaacagtcaaaaagcgtaccatttagtgtaaaaaaaaaacttaccaattatatatagtcagccccataattttaggcacatatattggtcatatattcaagatgctgataccaattatttgcatttccccatgtcatatttagtaattacaagttacgtttatggtctatcaataacagttgtatcagcaaaattacatgtttatgatctgttgtcaattttgtttcgtgtactgtattccaagatgcttacactctcgagggtgttcaatttctgtctcgatataggtttctgattacccaagtgtagatgtgatggacacccatcacagcgatcaatatgcaaagagcagcctgcagctgcaattcagggacacctctgtttcctttgaaaacaacaattctgttttggataagcatgatattacaagccctcaagttggcatgacttttgagacagccgatttggcatatcggttctacttagaatatggctaccgtgcagggttcggggtctcaaagaggacttcccatagtgttgatggggtgaaataccgtgcaacatttgtttgttacaaaggcggcattgctaggatcaagcctggtctcaaagctcgaaggaggcttgttgcaaagactggttgcaaagcaatgatggtagtcaagtataacacaactgaaaaccagtgggaggtagtttttgttgagctggagcataaccatccatgtaatcctgaaatggttagattcatgatgtgctttaaagatctccctgactggcagagggagcaccgcccattcaatgccaagactagattgaatccaaagattcactctggcagaggcaggccacccaaccaaaacaaagacttcatggtgaaaaaaaccttctcacaatcaaattattccattgaagcagcaggcaaggctggaaagctgagatttgcagagggtgatgttgaggcactcttggtcttctttgataagatgcaagctcaaaattcaaactttttctacaactgggacatggatgatgaaggtcggctcaagaatgtttgctgggtcgatgctagatcgagagctgcataccagcacttctgtgatgttgtttgctttgatactgtttatttgacataccaatttgtcattccattggttgcttttcttggaatcaaccatcatgggcaatttgtgttgttgggatgcggtttacttggggacgaatctccagagactttttcttggttattcaagaaatggctaaaatgtatgaatgataaatcacctgaagcaattattaccacccactcaagaccagtggtcaaagctgttgctgaggtatttccaaatactcgtcacagatacaatctttggcatatcatgaaagagcttcctgaaatgtctggaagagttgaggataaggaggcaattagcctaagaatgaaaaaggtagtcttcgacactattacatcaactgattttgagagggaatgggttgagatggtcaatcagtataaccttcatgataatcattggcttacaaccttatttgaagagagggcaaaatgggtaccagcatatgtcaaggatactttctgggctggtatatccactgttcgccgcagtgagcggttggaggccttttttgatggatacattacaccagagaccacaattaagacatttattgaacaatttgatactgctatgaagcttaggtctgaccgagaagcgtatgatgattttcgctcatttcagcaaaggcctcaagtcttgtctggtctactctttgaggagcaatttgcaaatgtttatacaataaatatgtttcagaagttccaagatcacttgaagcagctgatgaacgtgacttgcactgaagtcagtaggaatggatcaatagtgacttacactgtgaccgtcattggtaaggagaggaagtatgactacaaagtgatgtataacagtgctgagaaagaggtgtggtgtatctgcaggtccttccagtttaaaggtattttgtgtagccatgctcttgctgtcttgagacaggaacttgtgatgctgataccttataaatatattctcgatcgctggaggaaggactacaaatgccccgaggaatccaaggaaactcccatctcaccaaaagcgatcaaagctacagggaagggcacaaaaccggaaaatgcccgtgaagataaagtggacaatctgtacaagcatggtcaccagtactttgctgacattgtggaaatgggagcaacggaccctgatgcaatggagtatgttttgtcggtcatgaaagaagccaaagagaaggtacggaagttcgaggaatctcgaaaagatagaaggcctggagacagtccagtttctactggtaagagaaatggcaagtcttcaagaccatccaatgaggatgggggcaatggcatatcagattcaacacctgcgactacaacagtggcgacagtcgcggtggccacatctacaacaatgcaggcaacgcctacaatggtggctatagcgcctacttcggcaactgtgcccgccggaatgtttttggtaccaatgcacccacatccgatggttttcccacctttcacccctgcagtaccaccagtggtagcacctgcagtgccacctccagcaccagcagccaatgtgggtgatgtggcttccaactccacaaggaagagaaagaaaagaaaggggaacaaatgatgttcctaatactgattatgtaagcgcttcactttgccgcttctccttttgtgctgtactttgctttgtggtgttgatttattcagataatctcatcgtgcccttaccccgtattttttgttccaggcctaactcaaatttagtcctacaagctgcaccaggccctcctgtccatgtgtaataatggtttatcatcgtctcctgctgcaggatgatctgcccctctgaatgctttctgtgaattatcccccttgacttggaactgtccgtgcagctttggactgtctactgtaaattgatatggaaagtaatgtattatgtatgtagtgcagcttaggaatgttagtctctgtttctgctcatgtggattgcgacctggagcagcgcagtaccaagactaccagtagcgtagcagtaccccttgctggttggtagagtaccattttctttcctttctggagtttgtcactttatgtaatgatgtaatcacactgaactttattgccaaccactaatgcttagtttcatcttatgccgttggctgttgcactgagccctgagcattattttcatcgtatgcaagctcaccatttcttgtcatactgaaaatcgatcgtgcatatggtatgagaatggtttttcagttttctgaaaattgatcgttcacatgttatgagaatggtttttcagcaagcatatgtagaattgtagattaccgatacaaggagttgacccaggaaggcaggaatagtatttcagcatccgtggtgcgtaggatacttcacttcaccctaaggagttggcccaggtgactcaattatcaagccatgttttgacttgcccgattatactcgtaacagccacagatacgacacttgacgcggctccaagaactcctgtgtatattattctcctgcatcaatcctccagatgaagaaaccaacagtcacatactccatccgttttaaaatattgcaatttagtaccgtatttgacataacctaacctattaatctagacatctctattacaatcttgatcagagtcgtagtagattatatcaaataagataccacattgctatattatagaaaagatgatgtgcttattgtctttaatccttgttagactgtctacgcagacgtagatttccttttaaatacgagggtagttttttaaacaataaactacctttcatagagttctcataaaattctaagccaaaatataaatattgaaccttaattttagattaatctaaagcttcttttaatcattttctttttcaagccttcaccttgaaaccgctagagtaaaaatataaaagtttcattctaaatttattgttacctttatttgaattattttattttctatggcatatcagtcacgaaataatatttctaacctctgatgcattatttacgtagaaaaactgcaaatgtaccatactcactccgtctaaaatataagagattttggatggatgaaacacaacataatattacaaatttggacagagagcatgtccaaattcgtagtattaggatgtgtgtcccatccacccaaaatcttttatatttttagggtggagggagtataatccatgtctcgatgacttcatatgctacccctggacaggatgtaccctcatttttttttgcatgtcactcaaataattatgaaaaactttgagaagatgtattaatatgtgatatatccacaaacattttcaaattcaacttctacatttcgcaacgaaaaaaaaacaaatttgactatgaatatatgttaattagctgtagtttaatttgtttttttcgagatgtaaaagtttaatctgaacttgcatgtatatggagtgatatacattcatattcgtatctttttcataattatttgagtaatatacaaccaacaagagagaacatcctctcgagggattaaaatagtttccatcctaccagcttgttaacgggccaaacgtcaccattatgagtcatgacatgggggaggaagaagggcctattcacttagatgctaaaaaaacattaccaaattttggcattgccgaaattttggcaactgtgtttgccaaaatttttgcaggatttcttatataactaccaaaacttggcagcaaactaaatataaccactttttagcaattttattaaaatttgataaggttaaaaattgacattgcagtgatcaggcccgaaaactttcgacgacgaagccgcacaacctgcctcgccctcgcgccctgccatgccatgccatgccatgaacgagcgggaagctctagaagggccggaattcaaagccgcgactcctcccctaaacctggccaaatgggccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcattttttcctttatattatgttttttctgcctttttctttttttcccctcaaatttcaatttttatgggccacatgtactagtgggccggctaccagcccacgtgccactacagtagccgtgccggcccggtacggcccagcaccttcttgggctgtgcttgggccgtggccttggcacgtgggccggcacggcacggcccgctataggagccgtgcctaacggcccgtgtcctagtgggccgtgccgtcggcgtgccgtgtcgtgctgggccgggccgcccgtttggcctgctatatcctccccccacccccacccctacccgcacccgtaactcccccgccgcgtcgtcggctctcactgacaccctctggcccacgcgatttccctcgcccgccgcgcccctatccgccacgtgccgcgtgtcgcgcctcccccctcccgccgcgtgccccctccccccgcccacgtcatcacgcccacacagagttaaaactccaccaccaccctcgccaccaacctttcccactgccccactgcaccgcgctcgctcgcttgatatcgatcgatctcaccatgcggctctacctgtacgtgatcgaggcgcggggcctcccggagcacggcggcgatgggggcggagggccgtactacgcgagggcgaaggtggggaagcagagggcgcggacgcgggaggtggaggcgcgcggcggcggggcgtcgggggcggcggcggagtggaacgaggagctggtgctcgaggtggacgggggcgaggcggtggaggtcggggtggcgcggcggcgggagggcggcgggcgcggcgggagggaggtggtgggcagggtgaagctgccggtgcccgccgccgccgtccccgcggggaggaggagaaggacgaccgtgccgccgacgtggttcacgctgcagcccaagcaccaccgccgctggaagaagggcgcggcggaggcggcggattgcggtgcgtacacgcattctctagctttgattatcgaagtaaattacgtgtgattccgtccgtactttgggttaatccgctcccttctcgaatcggtcggcgcgcggcgcggcggccgactttttggtgaagctaccagtatctttgttagctttgccaaatgcagcacgcaagctcgtagtaagagggattagcatgctgttatacggaatgaaaacttagggtgcgttcgtttcatggacaatgagtggagatagcacatcgttttccgcgcgcacgcttcccaaactactaaacggtgtgttttttgcaaaaattttctataggaaaattgctttaaaaaaccatattaatccatttttgcaatttaaaatagttaatactcaattaatcacatactaatggctcatctcgttttgcgtatcttcccaatcttctcgatcccctatccctcaaactcaccctagtagctttcgaagtcattcgtaattgttttttttcattccagcgtagttcgacgacgtctctttcacggctgttcttttactgagactcgtgctgaccagcaacgacatgctcttttaatttgcactgtttgcacaattaatcatgtagccagcttaggccttgtttggttacacaagaattcaatccgggtcaggaataataagtatagtaagaaatttatgatagatataacgagagaccgggatttattctgagtcgggaaccaatttaatcatgatagagacaataagagaccgggaatcaatccactagtcaagaggtgtggaactaatccggatattttgttgtacctaatatgagtaaattggtttccgaccgggaataaatcacggtctcttgttgtacctattataaatttcttgttatacctaccgttcccggcctggaacgaatgcttgtgtaactgaacaagggcttaaggtcttcgcagcatctgtcctaaactagggtggtgtttggattcagggactaaattttagtgtcattagtctacgtttaatacttctaattagtgtccaaacatccaatatgacagggattaaaatttagtccttggatccaaacagagcctagatttggatacatactagtgatctatgatcagcaagggacttgagcaggctactgcgcacataattctcgagagttatttgaacaaatagtcttaatacgatgcaggaaaccaggatcaaattcagtgtttgccagacaattaaccattgtgtctcagtttatagtagtgcagtgtgaggtgtgatccactgattccctttcagctgggaacggcctagtttcggttgtatacacacacatccccgtttggtgtacacattaactcctctgcttttttaatatatgacactgatgactatttgtcttaataaaaaaattatgcaaaaaaaatgtgcttaaagtatgataaaacaagtcgcaataaaataaatgttaattacgtatttttttaataagatgaattggcaaacgtatgtccaaaagttaatgacatcatatattgaaaacggagagggtgttcttctccttcaggtgaatgttctgctgatatgttgttttttgtatggttgtgaaccagggaaaattcttctcaccttttcactgcatggagaaaacagcgacaatactgttatccactcatcaccttgttcgagctctaggagcgacactgacattgaatttgagagatcaacttattgggaacattcaagttccaacagtgggacggttgattctcccaggagttttgcaatagaacgatcttctttagaaaattctgaccgttcagcccaagcaaattccaattccaactctgaagatgatgatctaacagagcctagtgcagcaacagcaaagggcacaagtgacatcgaaccaatggttccagatgcaagctttgaagaagctatggaaatcatgaagtctaaaagcatccctgacatgccagaagatcttaatggtggtgtcatgttcgatcacacttaccttgtggactcgaagaatttgaactctcttatctttgggcctgattctcagttctccaaagagttgcgcgagttgcaaggaactatggactatgaggaacagccatggacatggaacaataataatcctcctagcttaaccaggacatgtcaatacaccaaaggtgcaacaaaatttatgaaagccgtcaaaactattgaagagcaaacatatcttaaagcagatggcaagagttatgtaattatgactcgtgttcgtactcccgaggttccatttggaaattgttttgaggttgttatgctgtacaaaataattcactaccctgagttgtcgtcaagtgaaggaatgtcacatctgactgtatcatacaatgtagagttccttcagagtaccatgatgaaaagtatgattgagggaagtgttcgggatggactgaaagaaaattttgaaagttacgcagaaattttgtctcggcatgtaaaaattgctgattctgctgggatggataaagagcgattattggcaccgctccagactgatcatcagtcagatatcagacttgcttacaagtatttttgcattntcacagtcatctctacagtgataatggcactgtatgttcttgtacacatctttctgtcaagaccaggccctcttatgggtcttgagttcaaaggtcttgatttacctgacacgtttggagagctgatcatatctggcatactagttcttcagctagaacgtttactgagtatgatatctcgttttgtagaggtaagggtacagcgaggtatgtttgttttctttgttgtgcatttactgtatttctcgtgcactagacatgcaaattaacataaagtcataactatgctaactatgtatcttcttttgtcacaggaagtgatcacgggattaaagcaaatggagatggttggttgttaactgtagctctgctagaggccacaagcttgccgcctgtctctagcggttccgtagatccttatgttgtgttcagctgtaacggcataacacgaacaagctctgtgcaacttcagactcatgaccctcaatggaacggttagtagatttcacacgttaactcactaatctcctatcttaatttaattcatcatctattacaaactgacagaacatttcagagataatggagtttgatgccatggaagaaccacctgctacgttggatgttgaggttttcaattttgatggaccatttgatctggcagtttctctgggacatgctgaaattaacttccttaaacacacgtcagcagaactagcagatatatgggtgccactggaaggtaaattagctcagacttgtcagagtaggttacatttgagaatatttctggagaacacaaaaggacctgagacatcaatgagagagtacttaagtaagatggagaaggaagttggtaagaaggtaacttccgactaacttgttcctgggtactgactcttaactaataattaaacctcttgatgatgcagtatttgtatttatattgcagttacatgttcagtcacctcacagaaatgcaacgttccagaagctttttggtttaccacacgaagaattccttatagcagtttatgcgtgctccttgaaacggaagttgccgttgcaggtatgattgttcccttctctgtgttgaggattcagtttgagcacattgcggttgacatgatatgaaatcaatcctagaattttactttgaaaacattgttttacttaataatccaatatcaccttatactactcttatgtcttcttttggaccattacaatatgaaaacatcaggtcattcacatattatatctgtggatattaatattagtagtaacttgcagttgcttctgatgcagggaagactgtttctgtcagccagaatagttggtttctatgccaatctgtttggacataaaacgaaattcttctttctgtgggaagatgtcgaggaaatcgaagagttaactccatctttcacaacagtaggtactccatctttgttgtttgtcttgaagagcggccggggactcgatgccaagaatggtgcaaagtcccaagataaggaaggcaggttgaagtttcagttccattcgtttgcttcatttagcaaggctagcaggttgttttatctcttcctagctttattaccagtattttttttttgataaaggaagcttttattaatctcagacgattacatcaagttgatagaaccatactaagaaaaataagataaggagaatctatttgacgagaaaactatctgttcttcattgttaggacaataattggactatggaaaaccaaatcatcagctattgaacagagggctaaactagaagaagatcaagaagatgaaaactatgtcgatcttaatgatgttcaatctgtattgagcattggagatgtgccactgtcaaaggagtatactttggaactgcctatcgatgtgagttttctgcttcattagttcttctgctgatagaattgcgtttgtttctccccctttttagtggaagaggctagataagttatacagtacttgtgtaaacatggatgtgaattttcatccctcgagggtatgtcctttcattgcttgcatgtcatataaatagttataaaaaattgaaaaaaaaaaaacaagatagattaactagtggcgttcttgcatttaacgatcacttgtcagtgtacttcactcctgggattcgtttttctgtacagctgcactgcttgaatattttcgtttatactcgaatttctccaactttggttgaattacattcaaatcagttcaaaattcaaacacatgtcggtgggattttgtccgacctcccaaaatcttgtacttccacagataagatcctaacccatgcttgtcaaccaacacgctgttgtgccaccaccatctgcagtctgcagaaacccccgttttccatcgtccctttgtactttgtagtactacatggttgtcacttgtcagcacgctgttgtgcgccaccgttccttcgatcgctttctgtactgtactcacaattgtgtgtgcatcgcaggcggatctgctgatgggggtgttcgacgggggccccctggaggcgaaggcgatgagcagggcgggttgcctcgactacgccgccaccccgtggcaggacgcccggcccggcgtcctggagcggcacgccagctacaagttcaaccgctacatgtccatcttcggcggcgaggtcgtcagcacccagctcaggctcccctccgacgacggcgacggctggaccgtctacgacgtcatcacgctgcgcaacgtccccttcggcgacttcttccgggtacgcacccaacaaatcacaaccacaaccacacctatgaactctcacgtacttactacgagtcctcacgttggatgctagtgcttgctgtagctaagatgtcgtcatgccactgttttttcctctcctttttattttggtgtggtttgaggagagtggttagctaggcaagtggccgtgagtgaaagggtggttatgctgatagtggttaatattaagatatttgcatctatccagtaaaaagtacctcgagatacaaatcgtttatggttagatctaataatcggaaacgatttattaccgtactagtatctagatttactttttattggaccggagaaaatctctaatattaatgtattgtgtgcgcgattaatttgattataatgcagttgcatttgaggcacaacatatggagcgtggaggccgcgtcgtcggaggcggcggcgagcagcgggagccggtgcgagatactggtggggatcgagtgggtgaagaggagcaagttccagaagaggatcgcgaggaacatctgcgagaagctggcgcacagggcgaaggaggtgctcgaggcggccgccagggagatcgccccggccttgtcgggctagcgagaagctggaggagacggctgttttttctttttcttccagcaaggccgcaacggagaagatctctgcagaggagcagagtgcacgactgaactgtgtcggcttttgccttggctgtagcgtagtagtatctccaaaacagaacgaaacaaataggaatacggagatgtataccaactacagtatatacgatatcttcaagaagtacacatgatcccaaaaaagtgtacaagtgtcgagcccgaaccgagctgtgcgtgcgcgcgcgtgaccagccggccgaattccggtggtttttcctcgtgtcgagccggcacgatgtggtgggaggtggccaactgttggtagatcgggcgatgccgtattgaacatgggcgtgacttctcgttggatagacaagatcatcatctgcggaacgtgggtgcatgcgacttcctggtgctgttgatctggccaccgcagtaccgcaccgctcatggggagagtcatggtggtggcgctcggtttgtatggatttccaagtgtacattcctgaggtgtgcatccctcggtttcatcttaggtgtacaggcttgaatgctaatcgagttactcatcataaaaatgtctaattctatataaaatgttatatttataggtttttatcattgttaatcacataaccagtttctcggcaaaatctatatgattaaggcacgcttgaatagaagttttatctgagataagaaaacgagccttataacactttctcgatcactttaaaagaataaataaatgtatcggatctctaacaccgtgaagaccgtatggatcagtctgcaattgcaaatgaattacaactagaagtgaacttgctaacgaaacgagaaaattggcttacgacattataaagcttcaaactgtactacaagtctacaacaacattgaattgtgctaaaaaatcggatgatataaatttgaactctgatttttttttcttttggtacgaacagagaccaatttcccctcgagctcagcctcagagccggcgctaggcaaaggggagggcacccaactactacagtacccaagtcgtcgccgccgccgcctccccccaaaatcgcccaaaataccaccgagccagacgccactacgccataaaagcagccttcactctcgtctcctcctccggcgccgatcccctcccgaattccgccatggatccggcgccgcaggcccaccccatcctctcctacgtgctctcccgcctccccaccctcgccaaggcccgcccggccggcggcggcggcgacttcgacatcgagcagccgcccgtgcacacgccgtcgccgcggacgccctccaccgcgggggagttcgagctcgtggagcgtatgccggggctgcgccacccgtccgtgctccgcgccatgacccgcgccgtcgccgacgtgtcggccgcgcgctccgcgctccaggtcctcggcccgcggcccgaccacgagctcgtcgactcctcccgcgcgatcgtcgccgcgaccgacgccgaggccgggggctcgcggcgggtccccgagggggacctcgaggcctgccgcgccgtggtgcggctcgaggagacgcacgacgcctacgaggcgctgctgcaggaggccgaggggaggctcgaggcggtgtaccggtcggcgatggaggggaaggacctggaggagcccgacgggagggacgaatcggcggcggcagccgccggggatgatgctgcggtgcaggaggaggtgatcgcggtgctgaggcaggccgaggagggcaagccggtggagagcgtccgcctcgtggaccggcagctgcgccacctgccggaggcgttcgggaggatccaggggctccgcgtgctcgatgtctcgcgcaatcagctcgaggtgagaaatctgttatctccgcatgctttagatctgcttgtttagaaccctgtaacccaaacaatgcttgtactgggttttgtacgcatttagacatctgaacggatgggatttttctcttctgtactgtgaaattgtgaattgatggattgaatcttatgttgaagatgatcagaaatatagggccatatgcaaaatgtgtacgtgagcgataaaatgcctgttttgtggtgttgcacacattctaccatttgaactgtatgctgaaaatagtttgggcactgaattttcggtaggattgtgttttttgtgtgtgtgtgttatggtatggtcagttcctattatttttagagtcctcaagactgcgcatgtactattttctttatagatttactagtacaacttatttattggtgatgaaacagttactatcttaggccttaggatgtaaatagtgaaacactgtatgttagtatttctttttgctgtttttatttgattactaaattaggctatgggtggatgagtgctgaaagttatggatatagtgacccactagtcttgttttagagtactgagagttagctgttgaccatctacagtctgaaactcagaataactggatactagtatgtagtaagtattgacagaacaaatgtagaactggtaggagcttggcgtgtatgtaaattcctgattagattgtggattcactttctaatatcatcctgtatttaatggttggcttggatcattggaaaatcataggtaagagtagggaaggctggctttgttttgaattttggccacttcctctatatccgtgtttacattgatgtttagaaatttcttagtttatttttgggatattaggttgtgctcatttgagtttaaaaatagacaaacaattaagcacatactaactataattattttctttgataaacctttatactcagttatttaaagatagacataaacagttaagcgcgtactaaatataattattttctttcataacccttttatcctcagtggcttgcctggtcatatttccatagcgacatactgtacacattttgttaagtatgttgttgttgtgtcccttgcttcattggtgaatcaatgtgattgtaggttattccagatgctataggaggacttgatcatcttgaagagcttcgtcttgcttccaatgccttgatttctcttcctgattccattggactgctattgaatttgaggattctgaatgtgggaagcaacaggctaaggtcattgccagatagcatctcaaagtgcaggtagataactttctttagcttaactcttgggttcagcaaatgttactgttcaagtgactgattggtgcaactccaggtcattaattgagcttgatgcgagctacaacgggctcgcttatctgccaaccaacattgggtatgagctggtaaatctgcggaaactctgggtccatatgaacaagttgcggtcacttccatcatctatctgcgagatgagatcattgtacctcctggatgcacatttcaatgaactatgtggtctgccatctgccatagggaaactttcaagtcttgaaattctgaacctgagcagcaactttagtgacctgaaggatctccctgcttctttcggtgacctgctgaatctgcgcgagcttgacctcagcaacaaccagatccatgctcttcccgacaattttggtcggctggataagctagagaagctcaacctggagcaaaatcccctttctatgccgccaatggagatcgtgaacaaaggcgtggacgcggtgaaagaatacatgttgcagaggtggcttgacatcttgctcgaggaagaacggaagagcatcgcagcagcggagagccctcaagcaccgaccactccttcggcctggctggcacgcagcgtctcctgggtctccgacgtttccggaagccttgtggggtacctcagtggcgagaacaagacggagaaagatgcctacctggatcagcagtactgaaagcgctcacctgtgtggtgtttgtgcaccgtgtacatactataagcgttccatgcttaccatctcatctgggaaaatcgttttgtgttcctggtgagtcgagccatacactcgtgctaggcttgcatcccccaaagcaggctttggggtttattttgcccgttttaacttccggacgtccttttcatagcttcacttgttacagtattatattactttgtcgaataataatgtggagacaaatatgaccggagagtgcgctcaagaatatcaatgctttagagctttaggcctcaatgtttcgacctgtgcgttgtgctggaatggaagcggcggccgtgttagtacaggttgccgtcgccggcaattgtgattcacgttttgctcatccgtttcttggcaattgcgattcatattttgctcatcgtttctcgatctcctttctgtgtatcacgtgttttcaaaattttgcaaatactgtgttacacgtcgctatcgcgtacgagaattctcccaaaacccaatcactttcaacatactccccaccaacaaaaggggagaaaccgaaccagcagcaacgtccacgataatagcgcaaagaaccagacgagcaacacaagtttaatacatcatatagcataataaacaactagtaggtacggtacttatttcgattacacaccgatgattagaagtctttaaacaccactactggcactacaccagaccctctaaggttgctggcgagtaggggtagcacagcagcacgaacgccgcttttaactaggtaagctatttataaatatactacggtctatatcttggatactgcaaggtgctcaatagctgaacacgacgaggtcatcactggcccttctaggaggggcaaaaaagattcacggccacatgcttcctcgccgtccttggtgagcgccttgttcatctccgttctgatcagatgccctgatggggaaataagaagcaaaggttcagattaactcttacccgcaatgacaaaatatggtgcataggaatgagacatcctgaacttaccagttcgtgcagttcatcatggagtgcatcccattcgaggatgccacagagttcatcaatggactgctccaggttgtactcgttccgcctaattatttccttgttcaggtcgacttgcccgaagcccatctgccccagctctctcagcatgttgtcctccacggcactgatgtgatcagatgaaggctcggtaggcaggcaagaagcagcgcgagcagttg

SEQ ID NO: 37532 - DNA, 20655 bp, Oryza sativa
tgcatcaacagaatgcttccattctgtgttgcttccttctgggggcatgttcaagtttatagcagcactctgcttgttgctactggttttgaccgggtgctccacctgcacatgaatttggaatccaaatgatcagataacaaaggaagtgccaaagccaatgaggacgaaaaagcaatctatggtggaacaaacctgaataaaaacccaaactcgctgaccaaacatctggccagtgggtgatgccaatctccagtacgacacgtacccaccaggctttgcaggtgtgacaaaatcaacaccaacatcgatctcttgatcaatagggaaaccatccaccgagatctgcacatgccgaatcagagttaacattttagtgcaatactgcctaacactcttgaccattcgttggtagttatactaaatacgaaaagggtagggtgtacccctaatttaactgagctgttgcgtgcaaatagatgtccaccaacccaggtaagacatgtcccatatggccacatggaagatccattgttatgtatgcgccaaatctttgtaaatggggttgatggtgccattactgttccatcagggacagtaacatccttaatgaagcggcaatcatgtagctgtcgaagatgtggaaagagcatctggttctgaaaaatggccagatgacagtcagttgacactgttctggaaatgttttacgagaactatatgatcatgaatttgaacaagttgctgctttcacctgattgaggtctctacatcgtctactcccaaaagatggtctgtctattctggtatattcattcacattgcccattcgagaaaaacaggtattgcataaatcataatcatctttactgcacgcaaaaaacaacaaatcatgttagaataatggctttttttccttccattccaattcaacttacgatgatgaactagaacaaccattgaactcaaaactcacatatttgacttgtagcgagaaccagcgataggagtgaccccacagccatcgcactgtatccatctatgcagtgtgtgctgcgccatgctctcgtgcttatcacttagatccctgtatgggcacctattacagctgctgccttcagaataaggtccataaagaccgactggtgagagattatctggcttggatgtgttacttttgcaggtgcatggagggaaatagtgaccaccctttaggcttctgtcagcttggagggactgaactgggtaatgggagagattctcaggcttagatgtgctacttttgcagatgcacggagggtaagagcaaccacccttgatactgcttttatcagctcggagagactgaagtgggtaacggggaaacagtggtggaggagggcatgtcgagttcaaatcaccaccaatctggccattaggcccaaaggactcagaagaaaggcctagttgtgtccagaaaagatcacttcttaacccttcaccgcaatctgaagcaggagcagaatgaacagtaggtgcaccatgaccaatgctagtaacttgtggcacagcagaggatgtaacagacttgcccttactttgggcattggtacttcccttgttatcaacttttacccagcctgaaagggtatccacataataaggatatcccgatacatgttcagcttgagctttgatgtcatcaagaagcacacccttaagaccaagtgatttagttgatccagagttatgcatatccagagggttcgaagctgaaacagccatgagctcagtgtcatttttaatattcaaacttcccaaagtttgtcccctaccactagaggagccagatgaaccatcagcagaaccactggaagactgcattttgctctttggtgccatcagtttagcaagccggtccagcaaatcagccaatgatggcgctgatgatgcagctttagaacgcaagtcatgtgatatttttgcaaggacagtgggaacttgttctggtacaaattttaaagcttcatcgatagctaatttcacctgagccaattgatcttccagagcagtggacattacagatatggaatccaatacctgctgttttgtctgatgtaccccatcactgctgctcttcaactcaacattaatcctaagagggttcagtctctgactaatggcagcatcacataaatcactatcatcatccagtatgacaacatccccatcctcatcagtataggtgagtacaaactcagtatctggattgaacttaaaagcactcgcaatctttgaccgaagagcagccagattaagatcaaagtgcggaccattcacaaaagcagtgaaccgcttaagagtgccaccgaattttacctgaaacatcaagcaaattaaaagagaaatagataagaataataatctagtaaaattgcacgaggtaaacttaaatagaacagtaagtggtttgctttgcaggcaagatgcttaagcaaatgataactcaattctgttcttatcttagcagctgatcaatgttgattcagttaacagtagcgtcaaaacacaattcacggaaccaaatctcagcacctgatgctacataagtaccaaaattacatggcattaatcagttaaggacgactgccaagttaagccgttgcatgttgagggaagtgggttgtcttctacactgaagagatttatacagccatatcatgcaaacctaaacagatttattcaaccatagcatgcaaaactggaacattcaacataccaacaaattacaaaggaacatacatcaaagtgatcaagatactctacaatcaaatccccatagcaagtactcttgtctagctaatcagaaaaacaaaaagccctgcaataatcttgatttcgaaggagtcctcacaataatcgccggcgttaaagactgatatttctacactattttacaatccctgcaataatcttgatttcgaaagagtcctcacaaaaatcgccgcgttaaggacccgatatttctacacagtttcacaatcgcaaacaatacagaaacgatctaatcctgggcgcccaaaaagatgcaaaatccatcctttcaagaacaacactaccacccggtcgcatcgctccacaacccagcacgggcaacagaacccactccccacctccctgcgacaaaacccccatgcgcgagcaaaccaagaacgcggcattcctagcacagaaacaccgcacccgcgaggagccgggaaaataaattaaaaaaagaaagaaaagaaaacctcaccttcacgacgagatccctctcgccctcgcgcgccgtcggcgcagcgtcccggcggcgagacatcccgaccaaacgaagccccgcgatggcgatggtggcgtgagacgaagacgacgaggcggaggggaggaggagaaggagacgggttgagtcaagacctcccttttaatccgtaagcaaattccgtttccttcgatgggaatggaagggattgggaggaggaaattcacgggctttcgcggggttttctgcgtaaattgtactgcgtcctcgacgctttttgggcccacctgtcagtgagaggcgggtgcctcggtggcgtgacaggatgaaaagggttggggcgttttgtaattctggaattagtttaagtgtgtgctcgtggttttgtactatagtgcttatctcattgtggggtccattggtcagtgggatcgtatggataggggatggaattataatattatacttgtgtaaataatccttgtaataacctaacggacgacctcacgagtcacgaccaaaatactcctccttgtgggctgtggcagcttgcttcacgttcaccgtcagcccgtcaccgatctttctatgacctgtgggccacagcgtgaatctttgtcttatccccgttttgcagcagcaagtcagcaaggacgagtgaatgaccattgaatgctgacgagaccctcgcagttgggaactttggggtgctgggttacctttacttgtggatgtaaaagtactacgcgtcgatgcctcgccttgacacggatgaactactgaccacgggaggcagcgagaggccgacagctcggcacccgccgcatctgcggcggccatccgacttcgccgaggcgagccgtcgcgctcgctgcgcccgtgccccggagatacgagaatttccttggctcggtcgcggtccagcagcacaagccgaaatccacgatgcgacggcgtggaaaacccgcatcagcaacacgccttttctcaggctctcgtcgtgctcgcccccgtctccgttccacggatgcccacgacaccccatccgcgcgcgtggcgcggcccactcgcgtagtcgcgtggatggcacttccaccggctctcgcctctcgcgcggccaccaccactcgcgacgcgggccgcacggtgccacagcccacgtacgttcccccgcacgcacgccacgcgagatcgagccgcgcggctcacgggccggacgcacccaccacgcgcgccaacgggcgagcagaggagaggagacgtgcgtcgtcgtgtgtgcctccgtgcgagacgatgtctgaatctgaacaccgatcctttgcaaaggttggggcaagttaacacgcccgcacgcttcggtcggagcagaaaagggcgagcacttggacactttgcacaggcatcagcttgggcgattaacggagaacaaaaaaagcttggacgattaacacactgcgtggtagcaaagcatgtccgtcgctgcgagcctttgctgcatgtatatatacacggatttttctttccagtgggactggaaaaaaggaaacagttcacagggcgtaaagtcctgtgattaaagcgaatacatgcccgtttcttttcgatatcttgagtgcacataataattgttttggttgttcttctagattagtatacacgtacaactgaacacgtagatgaagaaagcttgtgggcttgtgggctatggcatgatggtatatagtcttctccgggacctacaaaataacacaaatacacactcaactgagcataaaatgcaagaggtggaggtggttgcaacttgcatggaagcaaatgagtggacggtggcctgtggggaaccaaaagaacttcaccgcccaaagtagttcgtctaaggccgtgtttagttatttagacaaaaattttatatgtatacagatacacatttaaaatattaaacgtagaccaataataaaataaattacagacttcgcctgtaaaccgcgagacgaatctattaagtctaattaatccgtcatgatggcaaatgtttaatatagtaccgtattatcaaatcatggtataattaggcttaaaatatttatttcgcaatttacatgtaaactacatatgtgtgtgtccaaacatttaatgctctatgcatctggacaagcagctggacaagcagcatcaccgcacagagtcaatcgtcttagaattggacaagcatttttttacacgatggaaacggtttacatcctcagtaagtgacgaacgaaaaaaaaaaactagaacccaatgtatactaattacaaaattattcactgatatatttaattaatatggtataaattagacagaattgaataatctattcaggtcctgtgaccacacgaaggagtacgtagggacaccaatgtctcctacatatgctacaatgcacaaacacttcagtattttggtgtagaagtgaaagcatcttgaaggttactcatggctatcaagtctttaccttcctacacaatgaatctagagcaaaacatgcgatgaattaagataaactatctcgatttcattaagcagtcagctggtggacctgtgataaggagattaagatgctcgtatctagatccgtcctcagtgcagtacggctgaagttatgtcctcatagtatttgacatcaacatttcatctgcctagggaatatgagctctaatgctctcgagtttccttaagtggaatgccagcccaagttgttgcaacttgcaattgcaactgcacagcgcttgatccgagaaatacagaaggtccgagggcccctttgaatcgcagggtagaaaaaacggatgaataggaaaaacacaggattctgacatgaattgaagtgtaaaactgaggattgcaaacacacagtaaaaacacaggaatggtcgtttgattggagcgcaggaatcggatgagagagatagactcaaaggaaattttccaagaggttggagctcttgctaaatttcctccaaaatccacatgcaatgtgccattccataggaatttcataggatttggaaagcttcaatcctttgaatcaaagggccaaatagaaaaatttcctataggatttgaatcatatgaaattcctacataaatcatttgatttaaaggggccctgaatgtagctatgcagggcaatggtcttctgaatattgtattggctagaacttcaggtcaatacataggggaaagtttcaggcaaattttcattaccacggcccattattttgtgacaacatcagaagagaaaaggagtattctgtaggtcagtgcaaaatcgaagtactgataccatgcaaaaagaaaaaagaaaaagaaaggaaacaaaaacagagttctcgggactaattaagtagaagaacttttagattttgatgatgaatatactcccctttttttataagagaactgatgatgaatgtacctgaactggagtattcaaacttttcctccacatttttggaccacagttgatttccttattgttttgtttacaaagaagcactgcagcaaaggctccccaaatttattaaaccgcactcagtccactcaaccttggcccagctccgcaattagttggactggattgcacaactgtcaaatcaatgggctataatgaatttgttatgcacccacacacacaaaaatatgaaaagaatatcgccatttctgaacctgcacctgataaaaacatctttacatagttccagcttggtttatgtagtccatcacaagtccatttcacataaatattccggaaaaatctgtgttttctaaaagataatgagaatcccgccatttcagcctttcactcaacaggagctagaacctattattatttatcacattacatcgtatgtcgacaaaatccacaaaataacaagataaccaaacatttcaactcaaggaaagagataacataatccggaaaatctctcgttcacaagttgaatcgactaggactgaaaccccactcagtgacaggtaatatcttctaccgaatgctgcacaaaagagccaagtaaacggagtggattctaaactcgaaggagatgaaacaatattgttttaaaaaaaatctacaagataaatttatatgtgttaaatcactccataaacatgaaagctcaaatttaacttatgctcccttagattaagtttttttagaacggatgaaatacaagttaaaaaaaaatctaactgcgaaattcagcaaatttttactgaattttgctctcctcttctcacctctcacttgtcatccctaaaactctcctggtccccgcctcccgcaccacgccgtctccgatcaagattcttccctgatccccttgctgctgctgccatcaaatccttggacatttccagttgcaaatttagactcttcccccgcgattcccagcactcccaagtcccatccttcccgctgccccatcccatcccactatctccctaaccactgtgatttaaccaccgaggaggcggcaagaatcgtgtccagctccgcaccgttgttaggcgggagtggagtggactggttatcgtccacgcaagacgacgacgacgacgacgacggccggagctcgccggagcatcggtgtcagagatgagggtcatgaagctcggaaataggccggacaccttcttctcgtcaggccccgtcaggtagttttgtagttttgttcttgttcatcgactgttacttcgatcgtttggttgtcgtgtgaatcgttttttgtttgatcggtgttggtgttggttgcaggtcggtctccacggatttggccactgacatgcagattcttgtggatggttgcctgtttcgtctccacaaggtaagctgcaaagattttcttgtggtttgcgtcgatcaagaactgaattttttttctctgttttttttttggtctgttggatggaacagtttcctttgctttccaagtgcatgtggctgcaagcgctgtgcgtggagtccggcgacggcggcggcgccgtcgagctgccggctttcccgggcggcgcggaggcgttcgaggcgtgcgccaagttctgctacggcgtggccgtcacgatcgggccgcacaacgtcgtcgccgtccgctgcgccgccgcgcggctcggcatgtccgaggccgccgaccgcggcaacctcgccgcgaagctcgacgccttcctctcctcctgcctcctccgccgctggaaggacgcgctcgccgtgctccactccacgcgccgctacgccgcgctctgcgaggagctcggcgtcacgtcacgctgcgtcgacgccgtcgcggccctcgccgtcggcgatgcctccggcgccgttccggccggttcgtcttcgtcgtcgccgccgtggtgggcgcgtgacatctccgagctcggggttgacctctactggcgcgtcatggtggccgtcaaggcgaccggcaccgtgcacgcgaaggccattggcgacacgctcaaagcctacgcgcgtcggtggctgccgatcgccgccaagaaccaccacgcggcagagcgaaccgccggcggcggcggcggcggcgcggccaatgccgagcgggccaccaagaaccaccgcctcctcgtcgagaagatagtgagcttgctcccggcggagaggaacgccgtctcctgcggcttcttgctgaagcttctcaaggcggcgaacatcctaggcgcttctccggcgtcaaaggcagagctcacgaggagggtggcgtcgcagctggaagacgccaacgtgagcgacctcctgataccggcgccgccgccgtgcgcgggcggggtgctgtacgacgtggacgccgtggtgaccatactcgaggaattcgcgctgcggcaagcggcggcgtcggggagcccgaagggcagcccggcgcgcgcgggcaggcaccggcgatcgatgtcggccgagagcggtgagctcgagggggcgcgccgttcgacgtccatggcggcggtgtcgcacggcgcgatggtccgggtggggaggctggtggacgggttcttggcgatggtggccacaaaggacgcccgcacgccgctcgacaagatgatcgccgtcgccgaggccgtgccggacttcgcgcggccggagcacgacgatctataccgagccatcgacacatatctcagggtgtgcatgcgcgcgacacttgatcacgccgacattgcctcgccatgactaatcttagaattcttgatctctctctcaccgtgtgcctttgcttctgtgccacgtgtaggcgcacccggagatggacaagagctcgaggaagaagctgtgcagggtgctcaactgcaggaagctctcggagaaggcttccatgcacgcggcgcagaacgagctgctccccctccgcgtcgtcgtgcaggtgctcttcttcgagaacgcgcgcgccgccggactctcgtccgggcacggcaaccgcgtcgccgcgcgctttcccggcgacggcggcgacgtcagtgcgctgcttggcactggcaggccaagaacgacggaggagaacggcaaggacgggcagagccccgccgccgccgggagcgtggcggcggacggcgactggagcgtggaggggctgaggcgcgcggcgtcgagggtggcgacgctgaagatgaggctggaggaggaggacggcgaggacgccggcgacgaggcgttcgtgcataggacgcgcgcggggttggcacggagcgcgtcgtcgcgtgtcacggcggcggcggggaggtccaagcggatgctgagcaggctatggccgacgagcagaaccttcacctaaggggcatcaagacacttgagcaaagctgatccgtacataccgtgtacaaatatgcttgaatttgtaagtaaaatttgttccctcgagatttgattttgttccaactagttcttgaagtttggggaagttgtgtgcacagatatgactgcgtgtacactccctccatttttttaaaaaaaacattttgtaaggacgaatatgaacaagggtttatccaaattaatccctaaaaattaatttgttttggacagagcgtgtacatagttggtacagagacacatgaagctatccttcaactgttaaaaaagacttattgctcttttgttgcaacacactacacacccaactcacatccttattagctactgcagagacggaaagttatactttcatcttaaacgaaactcttaaagtttatactctcctaatgcaagatacagaacgcggctaacttaggtcctgattgactggctacagaggcagagttgcagagacaggagaggccaccagtgggaagcggattctctcccgtaactttccttgacatggtcactgacatatgggcctgcgagcgctggcgctcacatgctagtcaccacattcctctaactttacgttagagcatcccaatctcgacgagtgacttggcctgtcttgtgtacgtcaatacactaaagttagtgtatcttaagcaaattttgaaataagaaaaaactaattctattgaccccctcaaacatatatatgtattgagtttttatgactccgtcagtggctggccgcggctgaacagtcgcaacattttttctgtctttggtcttgatcgactcggatgattgcagctgcagcacagccgccacaaaattttgtctcaggtccaggtcacctggttctggttggcgggtgctgtaggcgctgcgcaggaagcacaagcgtgcagggcattagacaacgcctgtgtttgatggcaaaatttccgctatttttttaatggcaaaacatccttgccatctagggagaaaaagaaaattttcgtatcttaaagcaaaacgtagtgctaaaaccatggtttgatacggaaaacacgtagcgctagcgactgatatccaccaccaacaacatcttcttggccgcttgcacaaggtggtacgcgcgaccgacacgtgtgtcacaatctcaggctgacatatgaccatattttcaacatgcgcaacgttatcaatgatcataggccaaaggccagtcgtaatccgtcgctccaaggattggccatgttttagcacaggagcataggacaggagtgcacggtcggccagtcgctgcctcactccagtgcgagagggagatggacaagcacactgcacacagccgtggtcctcctcttgtcactttttagggtaagtttagttcacgctaaaattaaaagtttggttgaaattaaaatgatgtgatgaaaaagttaaaaatttatttgtatagaaaagttttgatgtgatggaaaagttaaaagtttaaagaaaatgtttggtactaaactcagccttaataggtttatcccgcattctcagaaaaaatcgttgttccaaacgccgaaacaatttcgatgtgagggtgaggctacgataagactacagagctgtgtggtatccactcaccagggaatcaaaaaaatctcgcggtgtcaaatcaaatgaacctgatgaaatcgaaactgctgttacaaattgttgtagctgtagcctgagcaaagaaaatactccctccgtcctggaaaaaataaatctagaactggatgtgatatattgtagtacaataaatctagacagaggtacgtccagattcatagtactagaatgtgtcacatataatactaggttagttttttatcggacgaagggagtagtatggcaaaccgggagcagcggctgtagacttaggcaatgaccaacgcatggtataaccccgtaaaaatgtgatgttaagcgggttgaaactacacttatgatatccctcacacagtgcgagccatgccctatcttattttcgcgatacagtacctgttagacagtcgcattttacatttaaaccttggattatttttatttgcatatacgtccaatatttgcagtatacctctaaaaatcacaatcatatataagggcccacccctccctcttctaccacctttctccttccccggcggcgcgacctcccctctcccgtggcctctcccctctctctcgtcggagccgccgcctctctcctcagcgcctcaagcagtggcggtagatcaagcacaatggcggcggatggaggcgcaagaggtagggatcaaggcggtgccggcaaatcgaagcaacaacggcgcagtttcccgagtatgcccttctctccagtccaccccctcgccatcttcttcccctgcgcggggtgacgcctctccccaacgcggctccttgcccgttccttgcccaaagctgatgaaactacacggccctctattgggcatcgtgacgctctgcgagggtgcggtccgggccgagctagcagacatatttggctttgggaggggtgagaccacactccagtgtggagcattggccgtggccttacagagatcctcctcaagagacgcggttacgtgagcccaccgctctcaggcccacatgcagaggcgaagctacaagtacatgtaaatgtaatatgtagagtcagctgactccataggtttttgcaaaacagctaaaaagctattgatatttatgttgaaataatataaaacttaaatatatatatatatatatatatagctttaacctcataggttttagttgctagctctgtcactacccacatgtcagtaacacattgaggatttgcttccggagcagcgggataaaatacgatggtaacagctctgctattgcggctttatcaaattggttcctatctagaaccactccataaaccggctaaatttaagaaaatcaaacaaatttttttattattttgacaaaatgtctgagaatttcagtggttttggccggtaatcgaggagacgaggaagacaaccatgtacgcgcaagacgacgttggcgaaaatttattcctgtgctcgtcgtcggttgacggggtcacgatcactggcggggccacagggagcgaacgacctcggcgtagcacgcgacgacggcggccagtgccagcacgagcagcgccaagccgacggcggccggggcgctctcggccgcccagcacgccatgctcaccggcagcgccatcgcgaacggccacagcagcagcacccgcgcccgcgcccccggcgcgccggcgatgcgccggggcttgccctcctcctccgggagcgcgcacagcgcgagcagcgacgtgaagacgccgaagctgaccacctgcgacgcgaggacggcgaggaggacgtactcgtcccgcgccgcgagctgcgcggcgaaggcggcgcccgccgcgaggacgaccagcgccagcgcccccgtcgccaagggcggcgacgcggtggtgccgcagtcgcagcccgacgacggcttctcgtctgccgccgccgcggacagcagcggctgctgcttctccacgtcggcgaccgaccccatctctgattttgcttccattttacgcacaatggatgattggatgctatgctagcttagctgcactgacaaatccgtgaaataatgcaattacatagctggctatatagtctcaatagtaaaatgaaacaaattcattttaaaaagcagataagctcagcagcgtaagaaccaagaaaatcacataaatattaagccggagctttgatcaaccagcgggctttacaatgctgcaactgcaagagcgtacatacttctgagtatcttaggcggccgctggaaattaattaaggaaataatgacgtcataattagtaagcactataaattgtggctccaaacgactaaccaatagtataaattaacaagaggaacattgttatggttttggaacagaacggtctctgctgtacagtttcaatgaccaaacactctgcactcttacaaagaaaaggacaagctagataaacctatcgctctgtggttcactgtgacagtgaatcagtgatgatatgcatcatgatacataaataattaccaacatagagtatgacaatgaaacatcaaaatcgacaatgatgaaaagcacctcaggaagtaactaagcacatgccaacaaaggccctctttactctatgcaataaaaatgatcttcagtgctacctcttcagatgatacttgcagtagtaatggaaaccaggaccacacaaagtgcagacactgtgatgctgtcaatgacaagtaagctggccagggtgattaactttatccagtctccactttgctgggcaggacagatcattaagatgcgttatgcttagccttagccgttagtgacaagtcacaagctgtctaatcttattgttatcagattaataaagatagtatgacaatgagaaaaccaaataaacagagtgagttctgatatagccaagccgaatcttgagagttctagattggaatgtttgttgtcgggaatcttcaaaacagcatgtgtttccttcttgtcaaaattacaggcatacgtccacagatgaactgagaaaagatggacgtctacaacttgggcaagaacaacggggagacaaaatgtgagtgccacctgatcctcatcgccagatacgccaggcttcaaaatgattatgttgcactccagtcagaaaatggccaggcaatttaacatgatattgcacacatggcagaggttgagcaagtcgttcaagcatttgattttcctccttttttgaaggcatgaagtatttgaactgatctgctctatctgcccaaaatgcctctctgcttaatagatggctcatactttcgcagcatctgctgcagccagtcgctcatcatcaatggcacgctcgtcttcagtggtaagaccctcaatcagtgagatgtatgtgctgtcatcaggggtgatgccattctccaccatctccttcaccatgttctcagcgtcatctccctggccattcttacagagcccctgtatcagcgcattatatgtcaaaagcgttggattgaaccccttattcatcatctcattccgaatcctcagagcatccttgacatcacccttcatgctgtagccactgatcagcgtgttataagtgacaaggtctggctggattcccctctctgtcatctcatcaatgagcttgcgcgcttcatcaacacgtcccagtagacacagccccctcattagcgtattgtaggtcacatcatctggtgcgatccttttcttctccatctcacccattatctcgaaagctcgatcgatgttgccagaagtggagtgactattgatcagagcattgtacaagacaaggtcaggcctaatgcctctccttacagcctcatcaaacagcttatctgtctcctgaacttgccccttcttagacaaggcatatatcaatgccgtataggtcactactgtcgcacggacccctctcctggacatattctcaaaaatctctagtgctttcttcacgttgccctctttgcaatgcccgtttatcaatatattgtacgtgaacacatccggcgcaagaccctttccacccatctcctcgaccaactcatatgcctctgttccacgcccatccatgaacaaggcgtgcacgagtaaattgtaggtcgcgactgtcattgcgacccctctctccaccattctatcacggtaaaggagcgcagtatccagcttaccctggtcacagtatccaccaatcaaggcgttgtacatcacagcttccggtttaacctctcccttggtcagcatttcgtcgaacaccttcactgcctcatcgacccggccaaccttacaccagccagagatcaccgtgccgtaggtgtactggttgggcgcgattcctccgcgttctcgcatctcccgcataatatccagcgccgcctggacgcggccccgggagcagaacccggcgatgacggtgttgtaggtgacggcgttcgggcggggcatctggcggaggagctcgagcgcgcgggcgggcttcccggcggagcagaggtggcggagcatgatgttgaaggtggtggtgcagagcgggaggcggaggcggaacatgtcggcgaagagggcgaaggccggggcggaggggagggcggagaggagcgggtggagcgaggcggtcgagatggggagggatagggacttcatccgcgagtagaggcggagggaggtggcgtgggggcgcacggcggcggaggcggtgagcaggaggttgggcagcgaggacggcgcgccgtcgaggtgcgggagcacggcgagcggcgagagcgccttgtccgcggacagcaccgacttgaagagcgcgagcgccgccgccgacgtcggcgaggcgcgggcggccgccgcgacggcggcggcggcggaggtgggcggcgccatgtggaattggggacttcggaggagggtttttcgtgagttttctacagagttgggcaatggtattgatttttctctcagcagatcgtctaccaaaaggcggtcccacatgcagaggtacagaaactgaacaagacttcaaaaagaaagaaaaaattgaacaagacagagagaaagaaagaagaaaataaactggaaaatgtcatgcagcggcttacatgttacaacaacgcataaacatggttcaaacgttacaacacataaacaaggttcaaaggttacaacacataaacatgttctcacagaacattttcaggttgagatgctacattttttttcttttttttttttttacggggaagagagactactatacttactgctcggctacatagagctggtgttaatacgcaaatccatatacaaaattttcggagatcagttatatgaagggttgaccactccaaatttcgtcactcttataaaaagcgctgcagctctaaaagagtgttgcagctcactagagtggcgaaccctagaccctaaaccctgaaggcgtcttcctgcagcaccgctgcttcccacaactcctcagagcatcacttacgtgtgatccccatccacccagccgaagctttcctgcgacccgaattgaaaatcctattgcaagaaattcaattcaggaaaggcaaatcagattttgttcttaaccgtaacaaaatataagtcagaaaaagaaaggagtattacgagcaaagcacacttacttcccagctgaaaaggtccgtttcgtccgtgtaaagaaaaggcagcgtgtcatcaagagttgggacggggtcctccggaaactcgcagcgctgcagcagatcttcgttgaagtccccggctgttgacgctccagcagaacaccctgcacggtttccagcttctaccatgggccggagagtggatgtgctgcattccccctcctgtgtaaaattcagcaatgcaacagcatgaagtattgtcaaaaaaaaagaaaaaaagaaagagcaattaatttgtttgccctatcctcattatcagtagcatggcttacctgatcatgtgaaatggtgccattctgctccgtgtcacacgggctgttcatcaggcagcgaggcagcggagggttcgttatgggtgtaatgggatcacttcttatggtcagtgcatcagatgcttcttcagtaacagagtccatttcaggcgtgccagtttgcttggaggataattggtagaataccttggaaacaacaagctctccgtcctccccgccttcttccacaccaagattatattgatgcataacccaattagcttgtactatcttgttctttttggagcctttgtaaagaaccagtattttcttccatccttttaagacaccgttatggtaaatctgttggattttccagttttgtgccatcttatgttctcgtcagaagcagcatggccggtgtggctgatctttctacgcttgcgctgaccagaaccatatgcgtttgatattctgtggaagaaatggctgctggtgccgtccagcttgatacctgacagaattacagaggaatgtatgacacatgagctaactaattactactagttcaaaaggcctgataacaacttaaaatatataatccagtaccggggagattttcaggatgtgtatagcagattccttccaccttttctagagttgggatgaagtgatcaataagaccctgaggccctggatttcccaggttaatttttctttctaaatgttcaagtacttcaagatcagatggatcaaatttaacaccgtcagggaattctggccactgtaaagtaacctgcaatgagattttttatttagcaccaacaagaaatgcatagaaaatgtgaaacttaccctactgatatttctgcttaaagccaacctcgtcatacccaaggcaagggagccacaagctttgtggattttatattgaaattgtgacacgtgggagccaggacaataggaataaagtgtagcacacagcacagtaatgagcaaaacaccttttttagtgaataatgaatgatcataaatcgatttagccggaaaaaaaacataaataatagttactcctaatcatagtattagtaaattactaatttacccccaatataccggtagtataatactaccagtagactgatagtataatactaccagtagagagcaccagagcatcgctctttggaagtaatgttgtctagtgttgattttctacacacgaaactttaatggcaaaacatcatcagagtatcagacaactgaactaaaaagttaaatcaagcattcataagtacaataggtagctgaacttacatcgctattatcaatgtgacatttgcagtttgggcattccctccatgcttctggaaccaattctccaagtttacaactcagaagctgagttgcatttcttatttttgtagcaattacctttccaccagctataatccatggcctgcagtaaaaggcagaagtgagacatgttcatcataacaaaaagtcccaacttatctcaaggacaatctatcgccttgtcattcaccaaaaagttcagattttaaggttaatcagcttaacatagtataattgtgctaagttacagatatggaaagacttcttctacatatacggaacttagtctgaacttctagatatagtgacacgcactaattggttcaacagaattaatagcaactaatcatgaatataacaggggttaacataattaattaacaaaccgtacttcgtacagttactaccttgtgccttgtgcatttactacaacaaaaatggtaggagtaagattaaaattaacagctatctaattcagatgtgtcctaggcctgcatgattccaaatgttgagcacatggatggtagcacactaactagtacttagtctagtactacttttggtctccacatcattcgtcatgcaatgctgttgttggaaattcaaagattgacatatctccactctgtttgactttccatgagttccattccctcattccctgctttctgctatagattgctctgtttcaagaaaccaaatgtaaatggacagagcaatctatagcagcgaatggctatatgcctcaaaattttaatggtttaactgcaatccactttggatctgcttacttccctaaactgttgccacattactctccattatgattggctaggcaagggtccaaaagaacagggtaattcaccataggctccacagctcatttactcactgatccagtgttctaggagtactacaaacgtatcgaaatctggaagctgagcccttcaccttagcagctgcaactgtaacaagcctgaccatcagcaacaataagccttcacttagcagctagaatgctgaaaaatccacccaaaccggacattcagagtttcagacagcgtaaggtttcatccaaaatcacattctgacagcgtaaaatcttctgtccatcgattctgaacgccattcctgcaccatcacccagaccggtggcaatccaatcggcaatcagatgacacgaatccgaaatcttcccctctgttagcaacgagcagctgtgaacgatcggaagacgacacatgacccagtctccatagaacagaagcagagtcttcctcctctgcttgtttcttggttgcttccagcgtaagattccccctcaaacctcagtaacctgcaaaaacccccacccccgcatgcaccatccgagaccgctatatccaccgatctcatgcattccggccacgattccatcacgccaccagtaaccagctcgatctccactcgagccacacacaagaatccaaagcgatcgatccccccaccccttccaaaaaccccaacaccagaatccacctctcaccgatcagaccaaccaccactgcattacacctcctcaggtcaacccggaaccccgagccagctggcggaggcgaaatccccaaatcgatc

SEQ ID NO: 37533 - DNA, 6064 bp, Oryza sativa
aaaaccacccccaagaaaaaggaaccgattaaaccaaaccaggccacaccccgatcgatcggagaaacccccacccccgatgctcaccttgccatgggtgcggcgctgcgacgggagcttgggctgggaggtagagagcatccgaggggggagagaggaggagaagcgagaggagaggaggaacttcttggcaagtgaggcagaggccagaggggggagtggccaaggaagccgggggtataaataggggagcttgcgcgagccagcctcgttggtgggttcgcgtctggaaagggttggggtttctttggctttacccatcgtccgacgaaatccaaaccaaaaccatccatcctgttcgcttggcgggaaaccgggctcgggtgcggcgcggtgcggacgtgcggtgcggctagcccgctactgccttactgtcgcctctcattcagccattctcatctctaattctactgtactctctcaagctgcctaccactacctaccagtgaatgtttcttcaggatgtgttacggccgaagcagctgcagctgctactagcactcttttggtactgtagcgcggttcgatgttttgcagccacaaccattgctactactcctactaccaatcactcccattgaattttcgtgttaaaaatctctgcccacactttgtacagaatccatgtaatctttccacacagggacatgaatattactgtgccactactagtcgttcccatcagacagacacgaataacgctcatcagcactctcctacaggcgcacgtatgcggtatactagtatagtactactatgcgtctatgcggcgagtgttccacgcttccttgcaccggacaaaagcccccgcccgccttggccattggctaggatcaggcacacccgcggtcgtggcccaatggcaatggccggatgcaggagtgagtggggcccacgcgcgccttgtcctttttggttcctgggatgccgccacgtccacgacccactggtggcgcgccgcgcgctcactctcatcgccctgtttttcttcctctccaagccaaagcacgcagccccacactcccgcgagggagggacccagcagaaacggaaactcgcactcgcgcttggtggcacggcgagagctctctcacgtctcagcagccccagccccgaggccccgagcgaagggaagggaaagggaggggagtagtacgcgctgcgctgtagccgcgtgctgcagctggtcgggaaggggagtagccgcgagctgcagggaaggggagtatgcgctgcgctgtagcttggctgtcttggctcggctcgggcgttggctacttgacttgactcgcgcagtgctactacggtctacagtctactgcgggctttgtgtcgaaggcccctgcgcgcgtggacgtggtcgatccaggcgtccgttggatctcgcggtggatgggtggtgcggatcggagagatcggaccacgcaccgctcgctcgttttgggcccatgcacgaccacgtacgccatgttcagaggatgattggaatcagctgtgtaccgtactgtatgtcacaaggaggcggcgcagtgactttgtgacccaccggcaactagcgatacgtattgttgcatgtgccagaagcccagattattcagtgcatatacggagcagcgtatacgtcttaagtgcaggcctgtcgcttgtgtgggcctgcttgggccaaatggagggcccaagtcgactctctttcacgatgagataagcctatgttttctgcccatacaaaagctctgaaaaaaatgcatctttattgccgcgacataggtcatagtacatgtgtatgttttattgccgcgaccgcgcgacgagctggtaaatcctctacagaagtacgcgtacgacttctactgttgcgacttctgcgcaagttcataccactgccaagctgcaaaatctactctactttctagtgctcctattgcactttgtcgtcgtagtagtacgtttacttatctagatcgatatgccagctcatcgtcctaatgaaacatgtagggctcctttgaatcacatgattaaaaaaaagaggaatagaaaaaacacattattctgatagaaatgcaagtgtaaaacaattaattgcaaaacacagaaattaccgtttgattgggctgcacgaaaaacttaggaatcagatgagagagataaacttagaggaaattttccaagagattagagagcatgttaaatttcctatgtttttcctctaaggccccctttgattcaaaggaaattcatagaaattttagaggatttcattcctataggaatttttcctataaagccctttaaatcaaaggaataaaccctatggaatcctatgaaattcctatggaatgcctcttctcatacaagttttggaggaatgttaacaagaggtagaacctcatggaagaaatcctttgagtctttatctctactcaaatttctgtgtttttcctgtggtccaatcaaacggtcattcctatgtttttcctgtgttttgcaatcctctattttacacttatattcctgtcagaatcctatgtttttcctattcctccgtttttttattcctgtgattcaaaggggccctaaaatcgtagaaatacgaaagtttccaccgttttttcttttctcgttcctacgaatcagaggcataaatagtgtatgatttcaatttctttgttttttcttcatttttcctcaattcaaaggggcagtagtattttctatatagtttataatgaaggtaatatctcgctgcagtaaatgaacagaggaaggctcctacggccagagcaaaatccaacggcgagaagtcccacaggtgatccaacggagtagtagtacggggacatgccctgatgcactgttctgatgattggacgtccgggctctccaacgacgagcccgtacattccgccgcgtactgatacagtgtcgtctccaccgcccatggccggaaatcgcgagaccaaatgatggcgtagcctgcgatgagatctcgtcgacttgacgggttgacgagacgacgagaagatggcacgcaacgctatcgcccaccgccgatccctcgagcggtgtccgggtttccgacaggcgcaaacgactcacgacaccacggccagtcgcgagtcaggtcaagggtcaggtcaagggcctcgcatgctgatcaatcgatcggttttgattggactgattctgatatgcgagattactcaaatttgctgctcggcacatcgattcgtcgcaagctcccaacattcgcaattcatcggaggatttttcgaaggaattctatgaaaaaataaattaatttatgtgaaaaatctctgtaaagttcccgtgctcgaaggaaacctgatatgtggcctcaagccctcaactgtgtttcctggtcagtggactctcggcgggtctaccaaaaagggaaaggaagaacagcgacaaataaccattttgtggctggccaacggaaaaaacaactggctacacgagtagtagtagtatccatctcaaacctcttgttgatttgaggcaaccagagcacaatagaacaccgatttgctataccaagtacggagtaccaataatagggtagtgatcagagaatgtttcactgaccgcttcgcccaactgcccaagtcctccaagcctatctatagttctatacgcaatataccttgcccaccgataatagaagcatccacctgtcgatccagccaggccgggcctgcagacagcgagctgtttgaacctagcaattcactaccaaccagctgctaaaccacttggagaacaggtcaagagacggtagattagacgcacaagaaggaataacttagctcaacttgggcattgggttgtgtacttgtgtgtgatattgcctcggattgaccacaggacacataccagacaagcgctcaagtcaatgatggatgaagaaacagaagaagtgctcacgcaatcatgcggcaatttccaacgacggagcaacggaagccagagtttttggtcaaccagaaattggatgcagccatcaaagaaaggaacagaacaccaacgcgaaaaagaaagagagaataaaagcatgtgtggattatctgcagggtaatgctagttctacagcatataaatctgaaatctcacttgattttgcaatctacagcagttctcagtttatgtatcaatcagggaagtaatatgaatgacaggtgaacttgtggtggctaccacagggtaatgagctcctctgggaaggtaaccatgccacgaccgagcatacactatgctgtagcctgtagggtcgtccggtgttagattgcacagtgaaggatgatgaaatcatccatagccactcatcccaagcaatcatccagctaagttagccaatcatatcagatgcaaccgtcacggccagccaatctcggaggtggagaacatggcagtgacaggcctgcacatcagattgaagagtgtagatcatcaaaatctacccactttctctcctgcagtaccctgggagaaggtatctgtaccgatcaacattctgtagcagatagctaggaagatgaacagcagaaaatgtgcttggaatcggccccaacttggcaatgatctcttggaacgtgtactcttcaggaagcatgtcaaaaagatccgcccctctgcatataacatcttgaatcctttcagggttcaggaagtacttaaatctaatccgatcgacatggctgtaagcttgcattttgaaggcaaaatcactaatgtagcgaaagcaaaaactgcagtgccaccctgaatcagcaagaagctcatctgtctgccggaagtgtgcatatcttgtcttcccagacctgtacctgtgtatcgatgccctccaacttttgtcatccaggaaaaattcaaatgagtagaggtaattcctaagctgaagatgaaggatctcaggaatgtcgtcgcaccatctcaggagatcaattgtgtggccacttgggatttcatcaacatctgacatgatcaacaggtcatcatcttctatttttgcaatcttaataagctggtccagggcaaccctctgatatgactcctcaacaaatgggttttctcccttcacgaaccttcccccaatcataccatatgtcagccgtgattcagcaaatccaaatcgatgacgattttccttgaagtgcaggggctttttcaatccagtgaaggttgagttcgactcaagcagcacaaactctgagacataggggcttagttcattccaacgtatttcaagaatatcgagctcattgctgaatagtacagcatcgaagacacgtcgtggggtctcccggactttccacccatgcaacttgcagagtttcgccatggtgacattctcatggtagtaatgagggatagttttgaagggcttgggaggagactcccatattggcctgaggaagtatgtgaccttctgaccatgagcatatatcattaaaattagaattggcactcctatcaatagggccaatagtgctctgaaatcaaatccccgaagtgcacatctcagcctcgacatggtcagaactgcctttgacgcaggctggaaatgaattcacaaagaaaataagaaatcaaacgagcagtagtggacataaaagagttatgaaagaaataagaacagcaaccatctgcatgccaactgctcctccacaaaaactattaaaaatttcagtatgtgcatatattagcaatatttattcctaacgcgggagcaaagtgggcaataaggccataatcaaagcctgcttgccaaaaagatataacctcatgaagcattcgctaaacattagcttttcaaaatacaggtcttgttacagtcagcaaaggcagcatctgaaattcaccggtaactcagaattccactacaaccgcaacaaagtagcaaaggacaaatgagagacctaatgccacagctaaaagcacagatgcaaaaagccaaagacaatttcgctcgtgaagatcagca

SEQ ID NO: 37534 - DNA, 10236 bp, Oryza sativa
gagacggcgacagcgagagcgcgcgcgctcgccgccgcagaccgaacgcgcggcgcgcgtctaggggaatcgaaggaaccgacgcccgcgacaagcggagcatgtctggaccgacggggccatggggagggaagggggaagggagaagggggggtagtaatggctcacctcgccgcacacgccgtcgcagatgccgtcggtcttcttgtggccgtagggcccggtctccggcatggcaggcgcggcctcgcgccagcaaagccccaccaccaccaccagagcaaacgaatccgagcaggagagaaggtcctctccaatggcgaggagggcggggcgcctcccgtggcccgggggtcgccggcgatcgccggtggcggcggcggcggtggttgggtgggggccttgttccgatctcgccctcggagggagggggaggcggacgcttctgggcgttgcccgttacggtggtggcgagttgtgtaattagcgggggagtcgcggggggtcgtgggcgcaaaagcgtgggggcgcgttttggaaccgcctaattatagccgttcgcgtggtggccgtggcctctgcctgcctgcgcctccctcatatccatcgccccggtggtgggcggtgcgtgcgtggcgcggtgcggtgcgagctgggcagttttgtcctcacgcacgcttgggtatttttctagggacataaattaaggggaggccaattaagcgtattgtatatccgtgccatagtcctgaactctgtgtagactctaatgaaaatgggaggctttgcccctcttgataaaaaaaaagtatatccgtgccataatacttaactattttctccgtcccataaaaaacaaacctaatactagatgtgacacatcctaatactacgaatttagatatatatatatatgtcaggattcataatattataatatgtcacatttgttactagatttgttttttataggacggagggagtacgttctttattgcataataagttcatttatgctcattttatttattttaaaataagttaatttttgagtaattattgcattataaagtttgtgagagtgaaaaataaatatatagtagacaaaatgatgaatagttgtattaggatttgataatgtagaggtattgtattttttttattttgtattggtatgtgtgggggtgaaaaatgaactcagtttgagacatatgtagtactccctccgtcttttaatatgtgacaccgttgactttttctcacatatttgaccattcgtcttattcaaaaaaatttatacaaatgtataagatataaatcacacttaaaataatatgagtgataaaacaactcataacaaaataaattataattacgtaaattttttgaataagacgaatggtcaaacatgtgagaaaaattcaacggcgtcatctattaaaaaacggaggtagtatatatctaacccatataccaaggagaaatatagtcagagaatacttataagatatgtgtaattatacactacattttcaacacaaaataaatatttaatattatatttaagaaaattaatttgatattgtagatgttagttttttctatcaacttaatcaaacctagaaaaatttggcaaagaaaattaaagcgacttataatatgaaacggaaagataccttgcaaaatataatcaatgttatatcatgatcttttttgatcataataaatacacacatcatacttatacacatgctgaaccctcacccttattaaaaaaaactttaataaaacagtaccgcaaataagttcgtactccatttgtcctaaaaataatcaaatcatagttatgaatatggacaagtgcttattcaggtttatagcgagcatttgagtttttttagacagaggtgtaggtaataagattaaattttagtggataaagttgtatacctatggtttctcctgatcagcataccatagtactttcttaggttaatattagatattacttggccatgcaaatgacctgtattttggacagctaatcttaaatatgaggtgtgtctttgtaactataatatgccaggttacatttgtactccgtattagctaatcatgtaaggtttatatagttttgagtgtattttgagacgacgtctataaataacattcttagcaaagaaaaatctttcctcacaaagaaaaaggccttctacttttactgttatgacatgaatggttgccaaacgagctacctcaagcttcggaatccaactcacctcaaagtatttgcagtacaactcatcatctttcctgcaaaggataagataaagaaccgcaaacatcacgagaaaaggatatgatatatatatgcaattatgagaggccacccaggtgagatgccaacgtacaaaacggattgatctttccatctatattttgtttcttctcctaaccaatgcatcatctacgctacaaaaaaaaaaaaaggctcttttatcactttcatcagctagaacaaaccatcgtatacacgacgactccacctatctcggcagcatcacattcggagggcatctttcccccaaagcgcccgcgaaaacatgcgtgttcccaacacaactctccaaagatgaattgatcacctgattcccttttggcacaaaattcctctaccacagtatcggcaaatctgtctcgttcaacgcttgcttttgcttactaggccgctattgcaatcgctacgttctcatccactatgcacagtagcaccatgctcctactactgctgtcctagccactacaactgattactctctctatcccagaatatagcaatctaaaatcgaatgagacgtattctaatactacgaatttaaatatgaggtatatccagattcgtattccatctaattttagtatgctacattctgaacggaaggagtaagttttagaagtgatcttaaactaatttaggtgcttttgtagaagccataatctgctttgcttaatcgtttttttcacttctaataaaccttagccataatctgctgttgcgtcggcctcgtcatagccgccccccctccccccccacgttgcagcaaacatcctcccctacccctccccctagtgccctcttccctccacgatccaaacctggtgctctcccattgttcttgggtttgctggtgctattctcatatcaaaaccttctcatttccggcatgctcaacaattggtccaggtgtttgttccaggaactgtgctcctccagcagcttggctggtctatgtcccatgccctccggcgaggtcgcggttgattctctttcatctgcaagttcccccttggccattacccttttgtctacctcctgctcgtttccacccctttccttgagatgtcctcgaccgcaaggttcagcggcactccctcctttaaggcttccttcccttgaagggcgttggagtgcgttgatctaacaagcaatttgatcaagtttgattgaagaagactcattgcgggtggcctttggctgcatctttcagtgtccctccctcctatggggcttccttcccccaaagggcgtcggcgggcttggatccaaaaagcaaaaagaccaagttagcttcttgatggcttcatgcgggtggccttggacttccacagcttttcgttggcttttcttctattccggcatgcatgtggctgtgtgaggaaatggatgttgacaagctagggtgttagctttaggttttggtgtttggtttgggtaattttgcaggtgttgctcgtcaattgttatcttctgtgaggttttttttctttatctgttttctcctctttgtattccccgtgtattctattctcctatcctccagggcccttgcgtttgcgtaggtgaagcctgccctgtataagatcatttggctcaatatattcaggtggggactctctccccccggtgatttagtcaaaaaaaaataatactttgttgcaagcacacaaaaaatttattttaaacatagcaagatgtcgtcgtgataggatactggttgcaagacgatgtctagtgtcttcctgttttattatcaagcatgggtctgtttttttaaccctgaaaaggatggccacaccctatcagtgatcgcacccgcgaaagcgaggagcacgaggagcgcgcgcgcgcggccgttttcttccctgaaacagcgtgcgcgggtcggagcgagatgcgaggggcgtccacgcagtgcagacgcatgcaggccgcggttctctcggctaaaaaactactcgtagtactccagtactacgagttctccgccgcggcgatttgtttcgtgcgtcgcgtgcggcgtggcaagccaaaaagccgctggacttcgcgaggggcacggcggggcggggcaccggccaatcgagccaacacgtcgttgccgtatgcacgccgcggcttggaaattccggcggaaaccgatggttttgttcgacccgtttggcgtttaggcgggcgtcgcccccttcttttatttgtttttgagtagagtgcacggacggtccttaaacattatgtctgtgtgacatgccacatcagcgtcacgtaggatcctgaaggggctgtggctatttgggatttagatgacacattatgacaagttctgagacttggatatgcattttgagagtttaagaacctagatgacacaccgctacaagtttaaggaccgcccatgcactttatactttgttttttttccgttccaatgatggagccgacgagtttctccgtctcaaaataagttctattccacatatatcaatataaaaaaaattaaaataccactatgttattaaatcacaatgtaattagttttttatctacttctaatatatttattttctaatttcataaactccgatgtaataattacttaaaataaataaattttaaaacaaatggaatggaaaaattgatgtattttgagacggaggattatccaagacttatcattgcatatttgtgttaattatttaatgtgtgcgtatcactgtatcagctgagcggagggcgcagtcgatcgatcgacttgaccggttgacttgcaaagaagcacattatataagtatatactacttcttgtacagttcggttggtccatgaagcatgcaaagtaacagtggaaaaaaggccatggaaaatgcgtcgtccactgatgagagatcagtccgtgtcaagttgctagctgctggtcattttcgcgacatgaaacgagaaagaaagggcggcatcgctagtggcccatcgaaaaaatacaaatggacaggcacctctcggtgttttagtgcgtttagtggctcaggggcaaagaccgtgtgaacaagaatcgccctagacttactttgattagacggcgatctgtaccgatccaccacagcttcctctgccgcatgctgagctgaaactaatatgttgggggcgaattcgacacacaagaatttccatagaatttcagtaattactttaaattctacaaaatatattacaggaaccgtcatcatcgatatagaccttagtagctaaatgcgaaagaatatccaaatatgacaagacatatataaacatgatatttattgatgagttttcagttgaaacatatgtaatatccggacaccgattataaacgcaccctcttaatccattataatcctcgaccggctaggccactgacctagtcgtttctctcctatgttattgttactatgcggttatatagcttatgtcactttatttaagactgagagtataggataagagagcaactatatttctattctaaaacctattacaactccaagctatactttgtaaccaactttatacacgtattcaatacaaaaactaacaaatttcacttgacgaatatgccacatcaatctaaacttgttcgtgcgtgaacttccatataccttacttgagtttattcatttttgctacccacgttgagctcttccatgagcctataccaagcccgtcatcttgaagaaatcgacctggatctcctctttcgccgcctcacgccaacgaacctccgtgcacatgccttcccaaccatctccgatgtattctactctgccgcctcctctagcctagagcaagatcgtgttgagccctctgccacttgcacatcacccacactagggtcatgcaccttttacactaattcttgttgctttagatcatcaccgcacaagaaatctaaggtttggtatctcctttttcttcggtgatttgcaatcccgtggttactctggttgaattccatcaacttctaggatctagttgtggctttcgctactattgttgcttcatctcaagctcgcaacccaattaatctatccgcaagacgaagccgacaaattgccatgtcattttcattgccgccaaatgacccaagcgtcatgtctgtctatctccctattaaatacaactcattgaaaagacgtctaggcaacccatccggagtgttcaactataccgatcgatttgtcgattgctttcagccttcaatcaacccgcttgaagtgtccagcaccttgaatcaccgattgctctagtcaccaatcaacatgagaatcatatcgtcttcttgttgattgcaggtcatcgaatggtccgagctacctgtttgaagtgttcaacaccactggttaaaacattgaccgacaccatgctccaccttgcaccaatgtccctccctagtcattatgtgcagattgcacggtgtggagcaccttcatcgcacatctctcccatggatctttcatcatagctaggctctgatatcacttgttataaaaattagcatgacattggcctcgtttccaaacacgaaataacaccataacagacccaatcatgatgaccacaccaagacatgatagttattgacgaggtttagccggattctacgtcctcgaggcatcagttacatgcattcctctttgatctaacataattacaactagcatggtggcccgcgcagcttgcgcggctatcatcattatattttctcacatataatagcatatatgttttctcaatatattgttcaaatatattaaattgacaatataattttaaattttgcaataactttacgaaactactaatgggtaatattcatattgtattttatatacgtgttagttattaattattttaatatcaatttttaattatttgtaaattatatatattcctatatgcactctagactcgtcttttaatatatattttttaattccgaattttctgtaaactgtatttctatatagactctatgctcttcttccaatattatttatttttatttctgaatttttattatttttaattgtatttctatgtggactctaaacttatctttcaatattctttaatttttaatttcgaatttcagttacttctaaattgcattcctatattgactttaaactcttcttcccatgtttttcttaatatcgaattttagttatttgtaaattgtatttttatacggactctaaactctactttaattttattatgtttattccaaattttagttagttttaaattcctatatggactctatactctaattctaatattctattttttttaattccgaatttctattttttttcttaattgtatttctatatagactctatattctatttctaatattccttattttttaattccgaatttcttttttttcttaattgtatttctatatagactctatactctatttctaatattccttatttttaattccgaatttctattatttcctaattgtatttctatatggactctatactctacttctaatattctttattttaaattctgaatttcagttatttcctaattgtatttttatatggactctagtctcctcttctaatattccttattttttaattccgaatttcaactatttctaaattgtatttctatatggactctagtctcctcttctaatattcatttttttaattccgaaattcagctttttctaaattgtatttctatatgaactctgttttttatttttctccgattaatgtgagaatttctagaccataagagcgaacgtgaaggctcctttttctattcctttaataatataatagatatattgggtctgaaagtcccttaaccagctagaccatcggtcaatcattcccttccctatgctactattgtcatgcggttataccggggtaggggtgaaaacagagcggattcggacggatagtagttataccatatcttaaaccattttttaaagcgaatgtagagcgggtgtggatgatgtgcggatgcggatacgaagcggattatttcggacgttggatttggtactgagtctgtgcggactcggttcggaaacggacaaaaagttgtcggatgttaaatttgtattcaatccatacaacaagagggcatcaatacaattagccgcaatacgatggcaaaacaacatctgaacatgatctcagctctctaggaaaaccaatcaaaacacaacaataatataattttgcttaattggtaaagtacagcttgtataatataacacatccagcaaattgtcaattgcttaagggctcaaataatccaagatacatagcacgacagacgacggcaagaagcagcaatggggacacggaacgacagacgatggggatggcgttggcgacgggccgacgttggcgcctggcgacggggatggtgctggtgacggtggcgcctaggcgctggcgctggcgacgggccgaccgccgacggtggatggtggcgatggggacgacaggaggaggcgacgggccgatggaggacgcgctgacgcaggggagtggggacggcaggcgacggtgccagcaatgccagaggcggcgcgctagaaggaggagcggtggcggcgctagcagcctgcaacggcgcatgtgtggagttggagaaatcgagagacgcgtgagaagatgagagtcagaaagatttgggggatggttggattaggttatgatagatgggccactcgatggaaaatgggctaaattgagtagttgtgtggcatgaaaattgtggattatccgccaaatagtacatcggatcggataatccgattaaaatatcgaataatccgcatccgtcggatatcgttgataccacatccggctccgcatccgcatccgccggatatctaaaaacccttaccatatcctcacttcggacggactcgaagcggatcggatcggataatatccgctccattttcacccctataccggggtgtctctttaattaatttaagagaggatctagaataagagtctagctctacttttacgctaaagacctattacgactctaagtctcactctgtactgattttgctagatatctattttgggatggatgtcaactaacactgatggggactgagcttgtaagatgtgtgggtgcaggaattgttgcacgggataatgttagagataaggataatagacatatattcaacttcaacaattgctatgaaatttctccattctaaaagaggcccaagacatttttgaattatcgggaaggagttttcaaatgatacaataatacgtgataaagaatcaatttgctaacagtattcctacataagctagctaaacgagaacgatggaagagtatgggcagaactgcataagtacgtaagacggaatacagcatatatggtgccttgtggttgtggtgatgtcaatgtgatcctgtgatgcgaatatgagcatgacggcattttcgtcagccacctatgaagtatgaactctcctagttcgtcttgaaagagcataagacttacgcaatcattgcattaaggaggagaaagctaaggatgaactcaaagcaaatggaacctagttaaggtgagacaaactaaaccaagtaactaattggagtctaatttatactagtacatctgtacatgtcaagactcaagacacatcattcaggtcaggtagatatctgctggacagttggccaaaacatgacacatcaaagtatcaaacaccattgccagatcaatcatgccatggttaggtttatgctagttatccagaacacgcaatattttttgtttgtgagctgatacctgcctgagataagatgatgagaaacaagttaagcca

SEQ ID NO: 37535 - DNA, 21106 bp, Oryza sativa
gttgtgatatctgtgccaaaaatcggttgttttgtctgattgtgtgaaggtgacttgaggtcaaccttggtcaatgatgaggaccgggactatgtttagggaggaacagaggtctagtgcggtcgggatactatgtgagaaggtgactagagtcagaaatcttggaggtcaacttcggtcaacggtggggatcggcactaaactcggggaggagttgagatccagacggtcaaggataccgggtgacgaagtttgatatgagatggcatacggtggatggacattatatgggagagatcttcgcaacgggcttcacgaggtgtgcgtgcaagcgtcggtgttcgcgaagggaattgaaaagttggagtatatggtgctacagtacacgaggtactgtagtgtgcaggtatgcatgcatgtacggtgctgtatatgtacgtgtgcatgaccggttggccgagcaacagcagagcggctcggtgggcttcggtggctgttggcggcatgccaagtcggcccaggagaagcaagggcccagctggcagcgagtcggagacggtcacgcgtggacgtcagcttgggagcaaatcagttttggatttctggtgtggccggttgtttgctgcacgtttggaaattgtaaaacgtatggaaattgagagattgagtcctgttgtgaattggagttcaacacctattttgagtaggaggtttttatgtataaatagagagggagggggtggcctcccggtatcggttttagtaatccgagtttgagagattagataaggtttcgtgagaaacttttgaggggtgctgtggctgcaccttgtaaacaatatacttgagcaataaagatcatattcaatcatcaaggcatcgacgatctattccggtgtcgtaagttttatgtttatgtttggttttagcattaacttgtgattattcgttttgctgcgattttgtccaagttaatccatccaaaatctttctaatacttcatagatcagatttgaaaagtttcgttgattggttcttgttagatttgaatttgcttaagttttaggtttagttcagatttgctgaaattctgagacagctgaatttcgagggtgttttctcttaaaccgtttattagtttgcaaatccctccagtggagttgtttcttggtttgtatagtttattatgtaaagtttgcaactcgatccaacggttggtttaagagaaatcgtgtttttaccgaagctctgtcgtgctgtttttagtctgatggtcaaaccgcgagaggaacagcggtcaaaccgattagagttcggtcagatcgatcctagtaggtcggatagaccgccaaacatgtgttccattggcttttgaggttggggtgtgttttgatctattaagattcgattatttgacttccgctgacgaaatctaccattcaccccccctctggtaggcttggttacttgtgttcgatcctacagattgttcctcgaaccagcgctcgcggttagaggggttcttctttttctccctgctctagcccctagtgtgcaggataaattttcactaagtaagagtttctatataggatagatataggatgtacgtgcgcacatcacagggacggaagtagcagggggcttgaacaccccctaaggccatgttcgattgggccgagaacggccggggtcacggcccaacccccgtggatcaacctggcgaggaagcaatcccagcccatgggaaaagttgcgttcggttaagcccagacgatgattttaacccggcccaccacagggttcccctattgtccaggcccaagaaaaaatcacctagtgcggaggcttggaaaaaacacttagagaggcggcacaacgagaggaggcgctgcggcatgactcggacgcgacgacgacgacacgctctctcctcgggcagctgtctcctccggtggccacatgttaatgaccaaatttggtaaattatgcatcagctgaagcggatttggaaggaaattgacaatcacagaaacagagcaagaatcagcatcgaattgcgtcggctatggtgtgcatcggctaattccgaatcggataagggaagccgatgtagccgattccaacaaagtgatgttggaatcattgtcggattttgttggtgtgcttcatgaggattgccacctatggattaagtctgaaaaaggcaattatgtctattaattaaaaaatagtttgttagtttcttttatctttaggaaagtgtgtttagtgtccgataatgactttaagttttccatttatctttaggatagtttctttcttctcctataaggactagtatctacccatgggtataaatatgtacacccagggtcattataatatcaatctttcgatcaatgcaactctcgacgcatcaccaccctctttaccgaggtttttacttatcaaccggcggaagttggcacatgatgcggggctgcatcggttcagttcgatctccggtgaagcggtaagtcctacgttccgccggcccaggtaaatatatcggttacgtcagcgtcgtccaaggctgcatcagtacatttgacctcttggattgctctggtttggttgatatatttgcctacctgatatctcaattctatctctgattgcattgtgtttagagacgcatcggtttagttggaactgtctcggttaggtccgatcttctgtcttagccgatatatctctacaatcacaatgtcgttctaaatagatttattatatccatcacattagacagatctatcggcttatcgagtattagattatcatacaatctcgtgctgcatcggttgtgtccgacctactagattgttgttgataatataagtcttgttaagccaataggttcatgctagtgttttatcggggtgctagccgataagttatctggacgttgcatcggcttataaggatcacatatacatatgagctggatttagccgatcacaacaaagagtttactgatttatctaatcttgtggattctatgacatcggacctccagccgatgtattatttaaccttcggatcagtacgtgttctatcatatcatattgttagccgattggtttctactggataatatcattatatattttattacatcttcatcagccgattgcctccatattgttatttatataatgtcggaatctacattggatatatagccgatagctcaaaaccctatcaatatcggctggtatcggcatcggctggattactccatcagcttgtcagccgatcgactcattgatctactgtttacatatcttgtcagttgcaggatcaaactgactggcacgtccgcatctcatcaatctttggacctgcactggagctaagcagatctcccaggccagtgtttgttttttgcatcaacaccaccttctcccaagtccccttcccctctcccctcctcttctagggttagggcttctcacgtgcgcgctgctgctgcggcagcgacaacgcacggtggtggcaggtgtggcgaggacgctgctgcatcacaccccctcgccatggctccgttgaagctccgccgctgcggcaaggagaagtaggaggacacggacgtggtgaccgcttcgagtgttctttcttccactggtttctttatttgttcttctttctcccctttgatctgttacctagatttccagatttcctcctcccttagttcttggaggtccttaaatatgattgtttgattctcattatggcatacatttactattatttgtatgcaactttggcttttctgaggccgtgcaaaaagactagcaatatttgcatatttgtttccgactcttgcttccatatgccgcttcttcttcgcgatcaaagtcataagactatctatgttggggggagtagctttgaccttgcccggagaggacaaaggctcccattttctcccaccaatcttgctctcgatgagctcacaagcggaggctccgaggagccaccgcagggccctcggaagccgccccaaggggaagggggcgcttcagaggcttcgtcaggcttcggggaacgtgaccccgaagggggaccccggaggcaacagccaggataacatcgcagagagccttaatctcgcattttaggcggccaactacctttgatactgttggctcaacaccctaggtgaaggccaaggtacatcgttatcacgcctcagcctcgagcagtgcaccccgggaaacatggggtcccccgggaatgctggcttaatgggcgcagtcccatacgatgtcccttggagagttaccagaccgcccttgagcgggggccacttgtcaacctccatccttgagttaagcccagaaggtctatctctgtaatttcccttaccaatgtaagactacataaagatgtaatacgccccccccgggggggagggggagaggggggcaaatgaaataatagataaaaaccacatcccttcttcccttgtgcttgaacccctttggattttattccaacattggcgccgtccatggggatcgagcaaagagagaacaaagcagtgcaagtgaaggatgccttcaaagcatgcaacgaagcagaaggacaccacggcagccacgcgactgtgtagggcaacgcgccccctggtttggctgggtgaactagtgatcgcccctccggctgacgccgacggtagcgccaccgggagtggcaccaaacttgagcccgagaccctctgcgatgcggccgtagaacctatcccacaggtggcgccggcgggtgatctagctacggacattcgcgctccgggggcgccgacgcgcggatatccgtgaattaggtttttcggacctgtcgtggacggttttggcaatatgatgggtgaatatttctgatattgcggtttagagatataaattaaacccgacgtaaagatgaagggatagaaggtgaacttattccttctttttccttgaacgtaggctaaactttttgattttttattgcctaggcgcctagcccctgttctctccggattgggccgaaagccagcccactatccctactcccgcaggcctgtaatcctcaatttgggccgcattcttgttagcaaagacccgacccaagtatagaatctagggtttataacaagaccgaaggaaggacgaacatacagattcctatcctctctcgccatgacaacaatgtcgtcgaggctcgcatctcgcgccgcccgcttagctgcggtggcggcatctcgcgccgcccgcttagctgcggcgtccgcatctcgtaccggggccggggacccctcagcgcgggccaccgccactgccgcatctcgcgccgctcgcttagctgcggcggccgcatctcatgccggaggccccacagcgcgcgcgattgcggctgccgtatctcgcgccgcccgctcaatctcctcgaagctccttgacgacgacatcgctgcccgcctctccttccgctacagcaccgagcccccaggtaaaccttaacacccaatcccgctctcttcatggtctcccagcaaatgagaattttcagaatatgccactcaatttgcaccaccttcaggatttgccattaatccatgtttggcgaacaaaattgcataacaccgtaatctcgagagaatttgtatttaaaagataatgcagatgaattcctaatccccgtgcctgagaatttcagaatatgccactcaattcacaccaccttcagaatttgccactcaatttgcaactttttcaaaacatgccactaaggactctaattgtttcatccccaccaagcacgggaattgtttcattccgtgtcactccgtctctctgaagttacgcgtcgtcgcccgtccgtatcgtgccgtccgttgcgtcatcttgccgccgccagcgtggggaggaaggccgccggcgtgggtgaggagcttggccggtgttggggaggaagagctcgccattccggtgcagggaggaagagctcgctagcatgaacggtgtagaagcttgccgacatggggaggagagctctgccggtgcgggaggaagagctcgtgggcatgggaaggaggagctgccggcgttggaaaggaagagccaccggtgttgggaaggaataactcgcgcgggaaggaagagttcaccggcatgtacggggaagaaacttgtcggcgtggagaggaggagctctgccggcatggggaggaagagctcaccggcgttggggaggaggacccgccggcgtggggagggagaacttgccggcgtggaggaggagctcattggcggcgcccagatgactcaaacggacgtcgtgacacgggcgggcgacggcgctcggcttcggagggcggagtggcacgggatgaaacaattcgcgtccttagtggcatgttctgaaaatgttggaaattgagtggcaaattctgaaggtggtgcgaattgagtggcatattctgaaaataaacagccaaccatggatttagtaacagactaatattcgtgtcatcaaaacaatgttggcatttattgtgtttagtttttacaccattatcacgtgtgatatctctcagcttgaaagctcaacttttctaccaataaaaattttggctggaacctcttgagccaaaggctgggatctaattccattatctgaaacatcatataaattcttctttgtgcttgcgaaaaatcaaatttgttcacactactaacttttgcgaattgaattgtgatagatgatggtaagtgcgttacagccaaggacctcgagtcagatcaagccgtatgggccttatatgagcgctggtgcaagtcatacaacaagaagcgtgaccatgctgagatgattcgccggttcgacatattcaagctgaaagcatcgcttgtgcacagctggaacaattatgttcatgaagacaaagaggaattagctcgtgcaaaaaagagaagggatttaggcaaacctgtcgatccttggtacctacaagaggaattaggcccatccgccgatgggggagacactgttaaccaatactggcggggcatgttgaaggaaaatgaccaagggatggatctgcctgacatccaaggaggaaaaaaaatgagcactgaagattgaacatgttacataagagcgatttaatttgcttatggaaatcccttaccctcaaggagttgaacttagctccccatataaatcaactgtaataataagttatgatttgccgttccatgtgtagtctatgcttatgtcgtaccatcttatctaagtggtcatgaattccatatgcttccgcctgtgggaagtttgtgtattttagccttttgggtttacgggcacaagtgttcaaacagatcaagatcaagtgtgaagatggtatatatgtcagttgtttgtacattaattcgttgagcaataggacgaaagtaaaggtgagtattgtcttgtctaaaaaattcaacattttcaccattatcattcatgcattgtttgtttatatatatataaaaacggaaaagaaggaaggggaacaggaagaggtgcgctaggaaattggcaataaactaataaagaggaaatttattccatattctcaatttgtctgtctaaaaaattcaacattttcaccattatcattcatgcattgtttgtttatatgtatatagaaaagaaggaagggggaacaggaagaggtgcgctaggaaattggtatatatataaagagtactgcttccaatttcctctttattagtttatacaggaagaggtgcgctaggacctttataaactaatacatcaatcttacttgaatacatataaagaggatggaactaaagttgttatttagattagttggcttattgaacaaacagctgtttattacctgtgtaaacaattacttagatattttcgccgggtcaattacttagatattgatcatatggcttttaatttagtttatctagaaaaatatttttgcaacttacttgttaggttgtttggcaattcgttgagttcgacatgcgcagtcttgatttttttttaaaacacaacacactttgttaaaccacagcgtttaggggaattgaattccccaatacatcgcccaggataaacataagagttggaccatatttaacaagagagaggtcaactgaaaaaaagaagcaaactttataatgaaactaagcagcaatgaaggagcaaatcgatagggtactgtggcagggccgcgacaattgcatccaagggcctctattgatatgtactccgcttgacgaactggtaaaccccttcggctgcctccacggaaacgacacatatgagaggtttggtgcgaagccgtagattttggtgtgaacatcaccggactccacaaaagatttccacggggttcatcattgaatctgacaagcttggactgcaaacctgcaaaccaaagttgcaaatccaatctgggctcaacccgaacgataaatcctgcatggttattgctgccaagagataaagaggaagaatttccccaaatccagccaaccaaagacttaatccaaagatggtggcgaagaacatgctgtcttggtaactcgatggagaaggttgaagaaaaggagatcatccgagtcgcatccacgccgccattgcaggacacatccgcaccaccgacgccgtcgcggactgcaacggcgcagccgtcgccgccgcggggtgcatcggcgcagctttcgccgccgggggccacatccgcgctgccgtcgccgccgagggcagcaacggcatggccgccgccgccgcgggccgcatccgcgtggccgccgccgccgcgagccgcatccgtgaggccgccgccgcagctgaccgaaaccgagtcgccgccgccgccacagactgcatccgagcccctgtcgccgccgcaggtcgcatccgagccgccgccaccaccgcaggccagatccgcgtcgctgccgtcgtctcggatcgattctgcgtcgccatcgccgtcacgagctgcatccgcgtcgaatccgcctccatctccaacttccataccacaccaacgaggaggaaacgggaagaacccgacctaacgagactagcccggctacttagctatactaggggaggggggacgacccctctccctcccgccgccggcgacgaggccgccggaatcgaggaggaagaggggtcgagagaggggatttactgtagcaagtgaggtttcgagagagagcgctcgtgagtcgtgagaggtttccgcagccttgatttctagttacacgcgcagcctcaaggcaccatctgattcttttcagatttcagacaactcgaataacttcaaatttcagattcttgcctataattcttttgcaatgtaaagaatttcaataagtgctgtagggccaattgtacaaataccatggcttgctgaactaggagaacctatctcaatctctatgccatggtcggaattgtgtatcaacgcaggaaaaagaaggggaaggagatggcgcacagctgtgattgtgccgaaccgtgaacagtaccgcgcagatcagcgtttccgttagcgtgacaggggagttagtttcctttaaatcagtaaattgttagttacaagagtaagcctataagagggcatccattcggatattttggatccatttttactatatctcactcgaaagattttttcttatctctcactcgattttctcacttaaatttacagtccattttcttgtaagttacattgtaatttatgaaacttacactgtaacttgtaacttttgtaagttacactgtaatttttgaatcttcgcatgtaaattttaaattttgtattggatttggtctttttattgaggatatggtaatttagtgtccattatggtgtttcttaattgctttttgctttttattatatctatcggattttaatctaaagattaaaaatctgtgtgatacgatcataaaaatctttcgaaagacgtataggtactccctttttggatatgcaatagattaatcttcatctcatctcctgtttctctcttctcatcccgtgttctctccggcgatccacgacggatcgccgttcgcgcaaactacccaaacctcgtccacccacaactcacacatatcccatccgttcactattggcgcataacaacttgttatcagagactgtggttcaggacgacacatccagcgataagcagccgctgctcgagccgacggatgccgttgccaagctgcaggacaccatgtccgacgtgctcaccggcttggggttgttggcgtccaaaagcgatcttgctgaccttcgtcgttcggtggccgtcgtgacatcgcgtctcacgtccctggaacagcaaccaggggtggcctcgtcttcaacaactccgcttcaacctcgcctcggcggctcggcggcgcgggcatgttgcccaacccgtcccaacccaatctgaacgttggcgcggcagagctggcggcgggcacggggacaggcgcgggaacgggcaccggaggcggcagcgttccccgtttctacaagctcgagtttcccattcgacggcaaagaagatcctctcaactggctgcaacattgcgagcagttcttccgccacaatccgctcggagaactcaaacgtctttcccagacggggaccgtggcggcatatcaggagaaattcctggcgctcgcaagctgcgtccaagatcccctgtcggaagggcaacaggtgcaggcttgcaatggataacaccaacgcgggctgctgctcaccagtcaccagcatgtgagtccgtcgctgccaggtgccagtcaaacccatcttctctcatcgcccacgcccctatacctcctgtccaactgcagcattgttcgctgtccatctaaagtcttacagctattcaccatacggttttgctgcattacggttctttgtgttgcgttgtgcagttcggttggagctggaggacgaccaaggcacaacagagaatgcatatccgagccaaaattatatatcagaaacaccaaaaatggtggtacagtagtttttttttttctgttctccactcaaccagtttggttggacctaactgactgcaactcaaagaagaccgacagttcgacggacggacacaagatgagtctcccactgctaacttttacatggcagacctaacaagatattgttcgtattctgtatggattatatgcaaaaagaatgcttttatggatatgtactccggttttgccattcaatcaaggatgccgtttcgctttcctttttatcctgggcaaatcttctctgctaccctgctggtacctgccatccatacaacacgaccatacataaatcacaatgcaacaagtctcatctcacataaatcacaatgcagcaagtctctcacagaagattatcaggttaatatgttatttgtctgaattggaattgacgagatacaacttacagattagttgaagcttcaggggacttgcgcacctgacgctgtgaggttgttgggcgtgctcgcatcagcagcacaagtgatctcattgagaggattgctgaaaacatagaaatgggcagatcaagcaattaattgttagtggatcaacacatcaacaaatatcagttctggttgacaaattctgataaactaatcgctgacaaatgcagaaagtgcatatagaaagcactacaagatgttactatattgcaggcagcataagtgacaacaagaattctggtaactcaaggatggtaaaattacccaaataataaagcattgtccttaaggagggatagaattggacctgctttatgcaaaatgccgatcgctacatatgaaaaacaaggcccagattctgctgtggtaaataacaacaaaaatgaagcacaaaaccatacaatctacctaacccaaattctggtaactcaaaagcacaagtaccaatagctaagcagatgacatattaagaacaagctataccatataatctacctaacccaaattctggtaactcaaaagcacaagtaccaatagctaagcagatgacatattaagaacaagctatctatctctctatactcattcggtaaaggcaagatatactgaaaaaataaagtcttatccttaatgacttatgattggctgattagtctcaacagtaacatgcaaaatttgccactaaggcactgacctcataaatcttgacatggcatcagctacctgaagacagtgaattccttcctcggtcataaactctggaagttcacatatgtttttttctatattcaagtcaattttgatatcattagagttaaaaaaaaaaactggcatccatttgacaaaatatatgaacaagggcattactgaagtttgcatcagacaggttgtcgatggttgggcaagtgcagctcagatcatccctctccactgaggcgtatacagctatctcgatggtgtctaagtggggatctagatgaaaaaaacacagattagtcacatttaaggctaatgcattgctcattgaagtttttttttttttttgagcaaggaccaaggcccccatttctattaccagaaatggatacaagctacaaggttcttacagaaaagaaagggaagaaaagcagctaaaacatttgctcattgaagtatatcatataattacttacgagtccagttcattgtcctggatagacctttcatctggtctttcctaagaatacggtttgattttgatctgttcgcgccagtctgtatgatttgacagttactctgatcatttgggcctcctaaataaattaggtagatcttcagaattatggcaatatatatgttatactaaaaaacgtaaggtttaacgtataagaagaaaattactcttggagtgtggctgtatatgatcaaattcgtagccacaacaaccatgtttgccatttagcgccttcaggacaggatttccgttggcatccagccgccaacgatcaccagatcgtccaatcaccttgggagcattattccagcaagcttctcttacatctgcgctgaatgaacgaggttttgcaggtgctgatgcacgtagagcacgggaaaacttggacacaagacgggaaaacagacccatgtcctgcagttaacatagcaatagcataaataatcccttgtggatcactccatagatttatcaatttagacaggtttgtaaaactgactcataatatttgataacacatctatcggtatctgtattgaatagccatagaattcatatcacaacatctaaaatacacatcaatacacaaacgtgcatcaccactgacccattagagatatgagtcgctaagtagaagatgtaatgtcaaattagctacatctgcagaaaaataagtgcaggtctaacaagccaatttagcagttaaattatgtgaactgtccattacaaacatatcaaacaacaggacatattggtatgccagtatcgcgcaccagcaagttaaacgtgccctcagcattaacatatcatcttccacaaacaaaaaacacaatccaggttgcagtgctgcactacactcactatctggaggaacccaactccgtgaaatacagcagaatgctacactaacataacatactgtaacacttacggcagacaaccgtaatttagaaaggaaaaaaaatcggacagagttcaggatccaatccgaatgggacaatatgcaatttccgtaacaactgatgcgagaaccccaataatgataatttcccggtactaggttgcaacattggtaaagtcagaagcgatcactagggaaatgcacaaaccctgtaaatccaactcccaaaccctataaaatctcgcacgatcaagggagacaaaacgcgcggaaacgttgcagcacacgggaatcgggaggccggtagcccagcaacttaccaaagtcgaacccaaatcggtgacaaagccttggacttcctggagctccgttcgcgttcgctcgcagcagcaggcctccggcgaaccgcggagaggaacccgcgcgcggggacgaatactctctccttctccgacgccgccgtgcgccgtcggagccaagctgatcagagaacaccacggatcaattagcaggtagcaatgaggagggggaggagagaaggggaggggacttgcctgatggggagaaaagttcgcccctcctgcgcggcggacggcggtgagatcgtctccccaatttcttttccccgccctagctcgagagtcgagagcaaatggggtcgcctaaattttgaaattcaaagtggtgggggtgggggccacatacaggcatactacgaggagaggcgcgtgaagctgaaagcagcccggcccaccgaacccaggttcattttttcgagtggagtaagttcactttgagtccctcaaatctctaataccgaattctgggaggattcgcgtgtaaaaaataccgaattctgggaggattcgcgtgtaaaaagccccgccacatggcaccgcgtggttccaacttcccccccccccccctccgacagtcgtacgatcaggttttattagcaaaatgttaaactccaccaatgataccgacccagacacccagtccggcttgcgcgctggataatctatcctgtgattttttcccatagggcacatgtattctttttagagtaattactttaatactaataaaatctatgtaaatatcatatattgaaaaatatcattcaatgtgtacttggttttatgtttgtataataccttcggagaattatagcatgacagtatacgcaaacaaacggtcactggtggagaaaccatctttcgtcggtcggccgaattccataatagtcccggatgcaataaaaaccggagctaaagatgatctttagtcccggttaaaaagggtaactggcatatttgatttttaatcctggttggtaacaccaatcgggactaaagatgatatttagtcccggttcaaatgctgttagggcctgtcaggcccccccggatctttagtcccggttggtaccaaccgggactaaagatcgtaacttaccaaccgggactaaagatctcggggatctttagccccggttggaaataccaactgggactaaagtcccacccctatatatatgtctttttcctcctccagctgcccgagcaagcttcaaaatttcttcaaaaaagaagggaggtcatgccaaaatttctagtgaatttattttggtgattacatacaaataggaggtgcctaaaaggtttgcaacttcatcctccaatgtttttctttgtcatattacatttggagctatgttttgcacacttttttgtctccaaaatttagttgtaagttgatgagagagaaaatttgtgtgggggaagaaagaacatatagaaatttagttgatttggtaaagaaggttttataaaatagttgagaaggaaaatatagtgaaagttagtcttaaataatagaaaacaaactaaaatgaaaattaaaagaagcaaaacacattaaaatttgtttaaaactttagaaatagtaaataagaattatttagtgtaatattttatgatttttgtatgaataaagatatgtcattattgtatgactgttgaaagagtttgtaattatcttataattattgtatgactgtcattattgtaagaataattatttatgtacgattttttttcgactcatgtagatggatcgtcaatggatgtacgatggccggcggtccaaagagtttattgacggcgtgcattatttttttgagagtggccgaagctaacaggcaaaagggttttatttgttgtccatgcaataagtgtaaaaatcagaaggagtattctgcatccaggactattaatttccacttgtttgagttggggttcatgccaagctataactgttggacatcccacggagagcaaggggttgaaatggaagaagatgaagtggaagacgacaatattccagactttgatcagtacagtggatttgaaggaaatcaaacgggcgagaagaaaatggatgctgatggtaacgacgttgcagatgatcttggtcagatgttgcaggacgccaaggaggactgcgaaagtgaaaagggggcccataaattggacaagatgttagaggaccacagaacgtcgttgtacccaggttgcgagcaggggcacaaaaagttggataccactctggagttcttgcaatggaaggcaaaaaatagtgttagtgacaaggcatttggcgatttattgactcgtcaagaacattcttccggagggaaacaaattgcccgagacaacgtacgaggctaagaagatagtctgccctttaggactggaagttcagaagattcacgcatgtccgaatgattgtatcctatatcgtggtgaggagtacaagaacctagaagcatgccctgtttgcaaagcactatggtacaagattagacgagatgatccaggagaagttgacgggcaattaacaaagaagagaattcctgctaaggtgatgtggtatttccctataataccacggctaaggcgtttgtttaggaacaaggggaatgtgtaacactctgaaaattcgaatgacaaaatcaaaactctaaaaatacagattttcaaaaactttttaaattaattgcatcatgtcgatcttattcgtctatttcatctggatttgatctcgaagattattaatcatgagtaaagaatagttaattaggaataaaccttaaaaacaaattggtaaaataaatacaaaataaatattaggtgggatagaaataaataaaatattatcgcgactatatttggatcaattaaatttgaatacgatggaataagaattaaccctaattaaaactcaaataaattacatgaaaataaaatatgagtaatattaatctagggtgaattcattagttgagataatacacatattgagtaaacttcatttatgcaagatttagaaattatagaatcaaattcatatagaaaataatataaaattgggaaaaataggaaaaagacactattcattagcttctaggtgttcgacgaggctccctagccccttcccctcccctgccatgcgcgcctcgcgccccgagccgtcgccgtcgccgcctgccgccgtgccgctgtcgcctgccgcgccgcgcgccgctcggccgtcaccgtcgcatccctcctcgtgccgcgcgccaccgctgccgccccgtcacctcccgtcccgtcgccgcgcgcgtcccatcgtcgctccgagccgcgcgccgccgctgccgagccgtccccatcgccatcccgctgccgcgccgctcgcccgtcgcgtcgccgtcgtcgccgcgccgagccccgtgccgagccgcgccgagccccgcgccgcgccgcccgctcgtcgccatcaccggccgccgcgcgcccgtctcgttgccgcgccatccgacgcatcgccgtcaccgcgcgtcgccgtcccgcgccgcgtcgcccgcccatcccatcgccgcgtgaccgtcccgtcgccgcgccgcgcgcctatcgtgttgccgctgccgccccgcgcgccgtctccttgcgccccgcgcgccgtctcgcgccccgcgccccgcgcgctactcgccatcgcgtcgccgcctcgcgccccgtacggatacaggatagtgtcataatagcgtcgcgatatctgtcacacagagttgttccatgatacgtgcgccgcagtgagatatgccgttcttcccctcttgacaaatccccccctctttatccattctccccaccccatatcacccttccttccctctcccctttccagtgcgccgtcgttcccgtgccgccgcgccgccgttcccgtgccgctgtgccgccgttcccgcgccgctgtaccgccgcttcggtgccgccgtacgccaccgtcgccaccgccgtcgttgccgctgccgccgtcggtgagcagccctccttctcctcctctcccccccccccccccccgcgtccaccgccgccgccgctcgggtaggagggagagccgagagagagagatagagccgagagagagagccgagagggagaggaagagagaaaaagaaagagaggaaagaaaagagaaggaaaagagagaaaaagagaaaagaaaagaaaaaggaaagggagaaaaaggaaaaggaaaaataaatagaaagatttggaagaaaattagggaggttaatagtttagaaaatttaaaataattagaatttaattatagaataatcatggtcctagaattgcaaaatttaattattcttggtaatttccaaaagaaatcaattcgcagtagtagtttagatataattaacaattagatgaatctttatagactactatagatcatttttggataatcttttaagtaatcgattcacggtagaaattcggacttaatcgctaggaattttagacgtatattatatttaatcatttagtcatagactaaattaaaacgtataatattataagataattttaggattccgtccgacatttagctcgcgatagaaatttctaacctattatatggatataatgctcgggtagattaaattaaaaacttatgacaacaaaatatttatacccgcaaaatagtttaaatcaaaattgggtttgccgtagcggatagtaaagttaataaaaaggaaacgactttcgcattcgactgtcatttggatttattcggattctcatttgaattctaaccgaattcaaatcaattcttgcacgtaactatagagcccgagggagttgcggatccaagcgaaggccaagacccgcaagaccttgagcaaggcaagtcatcactattccttgaacatgttgatcccaattgcgaaattgtttggtttacaaataaaattgcatgcaatgatgaacatcctacttgtgattatgccatgccttgattattgtttacccttaaatctttgtaaccatgtttacgtatgagtccctagtcaactatgacaattgcttagaaacgctatactagaatcatgcatactcatatttatcaaatgctatatgcttgggcaattacctttgggaaggtaattgagatgcggcatgtggagacatgtgcgccacattgccatgatgttgatgacatgatttgtgaaagaagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctggtggagccacttcctgagaggcgggaatgtggacgtcctcagaaaaccataacgactcaatggcgggaagctatccttgggatcacaatggatggtggacagaaccgtcattgtttaatatgaacactggtattaaaactggatcagtttatgctaggtcttaggcttgtaaaaaaaattacaaaatttgctttgcgcaaaagaaccatagccatcctctgaattcctatgtcatgtgcatcattgctgtggtggcttgctgagtacggttggtactcatccttgcaaatataaaatttatcagaagcgggagatgaagcctcagaggatccctatgcctactatcaggagggagatgaagacgatggcgtctagtaggtcttagtacggtcgttgcctgtggcaatggcatgccgctgcctgaattccgctgccttatctatttctgcttttggatgtattccggaccgctcggtccgatgatttaagactatgtctgcgggcctatgatgtaataattcgtattagatactcgtgtatgtgcacttggtattccagctatgaattcgtgtgtaccaaactacttgatccagggaaatggtactgtttacacgattgattcctgttataaaaacgggggtcgacagaatgctagaatgatgcgatggcacgctgaagagcgtcaacaggatgggatgctgagacaccccgccgatggttcgcggtggcgaaacatcgacagaaaatttaaagactttggaaaggacgcacgaaacatacagtttggttttagtacggatggcatgaatccttttggagagatgagcagcggccatagcacttggcccgttacgatgtgtatctacaacctcaccccgtggctatgcatgaagaggaagtacataataatgccgattataattcaaggccccaagcaacctggtaacgacatcgatatgtacctaagaccactggtcaaagatcttaaactgttgtggaagaaggaaggtgtccccgtgtgggatgaggacaaacaggaggagtttaacctacgagcgctgttgttcgtaaccatcaacgattggcctgcacttagccacctatccgggcagtccaacaaggggtacaaggcttgcagggctgcaggaa

SEQ ID NO: 37536 - DNA, 2582 bp, Oryza sativa
gcaaaccacccggtacggaagaaaggcaagcacttcgaacataaggctgaacaccgtacgaagcctaaacatcgcaacgggaaaacagtgtttgctatggttaaagatcttaaagtagtgtttggaaagggtcctggaagccagccgatagagagcggagatggtcacgcggcgatgtggaaaaagaactctatattttgggagttaccctattggaaattcttggacgtccgccacgcaatcgacgtgatgcacctcactaagaacctttgcgtaaaccttcttggcttcctaggtgtatacggaaagtcgaaagatacactggaagcacgtaatgatctgaagcatatggaacaacgcagcgaccttcacccggaacctaaaggagaaaggaagccattacttgagtccagccagctacactcttagcaaggcagagaaggaaagtatgtttgattgcttggagagcataaaggtaccgtctggatactccacgaatatcaagcgaataataagcatgaaggagaagaagttcacaaacctaaagtctcatgactgtcacgtgttgatgacacaactgctactagttgtaataaggggtatccttccagacaatgtccgggcaacaataacgaagctatgtgcattcatgaacgcaatttcgcagaaggtcatcgatccggatagattagaagcccttcagaatgatgtggtgcaatgtcttgtcagttttgagttgatatttccaccttcatttttcaatataatgacgcatctgctttgtcaccttgtcaaagagatcagtattatcaggcctgtgtacctacacaacatgtttcctttcgagaggtacatgggcgttttgaagaagtatgttcgtaaccgtgctcgtccagaggcaagcatcgccaagggttatggaacagaggaggtcatcgaattttgcgtagaatttattgaagaccttcacccaatcggggtacctgaatcacgccatgaagggagactacggggaaagggaactctcggaaggaaagcaataatgacgatagacaacaatttattccgtaaagcccatttcacggttctgcaacaatcttcattggtagctccttacatcgaggagcacttggctctagttcgcgccaggaacatcgataagtccgatgcatggattacacggcatcacattgatactttccccgcgtggctacgacaacatctcatgggtaacgagtcgatcaaccaacaacttgccttcctggcgaggggaccgtctgggtcgatcgcaacattccagggatatgagatcaatgggtacacattctacacgagagcccaagacatgaagagcacgaaccaaaacagcgctgttcgtgtcgatgccatgggacacgatggaacaactagcacgtattacggtgccatcgaggccatatgggaacttgactatggtcctccgaaggtccctctgttccggtgccaatggattaggttgactggtggaggcgtaatgattgatgacagtgggatgacaacggttgaccttaagaaggttggatactcggacgaaccttttgtccttgccaatgatgtaacgcaaatcttttacgtgaaggacacgtctagcaaaggaaagaagggcagagggcctgacgagcctaagcgtcacgtggttctcccaggcaaaagaaaaatcgtcggagttgaggacaagactaacgaggattacgatcagttggatgggcaaccccctttcacggtgacgattgaccctagcatccttctatcaactgaagacaccccttactcacgtagcgatcacaaggagggaacaatagtgaggagaaagtacgtgcggtcaaccgtcagcgccgatgtattgccgtaattattgtgtacacaatgtaaactattttggatgtattgattaaatcaattgatgtatggcatatgttaattacgcacgattatttgaggttttaacaagtttaaatcatgtatatgctagttatatgcgataattacaatttttaaattttttaaatcatgcatgtggcatttatatatgttaattagagtttttaacaattaattcaatatcattcatatgctaattatatatgactattcgaatttttaaaattttcaaatcatgcatgtggcattcacatatgttaattagagttcttaacaattaatttaatatcctaattatatatgattattacaatttttattaattttaaatcatgccgtatgtatatacatatgttaattagagtttttaacaatttaatatcattcatatgctaagtatatatgattattagaatttttattaattttaaaacgtaatatttgcttattacgttttatccacttaatttattacagacagtactaattttccgtagtgattgtcattaatttttgtactttaaataaatttaatgcattattttctattttagaaacacatatgtaatggaaaataatactcagtgcgcttatcagtagtcccggatcttaaccctaaccgggtttaaaaaatttttggaaatagcgggaaaagatcttta

SEQ ID NO: 37537 - DNA, 6346 bp, Oryza sativa
tgccgccggccgcctcgacgccgacgtcatcacgacatgacgccgcggcacgacgccgcggcggcccgatacgacgagacgccacgacgccgccgtggcacggcatcggcgccgcgccgccaagccgccacgccgccgccgcgcaacgccggcgccgtgccgtgcgcttcgccaccgccgcacaacgtcgccaccgggccgcgcgccacgtcgccaccgtgccgcgcgccgcacggcgccgccgccgcgccacgccgatgccgcgcgtgccgccacgcggccgctgcaccgtcccgccgccgtccgctgctgccacaccgccgtcccgctgccgccacaccgccgctccgctgccgccacggcatcgaacaaaataacgtgaactaacgtgaacgagcgaacgaacgtgaacaagaacgagcgaacgaacgtgaacgagaacatgaacgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatactttagtatataatttattgactagctagggtcctataatatacgtctcctagacttagcatatatcactatgtgagttttagtataagattattagatttgtaattagacttagcatataaggttgtgtagggttctaatatacgacagttacacttagcatatatgactatttgagttttagtataagattatttgagttttaatataagattattagatttgtaattagacttagcatataagattgtgtagggttctaatatacgatagttacacttagcatacatgactatttgagttttagtataagattatttacgttttaatataagattattatatttgtaattagacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacagatggctgatcgcgatgaggaacagatattgtatgatacaatcgcggagggaagcagccagtactggaacgaagaagaggggaacgaggatccaaaccagtatttgaacgaggaagtgcagagggatgcagaggggaaccaagaggggcacgttgaaagggatgtggaggggaaccaggaggaggaggatagtgcaagtcaaccctccgctggacagaagagggcacgcgggcaacgaggtgccgcgaagaagcttgagggtcggcacaacataacggaagtggacgaagacggccgacctagtgccccggcagaagccgccaagaactatgtacgtcatagcggttgggttgtgcgggataacgtgcctgtcagtacggtatactggcgcagaacaagggcacgcggagatcatgagagctttgtcccagattcgaagaaagagatgctgtggaccacaatgctcgagacattcacccttcccgcgggtacagaggacaaagtgaaaaggtggattctgaagaaaatggcagaacagtttcagagcttcaagggagatctgtaccagaaatatatcctgaaggggcagacaccgaacttcgacacattcccaaagctaagggatcactgggacgagttcgttgcatataagacatgtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagtggggtatcgaaccggccaccgctaattggccggaccgatcgaagttctggtactatgctcatggtggaacgctcaacctagctgatggctccctggtcttcggcgatcagatacgcgaggctgcgcatcgactaacagaagcagtggaagcctcttctcagggcacgttccgaccggacagagagaaggacgagctgtcactcgccctgcaaactctagagcatccaggacgaacacgagggaaatgggtgattccttggaagattgggttcaaggaggacatccacacgtacaggagtcggatgaggagcaagagagataccgaggcgaagattgcagatctagagttcagggtatcgagctacgagctcagcatgcaacaggaggtggcaaggaaggttgatgaacgcatggccgcacatcggtcccatgatccctagccgaccattcctcctgcaatggtgagcccgtcaggaaaccgtagcagctgcgcctcaacgaggcaggtaggatcacagagcatggacgccatgcaaacccagcacgaaaccacctgccccgttgatgacatcactcagcggacaccatgtgagctgcatattcccttcaagaacttatcaataaaggtaagctcgtagtttatagattttagatttggccattccgctagttgctgcttatatatgttgtttactaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgaggtggattaccctggaggagatggtgagacgcatctacgcgacacaagccacgccattatactatggcgcaagcgctacatcatcctccctgggcaacaagcggcgtctcatgcaccatcccctccggctcctgcaccgtctcctcctcaggctcctgcaccgtctcctcctcatcagtctcctgtaccgtctcctcctcaggctcctacaccgtctcctccttatcagtctcctgtaccgactcctcctcaggatcctgcacagactcctcctcctgcacagactcctcctcaggctcctgcgtcgtgtcctccagcaccttccaagtcaagaactcaccaagcaccaccgcctgcccgcacaagggcaacgaagaaggcgaaagttgacgccgccgagaacaaggagccaccgtacgattgcacgcaacaggagcttgacgcttacgtggaagcagaagtgaagagacaattgaagcctcggggtccagaaaagaagattcctatagacccgagtgccaagaagttcttcaggagtatgtcggcaccagccaaggaggccataaagctaacggattatgagcgaacacttaagaaagcatcttctggaaagtccaaaccagtccctcagcttggagagcaaccaaaccaggagatcgagccgttggtgaccggcgaatattttggaatacaagaatttattaatgacaccgggctaactacggatcaattgctaggagacgcaccaatcaaaaaggcggaagtgaaatacatgtacgaactcggtaaatcgcttgtcaagcctgagctgctgcagtccctacccacacaaatgtacaagttccatcagctgtacatggagatgagcgcaaccggtagagagatgatcggagtgaggattagggacacggacttcttgcaaggagatgacattctctggatcaatttcaggggaatctacgaactataccagctggacgcccttgatgtctctattatgagttgctggattttgtaagtatatcgttcagttagatttcttactacgtctcctttaattaattaggtccttgtatataagtagactatatataatatataatcccttttatcgttgtagaatggagattcaaaggggcccgacggcggggggttttcgatactggattcatcgaccctcggaaagtaaacgtcgcaatgctcgaccaatacccgcaagccacagaggacaatctcgtccatctcttgaaggcgcagcattacaagacgttcatactgttgttgtacaacacagagttagtttaattttactgtcttcctataccaaatttcattctcgtacgaacattctaagtgtttcatatgtaatgcatcccacgcatattgcagattccactgggtgcttttactcttcgacctggaggcctacaccgtcaacatatatgactcaatggataaaaaagagtctacgttcgacaaggttttcgaacttatagacaggtactgtcataagttcctatgtgttaattaagaatcttgttatagttaattgctactacgaatcatagctttaaactccatgtagggcttggtatcggttccgtcatttggtccgcggcaaatggatagaaagacttaggcggaagttcaattttcctgtgagtacacatgctctacatttatatttctccgattcaaatacatacaagtgtatattaattagatctctcgtcgtttgtcatttatttatagtgcgcaaagcaaaagaagggaactaacttgtgcggctactacgtgtgcgagtattgccactgccttgcaaaccaaatcatcaccacaagagagctcgacgtacgtacaaataaattcaaattttcattacgtatcgatttgttgtttaattactaatcaatttcatacattcatatagtttattcgcatgagggataacctgatcacacacaaggaattcatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataatgtaaatatatatatatatacacacacacacacatattatatatattatatatatatatatattatgcatgtacatatgtattgaaacatatatatgcatggtttatatatatatatatatatatatatatatatatatatatatatatatatataaaccatgcagcaacagggccatgaaaaaaaaggtcagctcgatctttagtcccggttggtaacaccaaccgggagtaaagatgactcagttgatgttaccaaccgggactaaagatcgatctttagcctcggttatttcacccgggattaaagatagcgatctttagtcccgaattggtagtcccggtttggaaaccgggactaaaggggggttacgaaccgggactacaaatgctttctccaccagtgggtgaatttagtctcacgtttgtaattttaaaattttgtatataagctgttagaattagtaaaattaaaacaaaatattttttatttcttgctaccgattgctttaccttttgttaaaagattgtttaacattttctataatataggatattaacatggttaagttacatgtttccagttttaaccaatcacacttagcactaagggcgtgaataatggtacgatcaccatgtaggagagaatgccacacaatatatttttttgttgtggaagtgagtgagatgagagagaatgcttttgtctataaataggcagacatatat

SEQ ID NO: 37538 - DNA, 693 bp, Oryza sativa
ctggcggcgtgtgttggcttgtgtgtatgttgtgttggtcttgtggcttgtcccctctcctcataggggggcttgtatttatacccatagatgtccctttgtccaagtagaactagggagaccaacatggatacaatccaggtagtccttgtcgttttcatatagaactctgttcgtccttccttatctggaactccttttatatacaatgtatgattccgtataagacatgttatgtggtaggccctaccgagcttagtcaactactattaggtatgtggtatccataaccatgataggggtctccacgcgtcctagccttatgtgatcatggctactatagatacaatcgttgctcatatcatggatgaacaaggagatatcaagatcaagttctccatgtgctggaatccgatttagccacatgctacactgctgacttcaaacggctgccaaatctgcatacgacctccattttcagcccatgagtacttgatggaaagctctcggagtcctctttccaatggatccagtctcaccaccaaattccatctaagtcatccgcagatgaagaaacaaggtgatgcgtcacctgttatgggcctttgggcttataacttcgtttgggaccccggtccaagtgggacccaagtggggtgcgccccaaccaggtggagcacgaccctagagtcc

SEQ ID NO: 37539 - DNA, 943 bp, Oryza sativa
tttgataatgccaaaattttatcatgatttcttatatagttaccaaaatttagcagcaaactaaatgtagccactttttttaacaactttaccaaaatttggtaatattaaaaatgacatcaaatgaacaggccctgaatgaatgaatgagagagttgtcctcctttctttcgcctcacttcctggctcctgctataagaaacacttctcttcccgtaaaaaccgattaaagaaaccaatcatgatacataaaaccaatcaacctattctgttcaaatactttcactaaactgaataaagaaacgttacgacagacgggcctataaccagtaacaagttgaaaaacagtttggcacgaggcaaaatatactccctccgtcatataaaaaaccaatttaatattaaatatacgttttctagtacaatgtatctagacattagtatgtctagatttgttgtattaggaaacgtctaatccaatacgaggttaagttttttttaacgggagagtagacggtaatcataaagagggcttaatcaccttcttttttttttaagcacgcacataggaaaaacatcagggtatgcgggtatgcaggcgttcaacacttcaacgtactacgagacaaggacgccaaaaaaatacttcagccgaccgctccgacgtgtaactgtcaccgggcccaataattcgtgggccccacacgccatccacataataactccctcacccccacagcccattgacctccttcctcctacacccacccacccaacccaagccgtcgtcgcgttcacacacgcgcaccctctctgcccccacaatccatcccgtcctctcctcctccctcgcccgacgcgcatcgccttcgccatggacgccgcgagccgcacctggccgcccccgaccccctccccgccgcccttctcctcccgcccccgc

SEQ ID NO: 37540 - DNA, 6828 bp, Oryza sativa
  unsure (1)..(6828): unsure at all n locations
nnnnnnnnnnnnnnnnnnnnnnnnnnnnnnnnnnnnnnnnnnnnnnnnnnnnnnnnnnnnnnnnnnnattgagcttgcactgccagctttcggtgcactagagtaggcactaatcacaaaagagcgacacctcacagcctatttctatcacaccgcaatctgaatctctctggatgtggatggagaattagaaatacggactatggagctcgtaaacggtaaggtctattcattcagaagcgaagataaaaaaaaaaactctatataaaatcggcggtagtaagaaaacaactaccactgggtgttcccggctatttctacccatgatttgaatttgatgaacccctaaacaaaccatatgttgctgccaaagtgccaattatttaagcgaccgcacacgctaaacgctattgctcgcgttttattatctgggttgagaggttgacgccagaagcaaaaaggctcaagcaaagcatgcaggaggagatccaccacactccactgcactgcactctgaataaagaacgggggacacttggtgtgcgggtagccgcacggctcgaggaaatccgccactggaaagtgggaccgggcagtttcgctactgagaccaaggggtttgacccgcgggactgtaacgtgggcccacctgtcaggcgcggcggaaaacggcagagagagagagagagagagagatggcgccggcatattcggggggagggggaggaggaggaacacgtcaatcgccgcagcggcggaggcagctgcgtgaaccgccactggcctcgtcgtcgtcggctcggaatcgaatcgaaatcgtcggttccggtggccgtgggagaggaaatcccctgagccggagaagctcgagctggcgaatctatggcagaggcagcggtgacgagctagcgaaacggagaggggaagggtctcaccggatgggttggccgccgccgccgccgccgccgcggcgtctcagcttggctcagctgctcctcgatctcttcctaaaacctggtcggaattgtaggagaatcgagatgctgagaaacaggaagaacagattcatacagtgagattgctatgcaatactaggtattagtagatatagtaggtagaaagagattaccctttattgagttttcgttcctccctgctcggcctcccaggtgtcagcgcatttgagatggtttcgccgtggaggtggagcacagataccacactcctcttttttctagccaggccgcgctcaggatcgtaggcccgtttattttactcgtgagctcaagttccaactcacacatgcgtcaatccgaattcaaaattctagcccgttcagtgcatatccgcacgcttgctgacgtgtggaaaatgctgtcacgacacccatactcgggtgttctcgtattttttttaagtaaatttcacaaaactacatgttttatggttcaagttgtagaaaaccacacacattttaacacttggcacttaagtatatatattttggtagtttagtttcacaaaaccacactatccatgaatggatttacccgcgagatgacgtggttgttccatctaggatggggacgtggcatcctgttaattttgtctgatggctggtaatatgatgccagtcctcgtcctatgtgaaacaaccacatcatctcgcgagtgaatccattcatcgatagtgtggttttgtgaaactacacgaccaaaatatatgtaattaaatgccaaatatcaaagtgtatgttgttttcttcaacttagaccataaaacatgtagttttataaaatttacttttttttttattagtcacatagtcacgcaacttgattgagcaaagtgaaaactgtaaaagaggaaatacccatatactatcagaaaataccgtctctgcacttctgcaggtaaaagatgctcgatcaagttggaacaatttacatgcaactttaaaaacacaagtagcaactggcaacaatcacctgacatttcacaccgcaaaatgacaatatacctggcaataatttggattagcacagatctgctgaaatggtccaattgcaaagaagttggtggtacacgtgcaggaagtacatgaagattaagatcaatgtataatatgtacatcgtacaaatacgcaacagtcaacagatggcatcacttcaaatcttatttattcaactactacacgatagtaccactctttgcacacgtatgagcgccgtgccgggatggagagaggtccaaacccaacccaggacgaaatcaccacgcacgagggggtgctccggaccctgcttcgttcaaccggtccagcaatgtgttgaaatccatcggctggccactctcggtcatcctctgaataacattcatcacctgctccctgggatatcccatggtgattgccttctcaatcatttccccataaggatggccgcgcatcatctgatgcgaacctgggtgactcataccaacattacctggagctggaggcatctgaggtgcctgggctgctgaaggaccacttggggggtagccatatgcagtgttgtagccatgtgagctgccctgcggcgcatattgtggcgggccggcatagccccccttacttggaggtccgaaagagccctggcttggaggaggtagctgctgcctttgcatgttgtgctgcggtggtggcatgccaggtcctccgtatgaatatggcacttcagaacggctccccgctgccggagcaaccgtgttgtatggtccttgcatagccatgctgccaggtagagtttcagggggagggttcaaggactggtggggttgataatgagggtagtttggtggagtttgaggcctcatctgattttgtacaggaggatgctgttgtggttgcattgcctgaggaggaagctgagtgttagattgctgcggttgcactggtggcggaggaaactgttgagcattaggctgctgcactggttgaggagcaaactgctgagtgttagatagttggggctgctgcattggttgtggaggaaactgctgagtgttagataattggggctgctgcacaggtggaggaaatggctgcgagaaagtcggctgtggctgggccactggtgcaggagccggctgggaagattgctggggccactgctgctggtagggagggaaagactgaggctgggtttgatttgctgcctgagactgttgagatgaagcatggacaggaacatcttgcgttgctgaaggccttactggcaagtactgcacctctggttgtacttgctgcccctgtgtatcctgaatgcctggagcttgacgctgtgggtagtaaacaatggcttggctaagaacataacggtcctgctgtggtacagaagagctaggtggctgctgcactgtctgatctttgtactgttggactggttgagaagctctaggtgcaagggatgagttcacctgatgaggcaaaacaatcgccagctgctgaccaggtgcatctgccttttcttcaagcgtcttttgctcagggaaagatggtgttggcatatcttccttctttttagatgtgtcatgtgtaagttgaaatttggctaattccttctgagtttcagcaactcttgcttgtccctaaggatttgaatagatctgtgcacctgcatcatttgaaaatttgattagagttgaaacttgaaaacttctcaacagagaattaatgctcaaagatataaaatacagtacataaacagtaaagaaattaaacatttggagattgaattgttggttaataataaattgtcacatcttctgaacttggatacggtcatgtgcccatcaacagctctgtgatagccaaaatgttttgcaacgtgcatgtcattttagactgcaggacaatctcgatgaataccaagaatgaactatacttaaatattctgtttgctagaaatactcgaagtttgtggtcaggccttaatctccaaattctaaataagtgtcatcttgaagctcgtggtagcacctaagactccaaatggccattatggctcaacagatgcatgtctggcatggaacatatgagatgatgtatacccttagcatttgtgcactctgaacttataagatgttagaacagatccatcacagggatcacttatttatcaaccacagttgccaatttaaatacagaggagtgttgccaatcctggttgagtcacagggtatacattagacatactgagtatattcaagagtggattccaggcttcgagtgcacaacaggcaacaagactagtttatcagaagaaagtacaaaacaagaaggacatttatgtgcattaacctctgaacaggtcagtagggagcagcctttgagagaccaggaagacatctctccctttgtctgaaagggacggtggtatagcaccatcacatttcttagagattggaaatggtgtactttttgttcaaaggaaaaaaacaataatcacagcccaaaatactaaagaaccatagcccacaaaaaccacaacaacttaggagattagggcctctaggctaaacatacataagcctaatatttccctatgtattcactagatggtattttaaatacatataagaattggagcatgcatttaaagcgaaggagcaaaatcacatacacagtataaagaaaaggtaagttgtcacaacaaataaagaaaacatgtactgtacatgtcaatcaacacaaaaggctactccatccgttccaaaatataagcatttttgtctgcacgcggggatgtccaaataggcatataaattttgaaatacgtgcagaaatgctcatattttggaatggagggggtataatatatggatgagtatatgacatgatcataattacactggatgcaaaagaactgtcccccttcagtgcagaaactgaaagggtggaaaatgtgaaatactggatctagtctcaaaatatattttttcttaaaatagtgatttacttacttcatgaagatgtttctcaagagacttcaatctttgatcagtctcatcacggagcacatcacttcgaagttcacccatggatctctcaagcttatagcaatagatctccagttgtgaaagacgattagtaattccctcaagcgatcgcagcaaattatcagcatatttcttcatgcacttctcaacagcaaaaagtacatcctccttgccgtaactctcttgttcataagcttttccaaatggtctccccaatctactgtcgtgaaagtcctgctgcacaagtacaagaatgagggatgaatatagcacaaggatttctactattataatcattaaattaattttgcttgtaaaaatgcagatatctttgacaaatttcattttttaagaaacaaatacatcagatttttgtaatgctctctccaactatgtcagtaatagcttaatttgattatttatataattttggacgatgcaggagaactgcgcttcatttcattaagaagaaagaaatatttacataggagggatcaaggagtccctcctaccaagaacacatcccaaaacacaccaacccacaggtgattatttatatttcacctgttagaacatagaataccatcctccagcaacaccaagggtgtcatcagaagtttccagaatgctataatggactttcaacattcacccataaagacaataatctctaaacataaatggactgaacaaatagataagcaagacaataatccctaaacagactgaacatataggtaaacttatcaagtacaaaatcaacgtcaatccaccttttctctaaacattagattgtgttccttacctagaatagcaatgtcctggacacatggtcactaatttatatgtaacaaaaattttactgaacatgaaaactataggcggtattaatgttacgtgtgaatcaaatagtcatgacttgcataaatcttattcaacagaatgtcagaaaaaattatctgaaaactatatcctataggcatctttctctctcgtgcagtggccctcacagaaataacccactgaatatttcaattgatagcttattaaatgaatttctcattgactatctccagcctatattgaccattcaagacaaacctacactgcacatcaggaattcagtgtgggtttaatcaaaataagacctgaaaatcccaagtatagcaggtaccatataaaccttgatgcacacaataaaataaatccatgatattctctgaattacaacagataggcatagctggaataacacattcgtcaggaagaaaatgaaatagcaagcgatggctgcatagtaccaacgagcctataaccaaatcgatgtgaacgttacaattgggcaaaaaaaaaactgaaactattcagtgctgttcagccaattttcatcggaccgtttccacactattcagttgaacgaatagattcacgggaatacgacaccgctgaggcgaaatcgtgcggcaataagcctcggtcagagctctgcacgcgatcatcacgcaccacgattcacgagggatcaaaggtgggttgccgccgagagagggcgggggggggggggggggaggaagtaataccttgtcggccggatcggggcgcttgggctcggagggggcggcgaagtcgtcgtaggagcagagcacgtcgtccgcgccgaagtccaagctgcgggagccgcggccggcggggacgccggacccggacatcgcggcgcgctagggtttacgcgacacggggatagcttccttggaggggaaggaaagggaggggagggggggaggga

SEQ ID NO: 37541 - DNA, 17277 bp, Oryza sativa
gaagcgggggttgggttgattggcactggaaggaagaggagggaggaggatgacgacttggtggtcggtttggtctgcggccgcctggggtgttaattaagcaaaggcgtcgccgtcccggttgcttgttagatggacgctcacattgacggaaacctgcagcgcctctgttggagaaattctatccttcggtactgtcttcttcagctcacgttaaaattaaaagtttagatagaattaaaataatgtgatagaaaagttgaaaatttatgtataaaaaagttttaatgtgatgaaaaagttgaaagtttattgaaaaaatttggaactaaactcggccttagttggaaaagaaaatttttgggtgtcacatcggacgtttaaccaaatgtcggaaggtttttcggatacgaatgaaaaaaataatttcataactcgcctggaaactgcttgacgaatttattcagcataattaatccgtcattagcacatgtgggttattgtagcacttatcgctaatcatggactaattaggcttaaaagatttgtctcgcgatttctcccctaactgtgcaattagtttttcatcttatctatttaatgttctatgtatgtgtctaaagattcgatgtgatgtttttaaaaaaaaatttgggaactaaacaagacataagggtataatcattgttttctctgcaaatttttacaatcgtccaatcagtctataaaaatcagttgtatattcatgctaagtacagatattcacttaccgttatttttaaagaaaatctatttatattatatatatatataacggtgaagccaatacctatattacagttgagcggttaccactctgttggttttatcaagtgataacaccaacatgataacaccaacagagttcaggtaactgctcaactcaactgtatttataacaccaacagagtttaggtaaccgctcaattgtaatataggtattggcttcactgttagatatacaaaatataaatatattttagagtttatcactattgttactattgttacataactttgggatatccagtattgtggttcaagaatacgaatccaatacgaccactagttaagggagtcaaggtgaacttattccttccatctctatctctactattataaaaaataaagatgtttttgccggtaccttggtatgtcatccatatatgagtcggtttttaagttcattcgtttttggaaatacatatccttatttgagtcggtttttaagtttgttcgctttggaaaatacaaaatgatttctttaaaaaaaactcgcatgctaatttgagacaaccagactcctaattgtagctcatgtttagattttctgaaaaaatatatatccaagcagattacttgagacgatcggactcctaactgcaattcatgattttctaaaaaaatatatatccaagtgaatacccatggtgaatttcaccttaactaaaccatataacaataataaaattaaaatagccttcaaccattgcaatgcacgaacattttttttctagttactataaaaattgacgatgcttccgctgattctttggtatgtcgttcgtatttgaattggtttttagttctttcgcttttgaaaatacagaaggagtcgtgtaagaaattcatgttaacttgggacgagagtcagactcctatatgcttcacaattctcgctatcccataagataacaacgtacacgatatatctatcatcccaataagagttcctaactagatatcaatactatcaaaataaaaaaaatcccatatacttttgctaacaataatacaaataaaataatattcatcgttacaacgcacggatatgttttttaagttagtgaaagacggaagactgtcagctcacaggctaacatccataaattgggccgaagcaaggccttccgtggcaaatcgaaagtccgaaacgacgttaactgatttaagcccgaagggcctcatcgcagaagaagcccacaaccattaggccgtaacaatggcccgcgtcatggccttctgcgagccgttttgctggtaggctacaacgacggcgacgaggcgggcctgtttggcacagctctagctctacttccattctttctggagctggagctcagccaaacagctccaccaaaactgggagtagagttaggtggagccctttcacaaaatgtactagagttgtggagctgggtttaggtagctctacaacttcacttcaaactcaactcctggagctaaatttagaagttggagttgtaccaaacagggccagaacgttttgaccgaaaaagctatacgctctccctttgatcttgacaagagccttttccaccgagctagccattatttctcatcccttttctcagtcagatgacgtgctggtcgtccatttgttaattatttgcaatgtggcacaatcatgattcatgacctatgtaaagttgcgcatatttttcttaatttttgatggaaaagtttctaaaaggaacctttatatggccacatgctcggtgtcgtgtatatatatgtgtcacccgtacggatgattatattcggattggcaaatcttcgatggtaaagtagcaatgcagggacatcgaaagcagcaattagcatttgacattcgttcgtaattcatatataaatatttgctgaagctagctttgtcacaacaatgttggtaataacaatacaattcaaactacagcgtatacaaaatatatatgctagatagctgcagcggctagcgtacgtatacatatgcatggctactactccccggatggccggatggatatgctacgatgatatatatagctagctgcagagaaaacattatttgctgccaaaagaataacccggccgctacacaagttgcttgctacctgctgccacccttagttacaagggtttagtagtacaactattgagcaccagtcgatcaacctaagcctctcagagagattatttctttgagatcataatagcctcagacgagattatttcacgaataatgctcgatatatatatcggatcgtcgtctagtaatggtgctgagggtccgggccgcccggcacttcccgcttgccgccctgtaggctcctcacgttccacctccccggccgacgacgtccacggataccaaatccgccgccgccgccgccgccagccacgtcgtcgtcgtagtcgccgcccggcggagcggcgtactctgccaaggcacgggccgcctcggcctgcgtggccgcgagccccacgacgaccaccaagaccaggcagagcacaatgcagacgcaactacgaatagccatatctcaattgatcgatgaaattattcaccgtacgtacgtgtgtgtgtgtgtgtgtcgatgagctatagctagctagcttaggttcgtttgtgttgtcatggccaggtgccggcgcgaggtgtgtttatatagggggtgtagaggagacggtggaactagtgcagcgacggttacaaaagaaacatataagtgtgggggccaaagggcgccggccggggggcgttttcttggataagttcggtactaatctcaactaccaccgcattggcgcattctacgtagcctttcttctggcctcgtccgagtggccactggccaccaccaccacaattgctggtgctgctactagctagtaatagatcagtaccatgatgcacaccattgccactttctgcgacgaggaggatatatatatccccttttggcttttgcattaggcattagagtgtgaggtatgctaattgcaatggctgtactacatgtaggttgctgttggatgaaactgtcagctagctaggcatcctagacaacgagtgcttggagttgtcgaattcacaaatgtcacaggtaagatggaagaaattaattaaacacacagtaaacattgagtagaatcaaagccaaggacaagactagtagtgtagctgaactggctatgcgccgaatgcagtaccgccagcacgtacggcgccaaattacctggataaattcctaagtacagcatgagatattgagctgaaaccaaaggcgaatcaatctggttcagaattgcaatcctgcattcagtattactgggtcccctggctatcaacatttgcaatctcgactttgatacgaagctactgatatccataccttttagtgccaccagacattacaataggtaatatggaaggcaattgtaaaatatgaaaattcaaaagaattctttgaccaaatcactttgtagcatcaaaacaaatatgctcgatcaccaaccattagtatacgagcccgctacgtagctatgtagacagtgcttagtggaaaggaaaacgagtagccaataaaatccaatgcttggatgtaatttatatgtcaatatgtcattttgctcatctatgtgcctgcttcgtcaaaaggctgtagtacctcgaaaggttagttaatgtttcggttgcagatttgctctttatatctttgcaaccgattagccacatcctctgcatgtaacggctgtctgacctcctcataatgcaagaaggcagcttgcagaattttataagataaatggtcgaaatcaaacccaagagattacaaataagaaccacttgattgttaacacagagtccacgtttcgggttctaagtgtctgtttagctgagaaatgatacggtcatttgactttaattcgatcctgtatgacttgcttggtttgagatacgaaatggagtgatccatccgtaacttcgtccctcaaaaagtcaaaacatatggttactgacaaaaattaggaattctctttattccgtcaaaaccatgaaataatctcacgatgaaatactcgcaccagagaagccatattaattaactgagtcggttgtacgtcacaatcagcagattccatggtaatatagaggaaaaagttactgaaatcattccagtcaacaatctttctacatactgtgttaagtgactagatgcaatctgtttcgaaagcgacaatgctgttccttttacaccacaccttttgccactctctggatgaaagcaacctttttcagataatagtaaaaatattgatccacctagaaccttaagcgatgacgttattctttttttttttaaccttacatctattacctgaatataagtgactgaacgatcgcttaggatatttccaactcagtacttctcattttcatttgcatagcagatgcagggaacagaagcagagtgatcaatgaagatgcctagtagttatgtaccatctattacaagatcatataaacaaagaatctgcaggacagacgaaactaactattttgtacaggatcaaccaaaactaatttgatatccaccatgatccaaatgttgaagtgatatacggtaaactggcgagtcaatgtaaaaaagaaaaggcgcacctccattgtttatcaaatgcaacttcacctgaaacattgctagctaaatatttgtgaatctgtttggcaaccttggagaaatgtgaccatatgacaggccttggttggaaatgcatgcctttacaaacaatttcagcttcctttaaataaccaaactttgtatgacagatttgctagctaagtacttgagtatctatcataccgtatgtctggcaaccttggaggaatgtgcgccatacgacagcacttggttggaatggcatgcctctaatcacaacctcagcttccttcaaatgaccacacttgcatagcatgtccaccacacaaatgtaatgctccatctcaggctcgattgaatattcagacttcatatgtctgaatatattcattccttcatgcaccagtccaccatgcctacaagctgaaaggactgctgtaattgctaccttgtcaggtttgaagccatcctcttccatggctttaaaccatgccagggccttacgagaaaaaccattaagtgcaaggccagaaattatagctgtccaggagataatgttcctatcttccatttccttaaaggctttcagacattcttcaattctaccgcacttagcatacatatctagcaacatattatgaacataagtatctaagcaaccagaattggtcttgatgataagcccatgaagcaacctaccaagaacaaggctattagactttgtacaaatgcttagcaggctcacagatacatagctatcaaaatgatgccccaaaattctcatcagttcgaaaaatttaagagcttcagcataatcaccattccttgcacaagcagtgataagtatgctccatgaaacagtgtcattacatccctgatgtaaaagtagcttcttcgcttcgtcatacatgcggactctgttatataccccagctaaaacattcatggagacagcacaggagtcaggatctaacatacccccataagccaaagcatcagaaaccatttcatgtgaagcatatgaagatataatggcacttgagacatagtcatagccgtcgtaacccaatcttgttaccaacgagtgaatctgcaacagatcgaatactgatgggtccttgagcaaagaagacaaactaacctcgtttggcataacaccagatcgcaacatctctctcagaataaaaaacgacgttggaacatcagtatctgagtgacaagaaatcagtccattccaacgtgtggtgctatcctcaggagcttcttcaagaactttgtgagcatccttcgtacaaccacattttgaatagaaatcaaacagtgaagtgttcacaaatggtctcgtattgagattgtgtttgataacttttgcatgaatggacttcccatgttcatgtccatttatactggtgcaggcataaattacactgctaaatgttatttcattgggcaaaacactccaaccttccatcatccagaaaaattcaagggctctctgaggcaagcttctcctagcgaaggcaatgatcattgtattccaagaaaccacgtctctgaacatgaactcactaaacagattctctgccaaagacgtggaactgtgagtacagtatgaattcagcaatgagtttgcaactgttgagaaggaatctatcgcaattttcttcacaagcccatgaacttgctctggtgtgccaaaagcaggaagtactgccacaagagagccatcagacacgctgttaccgcttcgaaccagcgccctgaaccagatcacagcatcgcaggcacgtccatgctgcgcaaacgaagagatgagacagttccaggtgacgacgctccgcacaggcatttcgccgaacaacctgagtgcatcatcaaaccggccattccgcccaaagaaccccaccagcgatgtcccggagtaggggtcgctgtggagcagcccgctcttgaggatgtgagggtgcagctgcgccgcgcagcgggcgccggccgaaggcgaggagaggatcggcgcgaaggtgaacgccgtcggggcgacgcccgcggcgagcatgcgcgcgaggagcgcaaagccctcggcggcgcggccggcgcgggcgcgggacgcgatgagggagttgaagagggaagcggagggcggcgcgctcggactcgggctcggcattccgtcgagcgggtgccgggtgcggcatgggggggacagcggcgtgtcactcctggcgcgccggcgaaggccaaaggcgtgccgtcacgggcacgagatgctcgcggtgcgcacagctaatcgcgcgccccggcgaccggcggcgccgcagcaggcggggcggcgtcgaggcggcgcgtggcagcagcggcagaagaggggaaggaagaatcgcaaacgagcgcgcggcgacgttgcgatgggctcctcaccggggggtatctgcccgagcgcgcttgcagttgggctggtttgggccggaaatacgcgtggcggtgcatcgggccgaaactgcaaggaaagcgcgcgacggcttccgctgagcaggctgtgcgtcatgatagaccgggccagttttcctgcaatttgcaacataaaaaacgtttttttttttgcattgcatatctgatgatatttgcatattttctctttatctgtcaccatattgcgcagagcattttaaatgatcttcagtatcttcgtcatatccgggttagcattttaatcgatcatcagtatctcgaattcttggacatatgtaccacatgcagacttagtgtactataaaatgccgccctggataatatagggccggttcactttgatgaaaaaaaaccttaccaaattttggcattaccaaaaattttagtatagttgccaaaattttggcaacgtgccaaattttggcaggatttcttatataattactaaaatttggcagcaaactaaatatagccatttttttggaaactttatcgaaatttggtaaggttaaaaatggtatcaaagtgaacgcctatagtatagctagctaggcggggtctagatcccctagagttggctacaactctatcaggtggagttgccatgatttgtgccattccgtgtacctcaacggctaagattaagccatgttaacattaatatatacttaaaacaagtaattaaccgtgcaacaaataaacttgcatcaacaacatgtcacaggattttttttttactatagaattgtagaattaatacaagaatttcatacttcatctattttattaaaaaattatacatattaatattgatatggttcgctgttgcatatatatgaaaacactgtgttggtatatactgttgcttagagttgatcgactgtacgtggttattaagaacaaaaagtttttcacttaattttttgttgagaacataatcaaaatagaggaagcgcgcgttgaaaaaactaatttttctctcaagctataaccattaatgttgaggagttaatttattaggtaaatttgatgaggcatgatctcagccgtaggaaacagtggatggtatagatttggccaactctacttggtagagttatacccaactccaagggatccagagcagggtgtggatccctcggagttgccttcaaatctatataagtgtaccaaacatccctgaactgaccgatccatgaactgaccgatatatagcccatccatgaactgaccgatcgatcgatctccttttgcttgatatatatatactaagtgttcttttggccgacatggaaggtacagggcggcggccggccgcggcaatgttggaatcgttagcggtaggtaccagttgataaggcattggcgtttctcctcatgcatatgcaatgcatctgctgcgttggaccatgatcatgtctgacttggatcattagcattagctaactatactagaatatcaataacatgctagccagagtattgattaattactagtatctttaatttctggtggccggcagaccgatcgaggcctactgcctgcatattgccggtgtggcggtgcatgccttgcttatcttctcttgacagtaagcattctggcctgtgcctgcaccgaccttttctcaaactaataccatggacgatttgagtttaaaggtttctctccaagaatctttgtgcaatgaaggatttaattgtctccctcattttaggaaaaaaaaagcgtgtcatcccatttaaattacaattgcaaaatttagctgaaagattattcaatcttgagctgaaagttaaatcaattgtgtgatcctttaattggaaatgacaaacttttaattgaaatcctgacatgagaatcgttagtggagcctccgggagcccggagtggtcgagtggagcgtggtttcatgaatatttccagtacaatgcactgaatctgaattgctcgatcactacaatggaaaaattctaattgcgcactcatcttgaattgctcgatccaaccaccatatctcagcgaaaaattaagagagaaacataaaaaggcaagaccaaattaaaccggattagtatacacacgcgcaccagccgctaatgagattaatggagattgaaaataagaaacaagaaagccaatcgcttcgacgatttgcagaatagctagctagtgaccgaagctctggctagcacacgtcatataatattcagtcgaccgtcaacctctagtctagtagtattacgctttctgaaccctgaagaggcaaaactaaacgtaccctacctgtattttaattacaccatcctaaccggccaacccaacaaccgctcgatgaacctgttcgtcgataggctgcgtctgataccaaggccccatcgaaaagcatatgaaactatgaacagagcagaaaattaaaaggtttagccgtgacgtacggcagctcgatccatcgagcacaatcgatttaatttggtttaagacctgaaaaaaatagttaaagcaatgcaacttgtgtagataccagcaattttctgacgatggcatatcatatccaaaaagttcttgggtcttttaatcgcaaagggttttttttaaggcatggactagcttttgatctctctgattaccctattcgttaagaacctatagaatgagaagatcgtgacaaggcacgtcgcaagcaatgacaaaaatgaaaagttgcatgcttacctcgatcggtagataggagaagagcagactaattaaagagttaatgctcttttccttgattgaaaacaagaaactaattaatgcttgagtgactgttgtcagagcagtgtgagtccagagctacctttttttttcctccgttattcttggcatcggtcgaggtctttctttttagacctactgcgataatcgtctgtcgagtcttgcaaggccacacgtacggagatgagcttttcatttcacgttttactggatgatacttataatacgacgttgctacaagaatttacatgaagcattaattgttagatatagatgataaactttgggtgtgtttgaggaggagaggattgagtgattgggaagatacgcaaaacgaagtgagccattagctcatgattaattaattattaactattttaaattttaaaaatggattaatgtgattttttaaaagaactttcctatagaaaatttttgcaaaaaacgcaccgtttagtagtttgggaagcgtgcacgcggaaaacgacgtgctttcttcctcaaactcactggaacgaacgctgcctttgtaatgatgacatcatgatgaataactttaatcactttgttgaattttgtaaatcgcagttctgttctcgagcccaaagagtgaactctttaatggggtggccttggtaatacgacgttgctactaaattttatactagaaaacgtgataccttccggtattttttgaatgatggtaaaattaccccctgaagaatacgtaacaaaaaaaaaaaactagaggacgtatgcacacgaacatggagactcgtcctaagctgtgcctgtgggcttgggtgaactgagcacttcccggtttttggcctggttagccaagatcaatcaacaatttattgtaggcttttagacattgtgtgtaaccatcctagttttattaaaaaaatatgtagtaagtattatttattttgttatgacttacttttgtcagtgaaggtatttcaagcattcatatcatatttctcacatttatacaaaacttcaaataaaatgaataatcaaacgcgacatcaagtttaaaagacaatagcaccatatatttaaaacagatgtagtatttgttgtcagtagaaagtacatttagtgatttactcaagcgtatatattggactgctggtcactagctaaaacttgagaagttatctggagttactcaacgatttgatgagctgctggggtacgaagagccgggtcttccagctagcttcataaggtggtgagcgatatgtattcgaagcctcaccccttctaattatttgtataataggccatttcctaatattcacgtctttatttgatgaaccgctgtacgcctgtacctagtgctccattgactagtgccatgtcaatgtttccttctgaaaagttcatcactaagaaatacattcacgttatggtcaagcatgcagcaatattataggctcatcattgatgccgattttctatgcacatatggggccgcgatatatatgcgcagaacggtgcctttcggccttacagctatacagcacataactaaagttggcagcaggtgcatcccttcgtacacagccgaagtctgaagctgcgtgtataaattgcttcctatactttattaatttgcttattaatgtgtcgggttgtttagttcactacttcactttatcaagccacatcttaatcatattataattattagataggtatttatttcgcggccacaacttagatttaccatactttcttatactttaaactcctaaatcatttattttttttcgaaccataccacacttgtgacataataattcatggacataattttttctaccatgatcacactttagctaaggttagctgtcgcaaaattagtcaccaaccaaacaacccctcctttcacatgacacaggaatatagtgttgtacgttcattttcaatgtatacagtcaatgcatgttaattgtgtcattgttagctcggatatatatatcgttgacgaatgattatatttagctgcttcaatttgcagcccaatttaaactctagcactgtccttttaagttggtttcttgagaaaagcttgtacgagtacatactccactgaccgaccgctgatcttattgatctatatgatggtacgtacagagcggatccgatcaatgttactaaaactaagcttgtgcgctttgtcgagtagatttgtactagaaatagaaaatcaaagtgaaatcactatattaattattcccttccgatggtgtttcacaggtatgcatgcatatgcatcgaaatgaactcgtctatattgtccatctatctgacaacatacagtgcagaacgattaattagtcgagttctacagttctacactacacatggtctgatcatggacaagaacacatgccgtacaaagcgaaaaacagaaacaaatcaagacgaagaaacagaagtggtaaacaaaattaaccgcaagatcgaacactgaaacatgcagcactgggcgatcgacgaccatacaaaaaaaaacctccttaatttgtgttgatgcagacgaggcgacgactacctacgactgagagagatcaatggtgctggggatccggccctccggggctaagccgcttggactcgtgcgccgccgcgccgccgacgacgacgaccgcgccgccgccgctcctccgccctgcagcctcgccggccgccgcggcgggcaccttcatcatgccggccacgcctgcgcggccggcgacaacggccgcctcctccggcgcccgttctctcaaagccctggccgaggccgagcgcgccacggcagaaagcatcaagatggcgcagaaagcgaacacggccaggtacgtacgtgccgccatgtcgcctgctgagatggcctctttttgggaggaaattaaagctgatggattctagctagctggggctcgagacttgggtttgggacaaagctagttctacgtacaggtcgatcgttaggttgaaggtgatgatgggtttgtgtggagctacacatctaggcctgcatcgtcttatatagcctatagaaccttgtggcgtccacgtaagatagatatgatgcgtgtgtagctataagctagtaacggacatgatctctacagtcgagggcaagctgactaagaaaccatgcaaattaagacaaaagtatgttaactttgccacctcttctaaatgctcagccactaattagagagagagagagagagagaggctacaacgaattgtcttctcggtttattaggggcggcggccaaagtgtattccgactatgataatagctatacgcagggtatgcacgcataaagctaaatatatccgtgtgtttttaggtaagcacgtatttatgcatggatcaaaaaatactccctccatcctaaattgatcatcatatatacttatacaccaagaccaatgataatttaaatgacatcaatcaatacaccatgcacacacattctccaataatgcatgtatcaattaaaaaaccatgtcaattacacctcattactaccaaatctatatttcatggcagccattttgggtttttactggcggtatttggagccgccacaaagcaaaggccaatgaagatgaagcatctgcgctggcggcgaaaaaccgctagagaagttcatttttcactggcggtctatgtaaggcagccgccagcgaaaactgacttatgtggactgctagcgaaaacatatttttgctagcggttcctcatttttactggcagtggatggccaccaacaaaaatttggtttcactggcggcaggtaatgagacccgccagcgaaaataatttggaagaaaaataatcaaaacggaaccgcaaccctagccagccgtctgcaataaaaattacaccaaaaatatccccaaaatcagattttcgcagcgtgtacatattcaaatccacttccaaattttcgagcatcgattcaaatcctcatccagagttcacagcatacaagcattttgaacatggaagtgaacacagcatacaagcattttgaacatgaaaaaaagaaaaagaaaaacagcaacaacagaagagaggaaggaggccgtcgtcgccgtcaccgaccgagcagcaccggttgtgcgagccccgtcgccgagcatcaccgccgctgagctcttctgctgtaccaagccccgatctaggaagccgggctcaccagcgaaaccgtgggagggggaagggttgggggagggggaggaggaggagctcgccatgccctctgtcaccgttgtcgtcccgtcgccgtgcccccgcttcccatcgcagtcgtcaccgcgccccccgtcgtcgtcgcgccccaaaacagctcctcccgtcgccgtcactgcacccccacctcccgttgcagtcgccgtcgcgccccacgactcctcctcccgtcgccatcgccgcggcccccgacgaccgccttccgtcaccgccgcgcacggttgcctcccttcgccgtcaccgccaccacccgagaaccgtcggcagagccgccgccgatgccgcctggaggagaggacgccgacgcctaggaggagtggatctgtggaggtgaggaggagaggagaggatttgaatctggatctggatctggtgctgagaggagaggaagatatttttattgtgaagaggtgtgtgggattttagactatttgccattcccttagatgtagcattcccaaatgccatcttcccaaataacttagacaatttgcccaggtccccacaaatcagctctcctctgccattttacacccaatttcgggtcccatggctgccacatcaccaaccaaggtggcactgagagcgtgaaatgtctatcttgcccctgcctcttctcaactgttatgttttaacataaaaattacacaaattgccactgacactaaaattgaacaactgctctcataggagcactgttaagacatcccagtcactctaatccctcgttcataccatcccaacccaaattgcacaatctgacaaaatatatcagccacattgcaccataataacaagtatataacgcaattcaacggaacatttcttagaactaaaatagtataggcttcaaatattgttttctgcatttctacatagcacgtctagtagcaagcatggctggccttaacattggtctttgctgccattaaatacataaataaccccatctttcttgagtccagtttcatgtaacaaaagcaaaaaggcaacatcagttctgttttttctttggagtcaatttcttcttggttggtggtagtggctgtgatggtgttgcttcagtcatagccaagcgcctccttgtcactggtccaggtgaatcttgtgagcatccttctctagcaatagttggtgttccagttgtccttgtttgactaagaaaaaaagatgttagttatgcagtcatcacaataatgatcatgtaattaaaaagaagcaaggtctcttttatatcctaacctcctagtgactcgagcagggctatcaactaattgaactctagcaacctttgatcttgttggagtttcaacaatttccttagcagttttctttttcctagcttttgtagcaatattctttgccttcctcttcctaaaaaaacacaagtagaacacaagttgaagacagtgaataaagataggacaagttaacaagttaagaaaggaaaggaatgaataattgaagcaagttaagacaatatagaacaagttaacatgttagaattattacctctttttggtcccattaagaggacacttttggctgctctgtctatgccctagcccaccacatcttgggcatttcacctgccttctgatctttcctttccccttctcaagacaagaaggaatcatgtttttcctttgcctaggaacagttctaggcttgggcactggtggctgcaacttaaaatctttgttcgctgttggccattgggacttgtcagttatgcaggggatgacaccttcatatgcagccctaaagcaactaacagagaaaacgggatcaacaaaatcatccatgattggattcctttgtttggagatagctgcaagagcatgagagaatggcttccctgttaactgccactccctacatgtgcatttctgttggtcaagatacacaacatgcctatagacttcaacactattatggagctcagtcacttcagctgtatcatccgctcccttcatgactctcatgttggctaaacctctagttgctgcctttagttgtgtgacaattgcaggtaaaatgtttctgccttctagtttttctccaatcttccttctcttagcccacaaggctgctgtcttctctctgattgcatctgctagggcatcaacttgcagttccttgaattctttgatccatgcattccatgactcagccacattattagtgatgaagtcacatttgatctttggtgagaacttgctccttgcccacagaattttatgatgtttgtataaccaatcaccaacatcaggatcagctgataggggtgcaggaat

SEQ ID NO: 37542 - DNA, 7588 bp, Oryza sativa
ccactttactgtgcttcaatgtccttacaaggacagccatgtgactatgcacgacgatattatgtggtgaaagtgaaacatccaccaaccctaccctatccaccatcccaccatggagagcctcatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacgcgtttgcaggacactggctcactggtttctgctgctgtgctgttcggcctggatccaagtttactactacgccacatttcattttgactttcatgcaacttcgtccttgcatagaggttcataatacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgaatcatagaaaaggaataattttataaaggtatatacatgcagactaaactcaaaggcaagtaaggaagggggatgtgtattaagcaggtataaatatttttatccaattaatgtacttaaaagaagtggttacactggtcactgcaaaaaactacattcccaggaaagctttggcacaagtggcagtataactggtcagtttttggctgttcagacttcagtaacaggacaggtttggataattgggctgtgtctagttcagcgcaaaatttggattttgattgaaattgaagatgatgtgactgaaaagttgggtgtgtatgacaagttgatgtgatggaaaaggactaaagtttggatccaaactttggatctaaacacagccttggtaaatgttatctcagctatcaagggccaaggctccttcctactttctaggacctttactttgcaggtatactgaaccatatgctctacaaaaagagaaaaaaaaataaaggggggggggctatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccaaccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagaagcaggcccaggcacagccccagcaatgcgagcctcctcgccgaatctccctccatctcctcctcctagccgcctcgagctctcgcctcctccttcccccctcgccgaggaagaaaaacagtggatagagtgagcctaagtgcagtgtgtgtgcaactgaccgagagagcgagccgagccagacctactctcactgggctggaggcagctctctgctcacgccctgctttttatgggatggcgattcccttttcctttggcactttgctggccacccccattattctatttttctcgcaggcgtggggtctgaaaggaaaggaaggaggagcagtgaccactggatggtgagaatggcgtcgatggtcaataaaatactctagaggtcaccctgctgccttttgcttttttcgcagcgttttggtagcactttgtcgagcaccaaaaaaaggcgccgctgcccacacgattgtagtacagtagaacttgcatgtgggtctgtttagtttatgctaaaattaaaagtttagttgaaattgaaacgatgtgatgaaaaagtttaaagtttatatgtataaaaaagttttgatgtgataaaaaaatttaaaaaggcctgtgtagtgcagttgcgttttgcccgcagtccctcaccagtcagggaagtcacgaggcaatgtggctgcgaagagcatcagatatttctttttttctaccagtaatatgctcatccgtgaatgtacgacaaacaccgggacaggatagaagcatgctacctctatctcgagatataactatttttagcacagtaatttatcttaaaatgaagccgtttttctacctaccctctcctatcaaccaattataactattctcttcacttactttatctaatccactaattacaaccctccttcaatcatctatacctattccatctgttccaaaatataaatatttatgttcagatttataaccaaaaattattatattttagaaagaaggtagtactttttaatatctgtgtctatcttaaaaatgattatattttaggactccagtgattactgattagcgatgaatgtacaggtacggagccacgggcacacagtgtctgttgtttgagacaagcatcaatggtaaagatagcgccagaatattgtttgtttacatttggtatcaccaatgtatatttacagaccagtaaataaggtagacccaacaaaaataaacatctttaaaagttccataatatctagccacaatgataatataaagtttaacaacaaccagtagcatgaagggagagagtgaagatcaatacatagcaaaaaaaaaaaaacaatgtcttttttatttcttacaaccgggttgtagtgctgagagctatttactgagtccacaatacttactactggtaggaatattaaattattgcttattacctgatttgggagcacaatgtggatgttctttaccaacctgaagagaaattgggtgtgcttaatgtataacagaagttggtcttaaggtgggtcccactataatatattgtcaccttcacaatgtaagagcggttattaaagtgagcccctcatttcaagatagagagcaaagtatgagcggaaagagatgaatgatatatttgtttattcctttatgtctaaaccttatgcacaatgctagctcataaaaatgggcaagctcaagtttgtggtgtggatgtatgttgtaaccttaggagtcggtccatgaataatggatcatagttaaagtaatcatgtctaggatttaaacacaagatgaccacatgagatgaaaaaaagaactgcttcggctcttgtccatcaggtgaataagagagaaatactttctttttgcttgtggtagattttaagcacaagatgcaccttaagttaatgttaatttacatgatgtatgtgattactttttaagtgtaatcattgttttaagatcactttcaaaatatactcctaagggtatcttagaggacttagtactctttctatttttacattgtgccttaatcctaaagcagtttcagagtccattctgttttgtttcctttatatacgcaccgtttctgggtacatatgattgtggagcacaatgaacggaagggaattcggcgacggctcaagtgagattgtacccgcgtatgctctcactttaggtaggtggttgcagacagagcggctcaaaacctcaacgtctgccaaagtgagacccaattgagtaaacaagtgagcatgccggcgatacgggtttctataatccaaagtgtgttatccactatgctggtcagtggccagtggccactttcttctatgggcttcccggccttactgagaccatgtttgggtcattaagtttctggattaaaattagtatccggacaaaaaaaaatagtccgatccatagactaaaaaaattcaaaaaaatttcaaataagatgtacggtcaaagttgagcacggaaaaccatgactgtacttaaaatgggatggagagagtcccctaatataagtgattttgatttttttacttgcattatttaaccattagtcttattaaaaaaattagaattattatttattttttacttacttttttatccaaagtattttaagcacaatttttcgttttttatatttgcataattttttttaataagatgagtggacaaaaccaaaaaaaaaagatgagtggagaaacagtgtaagtaaaatgttaaaatatcttatattataggatggaggaagtaaaatggactaaaatagagggactaatggattaagacccacgaagcaaacagggtctgaatcttcggattaataaagtactgatcgtgtttgtctttgaggggctcgagcagtcgagtagcgttcacttttgggtgcgcaccatgacacgctgctaaccgacagtgaaattcagatatcgaagtgagggtgtgggacgaccgggcggggtggaacgctgctgcacagtgcacacagacacacacagctacacaccgacacattttctcggcgctcacattttcacagcggtcggtcaaacttggtcagtactacttcgcgtagagaacgcgtcgtcgattccacatttctactctactgagccaggcagatgatgcaaaatgccgtattaaatcaatcgcaagtcagcagatccgagcagtgaagttggtttatttgtgtggaccaacctatgcgtgtacatcatgctgtgcaggatacaagatatcatacactatcgaggatctcaggacacaccgtaggaaaaaaaaacttactcctggttccagtaagggcttattcggatcacgggattgtaaaaacgtaggaataggaaaatcgtaggaatatgataggaatgtatgtgtaaaacagaggattgaaaaacacaggaattctgtagataggattggtaaacatgtgttcggataggcaaagaaaaaacataggaaatggaaaaaatgaggtaggagtggatggaaattttcctttgtttctctattgattccacatgaaaggaatttttcctctgatttttctttgggtcgattcctatgaaccgaatgtcaggaaaggaaatatttcctatctacagtattcccttgaaaatcctacaaaaatccctcaatccgaagaggccctaaaatgagtagacttcacgccaatacaaaatgcaaaagggaactagtgttactcctacttcatgccaaattggcaatacaaattacaaaagtactgcaaaggtccagcagggtgagaatgaaagcgcgtaccgtaataaactgttacggtaaaacccaggcgtgattcgtgaaagcgcgatagacaagacaaagctagccggcagaaattcctggtagccgctaccgatgtgcaacgcatggacaaagatggccatgcgtcgagagttggcgtgtaccccatacccctgtacccatacgggccacacacgtaccacgccatgatacttaccatcgcaggcaggcaggcaggcaggtccactcgtgatctgcgacccgagagaccgagccctgtgcagatccaccgtcgtcatccggtggattttctgcaatgccgcgctctctccgaagttacgacgttacgtagtaccacgacgtaccgcggccgcgataaaggatcgccggctggttgggcggggagcctttacgagtggccgggccgacgcacgttgcggcggtgcacgctaccggagaattcggcgctcgtttgcgtcccaattgatttggtcggttttccctgcaccgtttttctgtcgtggtaggtgcccgtaccaccggcagccggagcccaatctgttccaggatcagatcgatcgagccccgagtcccgactagcgtgcggtgcggaactgctccgttgtaatgcttgctgcctctgaaacgaaacaagaccatcctgaaatgatgtgaaatgccccgtcaccttttgcgccaactttgtaggcctttttttttaggtttttctgtggaaaagcagggatttctccggttttcccgacacaaaggtttcttcacttgcaagactacctcctgtctacgcaccggttccagcatactgattctgtctgttccatattgctcactagacaacactactatcagtcgagatggcatatgagcttgttaattaagaagtatacttttgccaaagaaacagaacaccggggtatccttcgacaggggaaaaaaaggaaaagcaaaactcaagtggaacatgatgctgcatctctctggtagttgagatttgagagtcgaattagagcagatacaatagcatgctacaaaccagctgcaaacatattttaagtagataaatgaggagagagaagagcagcgggctacagatttataaccagatgtagcacgaactccaagatacagtgtgtgtatgacaggtgggaccatgtattaatagtgtagtatgtaactattgtatgaatgagctattagattggctatagatgaaattggagctagtagttggctatactattgaacttgctcttagaggacatcaagcgtcgccgatggcgcgggcgctgggcgatgccgcgtcggattgcaatagtgcgcggggtggaatttttgcgaaaaagtccttcgcttttggtgtcattcgatacatgtccttcacgaatagtacttcgagaggatgttttatgtggagacccttataaaaatcggatattttcattcaaaggagagaaaaccgtaaatttggactgccctgtaaaatcataagacgaggggcttttttgcaaaatgacacccactaacactaaccaccccaaaccctagccgccgccgtcccctcatccctctcgtctctctctcacctctctcgctgccgccgccttgctccgcctcccgcttgcgctgccgcctctgcctcccgcttgcgctgcctccacctccgccttcccctcgcgctgccgccgccgccgtcgcgtcagcatctccgagagtctccgcctcgcgccgtcgccatcgccgagcacgagctttgaggcgaacatggagaaagtgaggaggcgagcactcctctcctcttctcctctcgtccctcctctgcatgtcgtcaacctgccgccgtcgtcgctgccgtcatcaacttgcctcgggtttcgtatggggaagaaagagggggaaaggggctgccgacggccgtatgggggagaagctccgctgtaggagggttgctagttgacgcgcgcgcgcgccagctgctccccggcccacaaggcccatcggccttttatttattcacgattttttcccttttttttgattttttcttttttctttttttcttttttttctgattacttttttaaaatctttagcacacgtattttttttttcaaaatgttttgagttgaaagtttttaaatcatatcttgaaaattttcaaatctgatttgaaagttttcaaatatcgagttgaaagttttcgaatctgagttgaaatttttcgaatctcgagtt

SEQ ID NO: 37543 - DNA, 3123 bp, Oryza sativa
gctgtaacccgcttcccctcccctggagcctcgaccattcttctcccactcgtactaatcattcgctgcgagagagagaggaaatcgtgaatttcttcgacttaacgcgacgaaaggaattaaattaccatgactccagtccagagcccacaaacgcgttgtcgcccgcggctacaggcgaaagaaagattgacgcccgttaggcccattagtggctagcgggccgtttaacccttccagaggcctctcactgcggagagtatatagcccgtcttgcaacccacgatgaggactcgagcacgcagtcgcacctcccacccacccgcagccgccggcgagttcgagcggcggccaccgggcgggcggcggggcggcggctcggctcccctgatctccctcccctgcgccgctgcgcggtatggacctccaggatccagccgcggacgccgtcgcggccgagccactcaccgtcgccgagaccgacgaccagccgccgccgccagcgccgcctctggaggcggagggtgttgtcgtcgcggaggaagacccgctgccgcatccgccccttgaggtggtggaggaggatgtggcccccgtcgtcgcagaagccggcgccgctgccgtacctatggagccctccgaggctggcgcgggtggtgtcgtgctcaccgacgagctctgcgaccggatcgtcaaacaggtacaccagtttccggtccttccctctgttggctatcagatgttctgttgtatgctcctgcaaagacgacggattttttgagatgttgtgctatccatacgtcaaacgttccatccttgcaggtggagtactacttcagcgatgagaatcttcctacggatgagttcctgattaaattcgtgaagaagaacaagcaggggtttggtaagtggcatgcttttgcttcatgtagcgaaacctctatatattgtgatgctaagtttagatggtttagtctggtagtttagaaacatatgtatttgagacaggagccatgccaagtgtgtagtatcttttctccccattttgaactgcttgtgatgcgccctattattatttgcctgtattattttgccaccgagataattgtacttaggtttatgacaggtttgcttttcgcataaattgcattctagaagtctagaaatagatgtggtaattggtcagtaatatgtatatgattcaagttctgaaagctcttttatatcccttctctctctcttttattctatcctccgtgagacaaggtgtgactcttctagctcctatgtttctgcattattttgccttgtcgatcatacattagtggaatggaggtgaaaatgatgaaatatgacaggtacttatgagaggcatttacataggtactcctggtgcagctttctttagttgtgccgagaagctagtttaggcctctgtgaatactggtttactgttgtctgattcactccattctgttttgaaattataatcagggggactttttaattaataaaccatgggggctggctatttacttatttttgttgtttctctcttttcatggtttctgtagtcagttagatttcctcacatttagtttgactgtcgggccatgaggatacatgaaacttgatcccattaccgatgttgtctggtattcttccatggtagctgagtcaagctgttgcagtgggaactgatatgctccttactcatctgagctgcccctttttatttgagcttcacaattaaagtaggatggattagttttgaactctttgattgatcatttacagcaatagtttgctgccctcattcatagattgggacaagagctgcaatcgttttgcgagacatggaccttttttttttctttttagcagcctgatgttctgtatgtatcatatgcgctggattttgtacatgcttgggaagtagcttgtaaacaatgatccatgtagcactacttattgcatgacaactcagtggcatggtgtggaattatacttttaccttttgttgattttcaggtattaaattctttctgaatttctaggctgtaactggtatatcataagtgactcgttagatatagggtactcttctgtcatgaatcactaaatatatttacattaggtcgggtgaattaagtgttgcttagcgagtttatagtgctcaagtctatatggattgatgttcattagggttaactttcatcaaatattatgtattatatgaagtaaaatctcaaaggttcttctaattatgtgctatctttggtaatagttcctattggagttattgcctcattcagaagaatgaagaaactcagtcaggatctctctataattgaagctgcacttaggacatcatctaagctggtaatatattgcccatttattatctatgctttggaagtggtgcttttggtcagtgggagatagatatggttgctatgttaatagttataatttaaatgtatatcactatatgctgttattttgttcttaactttcaggtcgtgagtccagatgggaaaagggtcaggaggttacatccattgccaaataatgaattgaatgatgttaaggtcaatttccagcccactccttgctgaaatgcattatttatatgtattgtggaatatctgtgttctaagttttaactttaacttgcacgcagaaaaggatagtcgtggtggaaaatctgccttctgatttctccatggaaagcatacatgcgaaatttgaaacagttgggaagtatgttgtttgcttgtgtttgtgatgctatattgttctgaggacacttaatgattgatgctcataatatattgttttggaactgtactttatcttcatatgtgccagaattgcgaagataaccattcatgatcaacattcagtgggagaatctgcaacaattaagaaccatgacatcatgctaagtaacaaggtgtgtatcagttattactcagcgacattttcttaaaagatcttatagatacccaaactacacccttttgattttactacctactgattgtagtcataggttcgtaatcgataaaataagtattgtagccatgggttatttctgattgaccccccatacaaactacc

SEQ ID NO: 37544 - DNA, 7110 bp, Oryza sativa
tatttgataaatttagtcatctctagttgcttttacgtctcctgaataaaattggatatatcctttccttcacccagtattcaagttggtaataggtcagggttgtgcaggtgcatgctcttgttgaatatgaaacagcagaggcagctgagaaagctgtgagttcccttatctcacatttaatggcccatttgattcccagcgtatgaatacatcttaaagattgttgtttatgtgtgatcaaattaggctatcaccttaaacgatgggagcaattggaggactggaatgaaagtcaggctggctaagcgaaccgtaggatcaggaaagcataaccagtcttcaaaagaaaatcaggccatccagggccagccttcaaaagtagagcagcagatggtatcagaaaagaatggtggtactgattcagtggagagtgctttcgacaatgagaatgtgaactctaatatttcccatgaggtttgatttatttcatacacctattgttttttttcaattatccacttggcacaattatgtttcactttctcttacgtccatcttcaccctttgcattcccttactgaactgcacacatgatacaagcatgaagttcaaatgtattattctatttagttttttttttcatatttagatgctatgatcaggaggttgtgtcattgttctgcaagtgtctttgctcataggtcatttgtgcatatctttaggacatgcaccaacaccaaaaagtaaatgctaaaggaggacgaaaaggtcgatataaatctcaaggaagaggtcagattcagcaaaatacaagtgggcaaggtaaactgtttacactattttgaccctactaaatttgtagattatttgggtgatacattttatgccactgagtttcatccaatatccacaatatcagtttgttttgcactgagtgaaatgtttctcagatgaactccatttgcacatacaacttaagttaattcccatgtctgtgcatgatggaggcaggaggcttcatggtcaacatgttactctgcttctttatggaaaaaaactgaacaatatttattatcttaggcaactaataccattgtacacatctcctcacctagttttttgcgcaatgatatccttgttcatttccaaagctaagtctgttttcatcttgatgacagtaggttcaccagacttacattgatgtaactagtttttttttccctacgggtatcttttaacaagagctgaagaattcaatcctgacagttcttgctgtaaacacttgatattccaaatgaacacgcagaaggaaatcaagatcgatttgtagttctctagttttgtactaatgaaaaatcaaatacctgtgattatttctccacatatgtattttttaactctatctggaatatgcatactgatgatttttcatatcaggccatgtctcatcccctgccacttctggttctgatcatgtgaacaagcctattcctggaccgagaatgccggatgggacaaggggctttacaatggggcgtggtaaatctcctacattccagaaaggggataatgctgaagaatagtgcttttgtcccaaaaagcctggtaacaatctaaccgcgtgaaaaacataattctgctgttatgctataagctgtcttgcttcgtgtaagaacgtagggacatgtcactgatatagaaaaggctcttattttttatgtagtgtcttttctgaattaactggtgctttagtaggtctggtaaaaatttaacctcatgaaaaacatagtactgctgttatgctataagctgtcttgcttcgtgtaagaacgtagggacatgtcactgatatagaaaaggctcttattttttatgtagtgtcttttctgaattaactggtgctttagtaggtctggtaaaaatttaacctcatgaaaaacatagtactgctgttatgctattgttctctgagtataagaacatcggcacacgacgtttacagaaaaggtcgtagtgtattttgtgaattcaattttcgaaattacttcagctgactagtaaggttttaccgccaattgtgaagccgttgttccgtcattatttctgatgttctaggttttggctaccatcttgtcctgattaatacgaaaactggatagaatattagagcaagaaatagatgcttgaagtgtatgtttaaactatttaggatgcacaaagggtaaacaataaacagatcgagatccgaaacgctttcagtggacttgaggcttgatttttggagcatactgtgcaccgtgttgatatctcctggtgaatgttcctctgaactctgaagtgaggagccagtagttacagtctagcttgtatatgtaaggttaatcggctgccgaacaggcagaaaactaaacagtcagcgcttgttcagttgatccctctcccatggggattgaaggaattaatctctcagttctcttcaatcccctttctcacggagattaaccgagcaagtccttatgggggctgtagtaccatatcttcgaagtcttggtctccagtctccagtctccagtcaattgagctgtgctgtcccggtccagtggtgctgtgctgttacttttaataggtgcattgctgtgggaatttattataaaaacaataaaaaaaataacatgtaagatagctagataacatcagattaagtaaattaatacggtttatgataatttagatttaaatagtatgtagaatggtgattcaaacgtaaaaagtaaggtggtataactttatggaagaagaaaaatagggagatagtttggactatagattaatcatctaaaagctaaaaacaattgatgtgatatgacttaattagaggaaaaaagagaaagataatttgcaccatagattaatcatttaagcactaagtgaggatgaactatatatttatataggatattataaaacataataaaaatatacattgaaacattatgtgaattatgttggatgataatttaacatgtttgtatttgaaaagctcttaaattataaaaactataaagatatagcatgttttcatgatgtttaaatgtgatgattgttagtggatgatgagtaacatcttgttaattagtggatgatgatgtggcatcttgttagtggatgatgatatggtatctttgcatgttaagtttaaggtattagtggggataactttatagtaagataggatgtgttaaggaatcatctagggacatgtgcctatccgacaagtgaatggagctcccgagggtgtgtttagtttgcgaaaagaaaatttttgggtgttgcatcgaacgtttgatcggatgtcagaagaggtttttggacacgaatgaaaaaactattttcataactcgtctggaaaccacgagacaatttattaagcctaattaatctgttattagtacatctaggttactgtagtacttatagctaattatggactaattaggcttaaaagattcgtctcgcgacttgaatgcaaaatgtgtaattagttttttatctgtatttaatgctctatgtatgtgtcaaagattcgatgtgatgttttggggcaaaaattctaggaactaaacataccctgagtaagaatgaacaggtcagatccgctgaaacaagcctcattttcatgaccagactagtgtcgcagcgattttactgcgatctgtcaccaacttaatacgatgttggatctcggttcctattcagaattgggattccatgagggccactcaggcaggaacaaagcacttgtgatgcctgcgcgcaggcaggagcagaagcaggaccaatccactcattggttccgcagcggcgtagccatgcgctccaaccatgtgacaacgacacgaggcgtcgcgggcggcatgcatgcgtgttcggttcatggccagaggaaaccaagccggtctctcggatacgtatccggccgaaagagtcggccaaagcccgtggtttggctacggcgctgcgccatctcacgcacatcgtgcagaacggtgggcgaatcgtggcggcacggatgcccgggcgccgttcgcctcgcctggtttacgaagcagtgaccggcatgcagatgaaaggggccctgccggctgcgtgctggcggcggcgatcgaacctgaggttttttgcccaagcggaccgtatccaaaccgccgtcacgcgggcaaggcccaagcaagccatgtgctccaccaggccatattcctctggtgacggcaacctcgctgcgtaggccggtaggcgtagatatgccgatcgactaccgtgcaactgtcgccggcgagttggcgaggtagggctgtacttacggtgaagtaacgtacactggtcggatcgtgtccccatataacaggagattgcagcctgctctctgcaatctacagtttctcgtctgcactcctgttggaaggtacttaagagcaatgctacacgtactatatttttcttactaaacttttactaacaataatctcaaccgtttgatttaagtagatggaagttaaaaaaatctagatgcactcatagcatgacacatcagtgttagtaagaatttagtaagaaaaagtcagtatgtatagcttttataggtgtaaagttttagcgtgtcagatcagatatacggacaccacctaattacagaatccgttaataaactgcgaaacgaatttattaagtctaattaatccatcattagcaaatgtttactgtagcaccacattatcaaatcatagagcaattaggctcaaaagatgtctcgcaaattagtcacaatctgtgtaattagttatttttagcatacatttaatacttcatacaggtgtttaaacgcttgatgtgactgggtgtaaaatttttgtgtgggatctaaatagggccacaatctctcccttcctggctcctaagctaggtgtaattttacgttgctcttcgaaatagcgggcatttgatagcagagaggttgagaatggaaagagcggagtcaaagaggcaccatgatactactctctccgtttttatgtttttggtttgtgctaggttaaatattttcaaatttaactagatttatataaaaaatataacaatatttttaacatcaaacaattattactctcaccatcttcgagtttgaccaaatttaaaaaataacgtagcaatatttataaatattaaatatatactataaaagtatatttaatggtggatttaataaaattaatttgatattataaatgttgctacattcttttacgtgattcataaatataaataagtttaacttagaataaaatcaaaatatcttgaaacttaaaccgaaggaacacaagtgaggaggatgagaggtgagaatatgttgtttgagaaatggtatatgtatatatgtatcacaagtacccccgtctcataagatattaaattactataaatctgaacatacgagtatcttatatttgtatctatcttttttttatagagtagtacgtttgatcaagagtgaccatacagtttgactgaaattcccttaagagttttcatttgactagtgtacagacagtccaataaaaatatagttttataccgcttacactgccgtccaaaaatatagttttgactagtatacgcagccagcagagaataccgtcacatgccatgctcaggttgacccagctgttgtcagtgtgtcctatggtggactggtcgctggaagtgtggagcatatagactgttccctcttttttaccatcggttttgctaccgttccacttccacctcctcctccttttttcttttacagaacaaaatcaggcacaccgcacacgagatactacaaatatatcctcaggggtgtcgtaggtgctgagaaaagcggcgccactggacactggagtgagttggagtctcgtgcagaggctatgcacctgtgcggccggctgtgcgatggatatggaccgaatctcgtcacgacgtcttcaagggctgcacccaagcgtcgctagcttggctttgccacacacattagtgttgaacaggcaggccttcggagctagcaggcacctaccgcgtaccgcgtccccttatctgctttggacgctgctactgcacaaacttggtgagaggaacgtctcgtcaattcgtcatagtggtaccatgtttaatttgtgccacacagtaattcatatttttgctctattcccgtcactgcatccgttctactaatagtactcctactcactacatccgttataccgttccaataataagattgctcatttcaagatttattgtattagattatatcaaatacaatattaagttggtttttattagaacggagggagtactaagtagcactcctacagttctacttcttttgttaaaaaaaactcaatctaagtatttaattggatataggttcattgtactaactaataagggtgtgtttagttcacgctaaaattagaagttcggttgaaattggaacggtgtgacggaaaagttgaaagtttgtatgtgtaggaaagtttgtttgtgtgtgtagaaaagttttgatgtgatagaaaagttgaaagtttaaagaaaaagtctgtaactaaactcggcctaagtctaatccaatactatatatgttggacttttttaaggagccagtatatgctaatttgattgttcatggtgacagctggagcactgggtgaaatgattatatcgagggtttgctcgcgcgaaaagcaatccacaattcgatcggggcaaagcggcagcactaacccatcaatgctcgcgagtggcgtccgccccacatgccgcttaggtgcgagaccggcccggtcactcggcagtcggctccctgtagagatggtaccgtgccacgacgtcgtcccgtcccacctcgcgtgcgctataaagctcgcgcgccctctcctcatcgatcattcgccatgatcacagccacgtacacaacaaacgcggcctcagtcctcacgcacagttaaatcttgatcagcgtatcaatcgcagtatccagctcccatggatagcatccacgaggagcagcgg

SEQ ID NO: 37545 - DNA, 4602 bp, Oryza sativa
ccgagttctggatggaggagatggaccacgccaccgcgggcccgttcgctgtcgccggcgagtgcccgggggaggagtggtacatggacggcatggccatggagtgggaggacgggaggagctactactcgttccactacccgtcctacggcgccgacgcctcctgcacggatcaactgtacagtagcccgttgtgggagtgatcagtgaactccggctagctagtagcccctacgttacgcgttagcgattagtgcatggccttcgcttagactccaagtgactagtaccaccaccaggttccagtttggtagtttgatctgcgttttttgcctcagttttgcaaatttagcgcgctctgaatttgctggagagagcatgagtccatgagtttttttttgtgttatggtttttaccgggcaattcatgccctgttttttaggagtactttcgcacggtcgtcgcgagtgttggtgtatataggtgtgttgagctttgaacaagtgatgtttggcagtttgggtgttgatgttcctgtgccgatgcctcagtctgttagttaaagttggtaatctgtctagcacttcctctggtctaaaaaagcaagtcagttttaaatacgtgcagtcagcacgagttaaatttgattataaaaacatgtgaagtatatgttttgggtataggaaaatgatatattctacacctatgtaacttttgaagtccttttaaaatttatgctaatagtaaaagttgtataattttgttttaaaagatccaaaacgactcgttatttaagaccggagggagtagttcccatcggaaatatgaagattaggcagaagaactataatgcgggaaagtttttttttcttttcttgatacatttatatgtgaagaacatctatagtgtagtttctattaatttcaatctagaaattgtacatcaaaaatttcagagtactatctccttggataatgtacagagtcctgaggctcttcggccatctggcttcgaagatattacacggagatttcagatttctataaagcgaagcgcatcagctcactagtcaccgttcacactgtcacagtttgttggaacaaaaaaagatcgctttgtgaaaagcgtagtataatacacgtacaacgagaaaacttagggcatgcaaaacgagaaaaccattagcgtatgattaattgaattataattattacaaacttgaaaaataagtttatttgatattttaaagcaacttctatagatgaacacacattttaaaattcaagggcctgttcaaattgtagccaaaataaatattaccaagttttggtaaatgctaaaattttggcaagatggcaatattggcaggatttcttatgtattgaccaaatttagcatcaaactaagcgtagacattttttttggcaatttaccaaaaatggtatggttgaaaatggtatcaaagtgaacaggccccaactctcttcaaatatttaactaatgactattttattataattaaattttatttgatgaaaataatattatttgattgtcattttatatgattatgatgtcattgctacaaaattgtaatacttgagaaatttgaagtcagtgatcagttttgaaaattgtgctatgttttccacgtctgagtgagtaggatggaggaagtggaaagtttttttttcacgaaacataccgtttatcaatcttaaaaaacgtgcaaacgaaaattgaggaaaaatcagtatcttgagacaagaacaccacatgtagcatggttaatcatcgctgatccagatccatatactgcaaattctgaataatgcagatgttgtattgcacgctgtgcgacttgtccttgaaactggagcagtaacggtgttccacgataacgatatgctgcgcaggtttttcgcctccggtggtttctttcaccgagaagcgggaaccaaatcatgcacaagaggtcaggtgccgtcagcctgtaacaggctaggacagcctgaagccattgtcgtcgtagtaggttcatttcttcaaatgttcagcaatttaatttcagttctgttcaaccgtcacattacagatattcacgagcgatcatctacaggtgaagcactgctttcaaaaatcacagttaatcttattgcagttcacattttcttattgacatctcccacaattcccattgtaaaccagaactccaatcaacatccgaatcaagaatacacaagtcaatgtaaaagaataaaaaaacaaaaagaagaagaagaagaaaacatccacaggttcatgatgcaatgttccctccaaagttaatgctaaggcagactgcacaggggacagtaggcaaattgatcagctagctcatgagctccttctctgctcgcacaggcggcgggccgccatggacatgtgcgtggtcagcggccagaccaccggacaacttggtgttctgctgctggtatacctgcctcagcctctcgatctccttcctcaacgcctcctgatgagctgcacatgcaggctattgattaattctcatgagtggtttcttttttcagataatggaaagtaaagagatgctccttcaggcatgatgggaagcagcagcaacagaaaatgcagcatgttgcagagaagtaaaaaattttactacaaatttaactcaccatccttgaaaatcttgtcctgtgctagagccgcgatccgctgcttgaggtggctgttgccgacggtcaggatcgtccgctgctgatccagaaacgccacccgaggggacagcacggatacctcgttctgcaaaacatatcacattttacacaaaaccaaaatggcgatgtttaatttgggaataaaccaaactgatgcctgcttgtcaaagaagatctagccgtagtggtcagacactaatggcaccctgaattaccctgcatctagcttgttcggatacgctactgatacacatttgatttgtaactgtctcgaccgatccctccatgtgcacccacgatcagagcgctctatatgacccaacgtactgtgcacacaaacggagcatgttacatggagtacactacacaacagttgttaaatgctagtactactacttgcacaaacagtagtactaccacacatttcttaatagggcactaatttaatcagatgtcgcgcaagcaagctaagctagctaggaaagggaccacgcacaacacaccactgcccactggccaatccatccatgcagaagcagaaccatgtgcgtctggatcatggcatgacatgccattgccactacgtctacgtgggctggttggtgccgtacggggggtgaggtgaagtaagacatccgcaggcgtgcatatgcacgagggtgggggctcacgctctcgctcatctcctcgccacattgtgtgctattgccagccaaccagtgtggctgtgtccatcggtcggtctcaaactggcgccacttctgtccgtgaaactcatcgacgggtcgcttactacatcgcacagaatgcagattgcacagccacgaacggttgatctgacgtgagtttgtagagttgaggtagggtgttcggtttcctagctaggattcagaattgtgccgcgtttcgaaacgagcgtcaactcggcttgctagagctcgaagagcggattggtatagggtgtgataactagttttgagtttggtgttgtcgtcgttgatatgttcgtattgcacgtatatgtatgtatacctgcagggttgtgacgctgcgctcgagctcggagatgtactgaagcttcctcactcgcgacctctgggccgactgccgattagccagtatcctgaagacatttccaaagaagagaacacggtaattaatcgaggaatttatagtgtcgtaaagtgatttgtaattgatcactagatgcatgcatggacgcagtgcccaaccgggcgcgttcgctcgcttacctcttgaccctcttggggtcccggatcagctccgtcggcgaggtggccgccgcctgctcctgcgtcggctccccggcggcgtgctgcccgtcgtcgctctgcgccgcggcgtgcttgtcgccgccgccgtcgctgtcgctgccgccgttgtcggaccccggggccgacgacccgccctcgtcggggaacatagacatgagctggtcgtcgtcgagcctgtcgaactcgccgcccgccccgcaccccgccggcgccacctcgacgaacgccacggagtcgctcagcgaccggcggtgcgcgccccgccgcgacgccgcgaactcggcgaactcatccgcccacgccgcgtcgccggcgcccccggccgaggcccagtgctggtggtgccccggcgccgccaccgggatcttgggcgggagctgcgccatgtacgtgtccttagcctatagtagcgatcgatctcgcgagcttgggctaaccacctagctctggcgcgcgcgttggaccgcgccgcaacatggatctgccggtttttgttttatactagcatgctagtactactacagtatgctagctgcaaagcgctatagccaccacgccaccttgttactacgacggagggaat

SEQ ID NO: 37546 - DNA, 2379 bp, Oryza sativa
cggcgcgcgacagactgcgatggccggtgccctcgaaagcaagcagtcgagcgcggtgccggtcacctcggttcgttcggttataccgatcgcgcgcctgagacgagcacgaaattttgtgggagatcgatggttggaggcgcgcggcatgccgtcattgcatctgagtttgtgctgcggcgcagtgactagaatatgcatcgcgtgtcagactgtgtcaaagatagaatatactgtcaggatcgcgtgcgtttcaccggggaaatagtaacagctgccgcgtatcgggagcagcatgttcgcaaatccattgggatcagagatctcaccgcgcttttgcttgcttccacaatactactactgtacacgggaatcttccgcaacttggatcccgttaagcacacgcttttctcacggcctctgtacggacgacgtgttggatcggttctctccgttaatcttgcaaacgaaaagcaactcgttttgcccaatgaaggctcagcaatcaacacaagaaacgcacttttgccaactccaaggcccaaacaccacggcaaaagcttcatcaactaggcctgatattctattgggctgggtttagcagtaaggatggcctgatacagtacgattggactgccgaaaaagctaatgcgcgcgtgccggcggcgcgcgtcctctgaccttttttttcttttttttttccgattttttcgtttttttcacactttttttctgattattttttaaatcttttagcatattttgagtttgaaagtttttaaattttgagttgaaaattttcaaatctgaacttgaaagtttttaaatctcgatttgaaaattttcgaatctcgatttgaaagttttcgaatcttgagttgaaagttttcaaatctcaaattgaaagttttcaaaattttcaaatctggacttgaaagttttcgaatctcgattctcgagttgaaagtttcgattctgagttgaaagttttcaaatctcgagttgaaagttttcaaatttgagttgaaagtttttaaaatttgactttaaaatttaaaacttaaatcgaaagttttcaaatctaacttaaaatttttttaatctgttagtaaaaaaatctcccaaaaaatctccagaatctttcctaattactatcattagtgttaagtatattaactaatataagtagttaagactaaagagaacagggagtgctcgccagctggctttcctggcgcgcacgcgcgtgctagccacccccttggactgccttgtattcttatgtgctttcccaatggaaaaagtacatcgaaggtccctcaacttgtaattgatttataaaattgtccctcaaccgtaaaaccagatatatgacatctcccaacttacaaaaccgttcactttagatccttcggtagattttgttagagaatattatctcctggggagataaggtcctttcccgtggaccaatccgaaccggagtagagataatatctatcttctcctaagacccctatatataggggcagggtgtaacatctaaggttggcttacacttcagatcagatctataatgaagagagagctccaccatatatctgtgttcattgtctacttctgcaatgttcttgagggcaaaggaatgggcgcgggtgttttacatcatctcacgcctctattgctgtgggagggacagggaacgaatccgatgatccgctaataggcgcgttggtttacaacacgttatcagcagctctccgttcaccggtttgtcgttccaatctgttctcgttattagattgatttctaaattacagattgatgtgctggtatttcttgctctcatgtcccgacgatctagcgaggcttgcgatgcaactcgccgggaagctacggcgcggctacgcataggcgtcgatgagaccgccgtcggccacgcgaacgccagcgtttcgctcgtgtacgaaagcttctggagatcggcgtgccggcgaaccactgcagtgcgatccatcgcctagccagcggctgcatgcctgcatgcatcacgaggggaagcgccaccaaggctggccgcctcacacaccctcaacgggccggcgtggagccgccgcgcatgcgcgcgcgactcgtgctcccgcatggcgtcgccgcgtcggtcgcaccgcaggccacggagatcacggctccacgggcgtacaatgctggctgccgactcagtagtcggcctgatcttgctcctctctctctctctcgctcacttctctgcgcaggttggcgggtggagagaaggcctgcggggcgaggcgggagagaaggagggcgtcggtggctggcgacgcggccacaggccaccacgcggagtgaggaggccgg

SEQ ID NO: 37547 - DNA, 3022 bp, Oryza sativa
cgtccggtagctcccacttcgggtgcccggcttctgtcgccgccactctgaagttctcctcgaggtatttgtccgatgtcagggaattcccaaccttggctctccgggtaggattggtatcttagctcacttgcagggccaagcccaacctcttatgtccacaatcaggccagagtccaagaagccggccatgttctctctgaatcgcttcatgaaatcggcatacaactagtgtcgcagataaacaatctatcaagtcgattagattatcctaaatttgatcatggttgtgatatgtaaatttgcaatctcaatgtcagtatgtcacaaattatgaaatcggtgtacctggatgggagttctgccgtggaacagaggccggtcatccacgccgatggtgaggtactcctggttcctcgcgccgccagggctcgtgtagtgcacgtcggagtcgtcgtcgccgacgtcgcggactcaacgaggcagcgggatgcatggctccctgtacacgcgccactcgtaccgcgccggcccggcgcccttgacgatgccccactacacgtccgccatgacaccgtcgacaccggcctcccgccgcagccgcgtcctctagctcgttctccgcggtgaccacgcgcaactgcacgtctgcacgccacgccacggcgcagcgccgctcgacacgatcaattcgaacgaaagcttggagagattgcgtgagctcggagcttaccgtcagcaggcctcctccccacccggtgcggtggcctgctgccgcgtcgccgcccgtcgccggccactgatgtcctcctcctctcccgcatcaccccgccggccttctccccacccgccggccagccgccagcctgcacacagaagtgagagaaagaaaggatgaagggagagaagaggggtaagaaacaagggctgacatggacactcgacatgtggctcccacgctgactcagccgtcacatcagataaaaccggggtcaaaaccactgaaggatctaaagtgaacggttttgtaagttgagggatgtcatatatctggtttgcggttggaggacgattttgtaactcgatggcaagttgaggaaccttcggtgtactttttcctttcccaatttatctccaacttttcacatacacgtttcctaaactgctaagcggtgtgtcttctgtaaaagttttctataggaaagttgcttttaaaaaaaacgttcttggcttgatcaaccggtatgatcgcgaacagacttttgatatgcttgtaagttgagtatgtgttgctatttctcaacggcatcagtagaaatataattcccagtaatggcgtataaacactcttggtatattatggttgcagacttcatccgtaagcgcacggatataccattgtagcatttcaccggagagtattccaagggtatcgtatttatttaatcccatggaaagattatattagagagaactatactaataatttatatattacatgtaataatcaaagtttaagcaggggttaagattattaatagggtagaatgacacacagaaagagaattatatactctcattataatttatctaagctaagtgggaagaaaatagaaataatctattcctatacttctaatatacatgcatattatacatacatccaagatatatgattactttgctaataccctctttccaatgcactcctggtgcttcgagaagccacccctgattaacgagtttcttacgacaatccatcatgaccatccaaccggggctaaatatggagaagtaccctccccagaaaagtaacttaggattatatacacgcgcggaggaataccagtgctaagctgtcaccatcagcggcccacctcgacgtatccgcagcatataaccacaaataatgatatccaataatctaaacaccacgcttaaattaccaaatactactctaatatcatcgtcatgacatagagcaatcgtatgcacgatcattatacccacaccattgcattttccagataagctagcatcataatcaatatagtttgaatgtatgataaagttggtactcatatactcggaaagtagtacaataccagagtagtatctctactacttaaaaagtccgtagtggtggtggtgaggccattccaggcagacacgcggaatatgaaccattcgatcgtcaaatccatcggttcagaataggcagatgcgcttctctccgcatccttatcgagcgacgcctcccatcgcgacacaactcccctctcctttttctccgcctctgccgcccactccacccagcgccgcttgacgccaacgctcgtcgcccgaactagccgccaacccccgtcctcggcgctactccaccgcgcatcgcctgccgccgacgaccgtcgccatcgcgccctaccatcggcgaccgccctgccccacctgtagtagaatccctgcctcctccgcctgtcaccctcgtgcccggccgcctgtcgcatccgcccgtcaccctcacgcctagggggctactccgccccgcatcgcttgccaccgttgcccgcgcccagccatcggctgccgcctccgcttgtcgccctcgagccctgccaccggcggccgcaaatacctgcccccagcctctcctcatcttctggatttttttcgtcgcggccgccgccatgcagatcaatcgatccacccgctgttcggtctccctcacaccatcatgcattcacgcctcctcgtcctcacgattcacacctcctcttgatgctgcagccgccggattcgggagctacaatgcgagagagagcttgattcttcttgcttgaggtgtgtgttggagggagtgagctgagggctttatatagcttgagaataacggttacgacggttggaaaggttggtaataccctccaaccgtcattagggagtcatctcaaccgtctagccaaaacctggatccaacggagccacggctggttcgattgaaccctgggctgacccaaccagc

SEQ ID NO: 37548 - DNA, 10898 bp, Oryza sativa
ggtggccgggagttgccgggggaggctgcggtggcctgcggctggtggaggaggggaaggcttacgcggtggattggtgccggttgttttgggagttgctgaagatggatttggtgagcgggaagccacggcgctacgcgccgcacctcctccgtctgatcgagtaccaaaggcccgagcttttcgccgaggttgatgggagttcgcctcttgggaaaagaaggaaaagcgcggcgttttcgcggcaatgccagtgggaagatgaaaaggagacggacttgattgacgcagagtgtggagattctcgtacccaggcggctgaagcagaggtggagaggagcagccagagcattggagacttggaggagatgccagtttttggagagcgcaagcaattcaatgctgttgatcttgtgggttacaaaagttcaattgttggattgggggaatggatccatggagtgaacgagggaaatgcggagcttggatctcagaaaagcttgccttcagaaatcgaggtttcgggctgtgagatgggaggtaatgctgctgctggtttgaccgccaaagatcagagctcgaatgattcgtctctccttagccttcttcgcacaatggatgagcaagatgactcctcaagccatcagaatgtgatctccggggccaagccccaaccagggccaaatcagcagagcataattgagatcgaagatgaagaggatgacgatgatgatcaggtgggtgttggtcatgtccctcccaacattcaaaatggacattttggcctcaacaattattttgtgcaacagagggcaacagaaggctttcaaaatgatcaaacgcttccatctttccttgcctgcacacagcaaattaaagcttgcatggatgacaacttcttggataagatgaaggctctcatggatgctcgagctgctaaccagcgcatgattaacatgataacacaaaaggattatatgattgcagccaccaagagggacatactggaggatcttggagcaaggcacgttatgatcagtcaattcgaacatgacattgaattgatgcgtctcaccattcaacaataccgaaagttgtttgagaacacttctgctgcatatctagagtataggaacaggatgtcacgtgaggagggtgatggttcatctctggaagttattggcatagctgatgagacggagcaatttgttaggatgcagcaactggacatttatcagaggcttaataagtttcaaaagctttggctcacgaaatattcagatcttgttgggcatttgacaagagtagcagaatgcatgacatacctcagtaatggactgcaaagactgaaagattcaacaacaattcccgaccttaacaatggcaagcctcaactatgaattatgtcttcatatttccattatcctaaaaactttagtaaaccaactcatttttgttctacccgcaggcttggaaggcgaagaattgggcaaagaattgctgagtaagacaaaagatgcagagcgggaaggtgaaggggatcattgcagtagcgctgtagtggtgagtttaggtcttgtgctgctgaattttaaagtacattgaacgattgctgtttgagcaatttgtttagccaacgcaacaaatatttgccacgacttggaaatttgccataaaattgcttgctacttccatcaaaagtagatggccctgaggttttttatccaatatgacactctagctaattgcactgaagcttcgaagcccaattactatcaaccccctcgtttagcctcagcttataagcataagcgcagatttaaattttaaaacttaattttagagttgattttagggttttccgtataaattatttttaatggctaataagccatttcgctaatattaagttagtataagccaaacgtgtgtttcgtatctttcttcagtttttctttggcacaatgccggagcataacatgtcatgatgctacggtgctggaaggaaagcagacatattcagatcctgacattgcacttactttgcagatagatgaattagcacaacctgatcagaggaatgataaggagagcatgattgtcaatggagtttctggaatctgcaacgaagatgaggtgtagcttcacagggcacaagttagacaagaatgttctgttgatgggtttaacctagagtcagttaattgtctagggtttggtcatgtgggcctcaacagttgccctaattaattactatgttaaaatggtttagccgtggatattggatggtactgtgactatggtcaacaactttgtgcatgaatgacttctggcaccttgctatttttatctgtttcgagtcctatggacaagttcctctgcatgctggataaacacgcacgccgatgatttttctgtccctaggaatcactgtgggatctctttgaaacgtcataaacagtcactcttgtcttgctcggtgattcctatataagacattttatattaggctattcacagagtaagcaccggtggtagggtattagtccaaaaaattagcctaaagacaccattccccacggtacaaggatcctattttacgtgacctagttggatttagacactgtacaaggaaaccggcacccacaacgctcgtgacctggtggagggtagcgaggggaccgaaggaaattaatttcctctcctacccccgtcttctcctctctttctcctcctccttcgtcttcttcgctgcctcctcccactccgcctcagcgcctccttctcctctcccacgccgcctcctcctatcgtcccaagcagtagttggcggcgtggtcttccagagttgcggcggtcgtcggtggcgacttcggtggtcttccggaggctcgccggcacctcctctccctcgatcttggcggcggctcgccggtgcgcgagcggccgccggttcttggcggcgcagggacgccggtgcgcgggcggccgccggttcttggctcgtccggatccgagttgtggtggcggttgtcggcacggggccccggattcgccgccggatttaggggtcgtggtggcggatgtggtggccgcggcgggggcagcggcaggagcggacgtcgcgacgccgacgggaagccgcggcgaggaggaagcgggcacgcggcggcgagattgttgattgttgtttttgtgcatgtgagatgtgatgcttcttggtgattcctcttgtgttcttgggacggatcgagttcttttttctgcgttcttgcttgaggtgtttcggtggcgggaagaatcatgggcgaatcagggttttctccactcgatgcggcgcgagggcacagcgcggccaagaaccacaccccacagcgtgcgcgcctcgtgtcttcctctccttctcgcaccctcgttttggcgaggtttcgcgcggctctacttgggggcgaggaggtttgctagggtgcgattccttctgccacgtatgcttcaatccgagctggcactgtgtagcaccggtccagctcaccgcactgtgagaggccttacactgcaggcagtagtatcaattggttgactatggaagaaaaccgtcttcttcagacgtcaatggcctgcctgtggttccattcatgcgggaccccttgtaggcctgtatcttcttacttctccctccattccctaatataagatattttgatattttgtttgcacggtttgactactcgtcttattaaaaaaaatggaattattatttattttatttgtgacttactttattatccaaagtactttaagtacaacttttcgttttctatatttgtataaattttttgaataagaggagtggtcaaacgttaaaaaaaatagtaaatatcccttatattagaggacggaggtagtacgagttgctgatacaccagatgagatgaggatcatgttctctgtaaagagaaaacgagcatacctggtttggaaatggcatgaattttgatgtcatccattgggcataccttttttaaaaaagaacaagcctaatcatatcagatttttttgaataagtttactttaggttacttaatttatcgtcaagactaaaattcgtccataaaccgtgatacctgatatgacacgttctcaaaatcaatgcaaatgaggtcgcaaggcagttttgacggcaatttcgattgacgtgatgcctatgtggtgctgacaaaatcagaaaaaatcataggacccacatgttagtgagtgtttggctaaaaataaaaaattacaatgtgacccatgtcatcaaccctctacagagaaatatgtcatgacatgggtctgactgtaattttttttatttttaatcgaatactccttgacatgtgagtcccatgtttttttttctgaatttatcaacaccacgtagacatcacgttagctaaaaccggcttaagatcttattgcggtttatagacgaacttattcctttttttcccccttgcaagggttaccgggaaaaaatgttggactgggctttggcatcagcttcaactggcggcttgggcctggcctgtgcttaggttggcatgcattttggcaaaattttgagcaaggttccatttgatattttggtgattcatttcttgcgatgaatcttatgactttgtttgatagctaattttaaatcttttcagtttggctaattgtttttcttcaattgtaggttgaaatgatgtcaacattgtgtttgaaaaacatgaaactactgtgagagaattaacagttagataacatataatgtgatgtctaaagataatttgatttcttaaataagttattatactccgtaatgattacaaattcatttttcaacaactttagaaataaacaaatcacaacacaacatgataattgccaactaggcccaagtgcccaagttgaattttggattctctggcccactttttccaatatacatttggattctctgtcttgcaagaggcgagtcaaagaagcatgatagggtaactctcagctaatcttggccatccaattaaagatgaacggacaagataatactcctctgtgttcaggtgcataaccagcaggagatagtagaatcaatatatatcgaatacttttcttgtcaaatgtatcacgtctatttgtagtattatctataaacaattgattattgatagtagaaacattttttttctactagcagtagaattataataaatacctcaaatcatttttttactggtgatagtaccatagtagaatattactaacatggatcactgtaaaagtactacggtcattcttgttaaaattaagtacccgcttaaggattgtatgtggtcagactttttagacctgcgctacaacaactttataaatatgtaaactatacttatcaaatgatatgttagccgtctgaactttcgtaggaaaaagtgcgtgtacgagcgtgttcgcttgatgcaaacattgcctctggatagggagtgaggggttatccagaatcagatcatcgcccatagataagcaaatctcttctgattgtgaaaaagatgtctgaaaggacctagtcggctactccaaatgtggtactatcattatcctcaaccatgctatcctatggcttcgtagcagtagcactgattaatcacgcgatgcttctatcgaataaccttatcctgttgcttttgatcatccacctatgggcgaatcaattccctctaaagtcctattgcctagtgccctcgattggcccaagctgcagcatcttagtataatcatgatcatagttgggagcatgtttggtaaggttctgcactcactcctgatgcccctgaaacttgtataatccacaaagctcaattaccagccatccaatttaatatgtgagtgcgatgctagcgacatcggcatgtttatctcgcccccaacacatggatttgggactaccctatattcaaaggcactgggggaggtcataagcacttatatgcacacatgtaactcgagctgaatcgcctgtctctcgggttggtgcttgcttgctcatccatggccggagtcaggcagcgatccaaccaaccaccgctcggttaatcagtcggctcgacggattgctagcttgtgtgtgtatgtgtgtgtgcacgatctttttccggccatccaaccggattcgccaggccggccggtacggcaggcgtcaccggcgactttccaagtcacagatcgctgctttcgagttggagaacaaatctgtgctcccacttttccaagcttttgagtcggaagaccactcactctctccctcccctcgcgcgctctgctcccttttgttttctttctttctttctttctttcttggcagcgtgactgcgcaaagaggcgaggcgggaagaaccgatgcgctcctgcaatgcaagacctggcacgatcgcgatggcgacgccagcgagagcgagaccttgactgtaaatatatactactatatatttcctctccttgcgccagtggagtagctagctggagcagtggagtgtggagctgactggtgcttgcatttgactcgcgcgcttcgggtgcgtgcgtgcgtaactgagcagtgaagagcactgttgttgttctctgcgttgattgggagcacttgcgatcgccacggcgcactggtaccacgttgaaatttgaaatagtagagaaatgtttgggtattgatcggttgacttggagatgcagatgcatgccatgccacccatacgcatatgtagtgcactagtgcgtacagcgtacctaccgtgacccaaaaatgtttgttcgtccgaaaatgacatgttagagcttgtaaaaatcgctgtagtccaaaaatgtgtgattttgttcctgttggtatttatgaacatggtaattggggtagaatattgtagcagaagtcaatagactggcccatttgatctgtatgaaaagtataagaaatttaaagaatttccatcctatagaagaaaatcttaagaaatctttgaaataaaggattaaatcatattctccccattgaaaacaagcaagagactctaccacgtattttcatcttcttatggttgttaattcctatgttactcctacgtgtttatcaaactactactacaatacaattttaaagcttttctgtgtttttaattttatttctagagttttttcaattcttatgttttttacaactatgtgtttcgaagagggtttaaaactaaaatgcggggaaacgtcttttagtctaaaaatcataaagatgtcaatgacaaagaaaatataaactttgcactcttttcagtgtcccaaaagataaaggtattcccaggtccaactttgtaaatctgggagtactttatcttttcagtgccgtcttgtttgctcgtcctcttctctcatctccctaaatgacaggattacctagtgtaattaaggcgtcgtcaccgtgatcatgctgtttgcagttcaaaaatatactactaggatttgtctcccttaaattgagtgaacagccgttgaactacaaaatcctagttaaatcatcctcatccaaacaagcactgaaaaggggaacacttgggcaaaaaaaaatctatgggtctcaaccgcaactcccactttgcctagagaaattccatcagagctttatccactttcccttctttgtacaaatacaagagacgggtctgctcctttcctttgacagctacaagcaccaaacacctaatggagaactttcgttctcctaataaagaaaaacacttacacacttatgtagttcatactgaaccaacatggaacgcttgatgtataaacgaagcgaaaaatgaaacaaaaaatggcttaaaaatggccgctgattattcgccgcatatgctactgctgttgcggccgcggcagctggctttccaagtcttccatttccacggcgtggactcccggctgcctcctcggcgacggtctctccctgctcagcatcttcattagcgacgcgccgagcacccgcaccggcgccgagctaccggcggccgcctcctccttctccgcgtcctgcttctcgtgcacgcacctcgccgccgccgttgacggaggcggcggcggcggctccaccccggcgcggcagaccgggcacgacgagctggacgcgagccacttgtcgatgcaggcgacgtggaacacgtggcggcaggccggcagcacgcgcaccgcgtccgcctcctgcatggcgccgaggcagatggcgcactcggtggtgccgcccgccgcgtcgccgcccgccaccttcccgtacgccgcggtcggcagcgccgcgatggccgacgggtccagcccgacctgcttgggcggcgcccccgcgttcacggtcgccagcgcggccgcttccgccgcgcgcctgcggttccggcggcgtacgtggcagacgtagaggtggaggaacagggccagcccgagcacggacacgaacgcggcgacggcggtggcgatgagccgcacgttgcgccccggcccggccgacgagctcctctcgccgccgccgaaccacgcggaccccgggtcgctcactctccccggcacggctgacgtccgatccatcgatcgatactccgcttatccgctacacgcgagcgcgagctagttggcggagctaagcttctcccttggtttggtgagatggcgcgcggtttgggtgtgctaagctgagtagtactatctggtctctttataagctaagcagccgcgcctgcttggccttggctaatgatttgatttgggagggtttagtggtggcaggtttaggtttataggcctcggacgtgtgcgactgaccgtgacgctcgcgttgggcgcagcgggttggtgagtgctcgtccggttcgtgtgcctgtcaggttcgcggttgtgggggcaaaggcggggcctcgacggtgcgggtgtttgagtttcctacgtggccattagtcccccatgtccccacgacaagatgcgacttgatggcgactcgaatcgccgcggaacacgtcggttgctcggtgcggattttccccgggatttcttagccccggagggaagcgcgcgtcgcgcgagtgcggcacggcacggcagccgcgggccatgcagccaggtgttggccctgtaggcggccgacggtgcgccgacgcagcaaatagcccccgcgatggagagacaaaggaagaggatttcatgcgagatcttgcgctggttggttggtggtgacactcggcagctgtttggttggctgtttcgtgaaggtttgtttattcattgttcacgatggttacgggagtaatcgcagcagggtgaactgagcttttgtgaactgattaattggctctccttgtatggcaacacggctgtcaagtgcctctatgtcttgtcaactgtcaagttcgttgatgtggaggagtagtacttgattggagtacactttacttctgtactaaggttggatcaacagaacacatatccgtattccaaaggcttgttcacttgtttcgagtggattcattcacggcctgatacgaaattcaaggcttcggcgccgtaccgacgagtacgaaggaatccaccagtgagcagtcgtaggatggtgccccaggtggcccatggccaggtaggataggagtatgcctcagttgatgccaatttctggcgtcgagagcactagtagagcagtgatgaaaacctgctctcattcatccagagtccgcggacgagtccgaaggatgactgtgtgagtgagcctgggatggcatgcatgcagcatggcagtgctgcagtggcaatgccctcctttttggctcaaactacagagatggagtactcctagtagtacgttcagaattgaagacaccgtacactaaagttggtgctgctgccgcagagctgcttgtatagttaagcggcagaagattcttcggctacaatactcgacaacaaatttcatcgggtatatctgcaccttgattgcctcaaaactctagcgggaatggccaaattgtttgagctcccttttatcaggtgtaaagaccggagagatcgagccagagaggtgcatgcacttgcactttctttagtttccccgttgttgatgcttagccaaaggaatgacaacgatatctgtttctcgaacttatagcatgcgaacgactgaacgagacatggctgtactgtctggcccaatgtttaacttaagaattaagcttttaattactatagttggcccaaggtatagctttgcagggttattctttgatttggcccatatacaagtatacaacatcgcgtggtccaagcaaactccatctggtcggcttagcttcgtttaattaggcccgacaatcgccctgcctgctgggccgaataacggcacaggcgccgcctcaggcctcacccaaactaaaccagcatgtttcatcacgggcaggcatcgatacagcatgattcagttctcaacaacaacaacaataacaaaaaaaggatacagcatgattcttcgcaaaggggagagaagaggaagcaatgccgcatgatcgcgggaatgccatcttttggcgcctttggcacgagcatccgtcatgcatggactccatcgtcgacatgcgccgtcttggcgatcgacgttgcaggcgcgcgctcatctccgtgtacgtacgtgttgcgaatcccccaaaacgacgcgatgcgatcgatctggtcggtagctggttagaataaggtgcaggtttcctctcgtctcggaatggctataaactggcttggccgctagggcgaaccggcgaaggatcgatctaacctagcgcgtcgcccatgtcttgtatagtcatcgtggccacaggcgcgcg

SEQ ID NO: 37549 - DNA, 10366 bp, Oryza sativa
aattcttacacgtgacatgtttgaaaatttatttcttgcaactttttctcttcacgcacaaatcttaaggcgatccgatggtcacaaatctgaaagttttttggggggcaaaaaacttaagaaagttttctagcaaatccaatccaagataggttcaactccatatcgatctatcaatatcaaattttggagttaggaaataaaataaatctaaatagtccaaggtacctcctagaaatcacatgttttgtttaatacagattctcaataaaatctacagccatgataaaatgacctacatttaaagcctaaatattatgtgatcatatatcatatatacttatatagttcatcccactaactgtagttaatgctatttctcttttctctcattaagccacatcaccccaattatttctagcctttagatgatatatctatggtccaaattatctcttatttcttaaaaacatgcaatctcaattatttttagtctcaaaattgtatcaaattgttctcgtattgacaatcaaattacatcttatttgtctatattatgcaacttaatttttcgcagcaacgcggcggtgtattcatctagttaatatgggagttttctcagagcgcccatttagtaaaggtatgcatatatagatagattgtcatacaaaactaacattagttccaaccatgacatgcagaaaattatataataacttatgtaaataagaaatgattatttatctaaaagttgaggagggagggggatggggccgggagtcagctggtagctagcctggtacccatttggtaaaaatccatagtttttgctttcaaccacacaaaattgtttctctgccaaaataatagcaatcttcctttattgaaccgtcgtgcatttttttttaaatgttactatatatagatcttcgagtcatatttggccacaacatatatagcaaaagtcaatatgctaaaatgaacaatgtactcaaacagtagccctttttaatttttttagagaaaagaacattttaattaatggtccggctatggggagaaagttcgaacacaaacatatgctgctgcagctagccctttaaaaggagtaaatattatcgtcaatgatatgcatgcatgtaatattttcatgaatccgcaagcaaattcagagaatatggaggcttacatgcaaaacaaggaaagtcccagcctagaaacaagaagaaacaaacatgacaagctactgcactactagccactgccgaattagatggtaggatgttgatacgttgttgtcctcagcctctttcatactacaattgtcagaagtacggtatgacattcaatttcagaagattcagtctgtgaatgaaaaggatctatacccaaagcagtgaaagaaaagaaagaggaaaggtagagataaaaataccattcactcttccaataatagaggagcgtagagtgatagttatagtagagagcagatgccccccttgtgttcctgccctgctcctatcattatcaccatggaaatacaacagaagcaacagctgcagtggtctaaattctttcttaattagccaaacttttttcttaatctgaatcccttttactgctttcatcctcctgtacctcccatattgccgatatattattgcaaaaaaaaattggcgcctttatggaatcaggatctaggacaaccttcgaattggctaaaggccggaatcttcttcagaataatcagatataagaaacattaaaagatccaaaggggggaaaagccatcaagatcatagaccatatcatctcttcatcatcacatcttgtccatgccgagaataaaggggaaaacagcaatagcaactaatgcaacagcaacagctgcctagttccaagggaacgtactcttaataattaattaagccttggttacacatgcatgaagacagcagataataatgagggaaatttcatcagccaaaatcctacatgaaatgacatacacgtacccttaagcagatcagtgaagtgtgttaattaatagaaagcacacacctcctgcatgcgcgccatgcatcaattcttcagtctcttctcatcacctgatcacctcacttccgtgctcctcctcgccctcaagccgctgcgccgccggcgcgagaaaccccataaacccgccgccgccaccggcgccgccaacgagatggccgaagccgacctgtccggcagccattgtcgacggctggtggtggatggctgcgactgcgagggggtctagccatgcgcgggctgacgcccacccgcgaccgctggactgaaggggttccccatgcgagaagagctggctctggtccagcccttgccgcgacggcatggcgaacatgtagccgtcgccattgccgccgccgcggccgtctcctgtgctgttctccggggcatgccatgcctgcattctctggctgtggtcgggccaacctggaacgcctgcactcgagatcataccgtggtggttcgacgagacatggctgaagatctggtgctggttcgactgtagggtgaggcacagctcctgcggctgctggttgcttgtcgtgcgcgacaggaggtccggcgggatcccctgtactcgtcgtgtccggcggaggcggcgccgctggctgtggacgaggaggggaacagggacttgacgctgtcggagactcgatctgcccccagcgaatgtggaaggaaggagccagcagcggccgacgcggcgctggtcatggtgccgccggtagtgttgccgaacccgtaggacgtcgaggtcgcctgctcggtggcctcgggctgctccgtcgacgccgcggcgggcggcggcggggcctcggcgcggtcggggagctcgtcgatggcggccttggcgttgcgcatgagccagtcgacggccttgctgggccggtcgtagccgaggcggtcctgcacgtcgtagaaccggatggcggtgtgcgcggcgaggcggacgcgccggtcccgcagcccgcgcgccgtgcacaccttgctgtgccggtccttgcgcccggccgcggaccgcacgatgcggcctgccccgaatgcagtggccagcgcttcgacgggcgtcgactcgccgctgctgccgccgccatcgccgccgccgcctccacctcccggcccccggctcgccggctgcctgatccggtgttgcaggaagctgccgaatccctgctgctgctggtagatctgaagctgctcatgcgcttgctgcgccctctccttctcctggagcaggtagtgcaaggtgctcgcgctggcggtagggttgctcgtccaagggtctaagcccttggacaactggttcttgtcttcctccagcttgagctccctctcacccacagttaaccggaaaggagaagagcgaaaattaaaacaagaagctaaattctattcctgcatggggtttgccaagctcagctcagctcagctcagctcgccatcctgatgagagggaaaaaagatacagtggccatgggaaccccacagctccatgggcagagcaagcacgcacacacacagtcgcagcagcttaatagctatagcggcgcccagtgcagccgcccggccggcctctcttttgtgaaagtgacaagaaaagagggcagcgcagcgtagcgcagctagcccagtgcagatcttatcttggcaatctagcgctttgtgcttgtgcgcagctcgctcttgctagctcagctcgcagtactggctacccttagagggtgccaaaagaagatcaagaaaaaaaaagagctcccaaaaggcaagataattgttaaaaagcatgtgtgttttttgcttaattatcactattcaagcgatcatatatatatatatatatatatatatatctgtactcatttttttgttctctctttttttttctccttcgtgagtaaagtggaggaagagagagattggtagggtggggctatggaagtatagatcgataggatgatgcagggagaggggggcgccgcagacaggctcacaggggcagcaggagtcagggtgcaggagcagcaggacagaagctagctctggtgagatcacgcccccatctctccaatttccctcaaatttccccaaccttaattgcgtgggagaagcccacattgaattcctcctctcaatctctcatcactcgactctttctcgagaagactgtgctacaccaataggagaagcccacgcatgcattgtatcgatagatcacccacccgctgattgtgtactgtttcgttgtgtctattcagttgcaaagctgagcacaactgtgatggagaataactatagtgatggtcatgcatcacatcttttttgggtgggtttcatcttcgttaagctagctagcatatattcggattcagtagatacactgcaccttttaatatatttgtactatgaaacttaggaatggaaaagcttcaaatacgcgagagttaattgtttttcatgtgaaattcctgagcaaaatactgtcaattctagacaggatggagcacaggacctaatgtttgaagttactgactatataaaagtttttcatgtgtacaatacgttcagttatttagcacttctattcgtaagtctatgttactctatttatactcgtctagagttgaagtgttccctgtgaacgcagggatttaactgaatctatttcaatttcagttttgtaggcctagcgttggatcttcataggaattttataggaagtagttcaattccaacaaaataaaaagcaaatccagcgttccaaacatggcctagtgttcatataaatatatatgatggaattaatttccatttgcgtggatttgttttttactccctccattttatattataagtcgcttgatttttttcttaattaaagtcttttgggtttgaccaactttataggaaaaaatagcaacatttagaacatcaagttagtttcattaaatttaacattgaatatattttgataatatgtttttttattgaaaatgttagtatatttttataaaaacttagtcaaacttaaaaaaatttgactaagaaaaaagtcaaaagacgtgtaatatgcaacaaagtattatatttgattgcaccttaagtaacgggtctgtatatatctatatatgtacaaaaatgcagacttgagtagtagcaaatcttcaaaagaaatattatgatgtaaaaaaaacgtttgtaacattttgtcggttgatttgtaactattttttttacacatactatatccatgctgaaaagcttttattttaagctacaaacctggacatatgaacctagataactacttagaattagagcctttttgatgaaggtagtatgaaattccattcagtttcatgttggctgggcatctagggttttgttagttgttacttatagtatgctatacagtgtggcaggcaattagacggtagaggatagtatcgcagccaacataggagatatttaaggcaattttgaggaaagaagacatatactctctccatcccaaaatataagtttttttatatgaatctgaacaactgtttgtctagattcatagctaaaaattactatattttaggatagagacagtatatagtaattaatttggctataaatatgtttttgtccttttgactccgcaatatatacagaaatgtgactggatttcccaaatgaagttagttagttcggtattgactattcatgtgaaaactaaccagctcctactaacaatgttacgctcgactttttacacatgatgacatgaacatagtattactatgggcagatcatccccagtacttatattaaagactccttatatatagaacttatactagctacctgcctgccatctttgttagtaaatcccgacatcgcaatcacacaggtacagtctttttctttctccaataactactacaagtagcaggctgcaacgtgtgctagatccatcaactcttgcccgcgtgcactgaatgcatacgcaccaattatttggaccagacaattggttttattgggggtgtcctctgtgttggccgggttggtttagggtccagggcgtgtccggtttgctaaactgggttaatctctccttgccagatataaaacgtgtcccatgatcggttttcccttcggccttatcctcccatttgcgatgatcagacacatctatcgtcctcccatttgcgatgatcagacacatctatcgtcctctgaagatcgaacacatgtacacttgcccatccgtctctgtctcggcatcaatgcaaaatatgattgatgaggacatgcctatactgaatgaaaccagataaacgtggttagttgcatatcagcatatgcatggcacgaattaatgaagggtttcctctcgccgtgcaggtacatatatatattaactgtgtatggattaagggggtcatacctttaattaatttattggttttgaattgatagatcttgaaacgactgtaccctccaaaaggaggaaaaaaaggatctttgtgtagtatcgttttcttttgtggcgtggttgtgtttactgtggcggaatcggagcttttgtgtcgggtgtggctagccgaacaataataacccataacaccttcatgtccgtttttgcacatgtgattgatggttgacggagctatgggcgaaagccttacccccggtctctgactggtgttggcaacattggtgcttgtgggcgtcgtcttcctccttgaagtcatcattaagtggctctctctttatccgggtgaaaatctagtctagtgttctcaatgggtgttggcattattctagatgtttgttttccttcttcgaggcttcatgcctactccattagtttatgctccacggtaggggtgtttaggtggtttgagatagttgtttgtcagtcggaactactcatctgttttgtggtaagactggcaacaatgacatgtgtcagtctcagtagtggtgccaccacaagtttatcttttttttttctccgtgtgggtttaatttgctggttttcctctaattaatagtgcaattgttaggttttcacgtcgggttttctaataaaatggaccacctattttttttcttaatttaaaatagaaaaacttcatatcctgtttcttgaggtttaccttaaaaaagaaaagaaataagatcttggaatcactttggtcttatattgcatcattcgtaggttcatgatcgatatcgtgtcctccactgcttaaataagcgtaggttatccggccaaatcatcaagtccttggcaaaaattatttgtgccttgatctttttgttcattaaggactacaatcggctggatctaccatgcacgtacaggtgatttatgacactgcagtccctaactagttggtacccggattatatattattacttgcgagttattcattgtgtgtagttatatttataataccatatttttcactaaaataaatagtcagcttgtatttatattgtaagtttctaaattatatatataatttaaatgcatttacaatgtaagtcccaaaattacatatgtaaagaaaaaatcacagcaagcagcacaattgcatgaaaagaaaacgcaaaagaaaacgatactgatcagtatcacagcaaggagtacgaactaagcacgcgtgcatgcataagtacaaactagtgtttgcacgcacgatggcaaagcagtcctgcacaaaatctataaggaaattggagagctaacaaactgaactttaatcagagaatatttatggcgatataattatagcaaaaccgtattctttttgcgaaatggaagaatccgatcgagctagtctccccacatgcgtaggcccgtaatatagcggctgggtttaatattgtaatctgcaagaaacgatatgattttacacgtgctgaaatcgcagcgcttcgatgtttataattctcgcgagaggacaaatgttcaaacaaatatatgtgaagatgattgttttttttcctccctgtagatcagaaattattacctctcggtatacggtaaacagtaatcccgatctcggctttgtctgcatctcaatgtctgtatatatagtcgctgtagctgtaaatgctgatcacatgaatcccgagcaagcaatggctcactttcatcataccgatcgattaattatcaggcgacctagacatacattgaagctatacacctacagaaggaatgacaggatttcagaatttaatgccactgatgatacctttggttgcagaattgaatatacggttaacataagtatagaagccggccaacagttaggatagcagccaacccccctgactggtacgtagcttgctagttgctagatgtggttgtgtatactacgtatgtagtacaagtctcgatatgattaattaagcgcatggtcagtataagcttaatcgttctcaaaatttccattgcgttaacacgtacagtgcccaacaggtagaaaacgtaccagccgtgttgatccgttatactagtactaccactagcttcggtggccggccggcctcctgcgccgcgtttcttttcagccttttcctggtctccaactgtcccgccgggcttgcggggccgcgcggctagctgcaggctggcaaagcgcgcgcgcgctcgctgccactgcgagctcctgctcgctcggtcggccggcccgtcgctactcgctaggcgtcactagcgccaacccgccacgccagctcgtacgttcgtactgctgctcccccaaaacccaatgcaacgaacctttctactagctccgcctccgcgaccggccgcacgcctcgcgctcatgtgacgcgtcaccctccctgtgtactacgctgttggctcgctcgatcgatcgtcatgcatgcgcgcagcagcagctgcagccgcagccgcgcgcggccgaggaagaaaggacacatgcatgtgtccaattattgagactttgaggcggggaaagcgcgcgcggacacgccggacagcgccccgggcaggcacgaggtagaccgcgacaattcggcacgaaagaggtggccgatggggtgagagagggtgaggccggcggctgtcccacgccacggaacagtagcgcgcgcgcgcgcgcgcgagtacgtcgtcgtcgagactggagccgggcgggggcgcgtgacaccggccggcccggaggcggggcgataccgtatagtaccgacaccgagtgcgacgcgtcacggccgcgtctgcatgcatgcctgcgcagagaccgggccgggcgcgaatgggaggagttttttggaaacgcatgccgatttacggatctggcgcgctgggcccgcccgcccttttccctgaagctctgtagcgacgcatgagcgagcagagagggtgtggggtgatggcgatggatgcgggcgcggccaccgccgctcgtcgcttcgctggtggcgtgcaggcaggcgcaccgcgcaccgcgcaccggcaacatccgcagacgcggatagcaacgggcgtgcatgcggcgcggcgcggcgcggataaaaagggttgttgccgccttgccgggggcccgacggtggtggatgagtgtggatgtcgggcttctcggccttttgcctgaaggaggcgccacatcatggagcccagcatggacagaagaggctgggcctggcccgtttgaacttctcacagcccaggaggcaggagcaacgggccctaccccattgtgtgctccacgcaccgcaacaaggccgagctcctgaaagggaaaaggaaaaagagggggcccaacctcaaactactacaaccactgttctaaaatataacaatagcataatactataagcattacaaattataatattagattgtatctaatccatataagattacaatattttaggatggaggtacttttttacagggccagcgaataatgttctagccaaatttactaagagcgagtggagttttatataggaaaaagtacgaattacccctcgaactatcgcggtcgaccgaattacccccataaacccgaaaaccggatattcttcaccccaactatgcaaaccggacgaattaccccctcgacccaatctgcggtggttttggtctacgtggcgtacgcgtggcaatccagtcagcattatgtttataaaaaaattgtgggactcacctgtcatactcctcttccactcttcctctccctctcaccctcctctctctcacgggtggtaggcgggggacagagcagcggcggcgacaacaggggatgagggtgacgtggacaaggatggcgacgg

SEQ ID NO: 37550 - DNA, 7525 bp, Oryza sativa
ccgccccgcctcctccgacaccgcgctagtctcgcctcatccgctgtcgcgctctcctccaaaccactgccgtcgcctcgcctcacctcctcctccgccgcgctcgcctcacctcactgctgcctctgccgtcgcccgtgatagagaagagagagagagagtgagagattgggaaagagatagaagagagagagagactggcaggtagggtctgcctacttttttataaaagaattgttgactggactgccacgtagaccaaaaccaccgtgaattgggtcaaggggggtaattcatccggtttgcatagttgggggtgagggatgtccggttttcaaatttagggggataattcggtcgaccgcgatagttaggagagggtaattcgtacttttcttttatatgtagtagtaatacatttaccaacaaacatggtttgtgggaaaaaaaaataccgcgacatgatcgacgtctatcacgcattgttggtccggatataatgatgctagttcctatgctgaggtgctcaacgaggggttaaatgccctctctttcagaaagaaaatgctacacataccatgttttcttaccacttttgctacgcatacccgtgaatttcatatatttatactataattttgcttgcttaaggttttggcacatttcatgtaatgggtatgtatgtcttgggatataggtgcccgatccccttatggaataactggaaacgtaagctgtaaatctgacgtggggtgcagaagattttgattcctttttggtcttagatcatattttttcaatgcttgccgtataggaaccatgaaaaaataattacctattcgattaaaaaatattagtttaaataacatataagtaaaaaggaaaaataattttaaaaatattataaaatggatcaatatttcatatctctggttgaccaagtacccttgcgtaatgcctaagaagcaaaagaaaatcatcgtcctggatatcccgaggatatttcctgttcgctcggccgcgactccgactccttgtgtggtgtggacctgtggatccctcggagatgttgctaaaaccatttggtgtaattgtaaaatatcaaccatccctttatttctaccggctgatattaatttctcctaattaactctcttaagcagtgttgatttggtgagaaaatatttttattttcaccaatgagataagcatcacatatgtgtatatccctataagatcggtttattcttatcgggtatgtggtatccatatccctgacaagcattacatatgtgtatatccccataagatcggtttatcctcattatgtattttgaatatatttttttttgtctcggacaacgctacttgaaatcgatttaataaaaacaagaagaattggatatgtgttctagattacattgtgcttgcatgttattttgggaaatgagtatgttattttcttttacgttagttggagtgcaatcgctactatggaaggaaacatctttaaaaaatagtttcccttctaatcaaattaattaagtgtgaccgaggtgtcttaattgatctcatatatagaaatagaagaatggctatgagtttgccaaatcctcctatagattgttaaatgggttgtttattttcgtgcacgcccgagcacgcgtgtatagttcatgccccagtaacaacacgacccatttagttgtgggtcgtgctggtacgactagtctaatcatggtgtgcttgggctgctaccaggctagcgtaccaacacgacaattgcatatagcaaaccagcacacacatggtctaggaatggtaggacgcaacctggcccttgtgacatgatggcgactgacgactggtgaacaattgctagttgagcaactgtcgtccgaacaagagctataaagaaaggaaaacgaaagaattgagaaagctagggcttgtgttagaggaaacaatggtgtgagcttgccgacgtaggtctacacgacaacgtggtaacgcggtctacccttttcgtgagcacaaccactaagcgtgtcagccattgagagctcactagttcggggtgaaggaaatagcaagtgaagggagcttgacgaggaggaagatgaatgtgctattgtgagcggaggatcttaccatagttttgttgaagtttatgcgataggatgcaagaaactctttcatagttttttccttggtatattatcaattttgtgctaacgggttttcacacagcccacgtacccaaatgatatctcacaaggttgtgcctggcctccagcttcaacacgtgggtcaatacagtatgaccgttcgctgaatcgtgctactgattaatagggcattgcccaaacatatctatttatccaccatttcaaccctataaaataataaaaataaaattcaccgtcttaaaaattcagctcagaagttccgtttgaaaaatgggattatttccattttttaaatttcaccgtttggtagtgtggggatgggatgtgcaatccgggtggcggaattactaaattaccttcgccattttgacgtgtagttggcctctgtcgtcagtttgcccgccgccgccgccgcctccgcctccgctgaccgcgagcgagcagggcgccgtcgttcgtcctgttgcttccgcggttccgccgcatcctggtgagtacatcctccgccaccgccgtctgcgccgatccccatccatcgcgcgagcgagcgagcagggtcgccgtcgttcgtcctgctgcttccgccgcatccgttatgcacatcctctttcccatctccctctacccacgcactttttttctcgaatttgcgttaaccctagcttctgttctagaaatttgctttaaccttaatactcataacagtttgtttgttccccaaaagtttgggggtttaactgaaccacgatgtcccatgttagatccgccactgcatgcagacaccttccctgatgtttctctgagaaactaccccccccccctccctcccttccctctgttctccagagctacatagtgttatctgaatagaagtattgttctagagagaagaaggttttattgaaaatttgatcatctataattcatattgttctagaattcatctgtgatttgtcaagttttaagtgacgtgtaggtggatatagtttcatcaacatgtacaattttttttttggacgttctgcatgtatctaacgatcatataactaccaaattgaatctatagtcacacttctgttttgtgttattagtggttacctatatcctttcctattgcatgcagcccaagcttgttggcaccatggatgaatcacgaaaaagagccgcatctactgcaaatgctaaaagttcatcccttggtatgatacaatagagcatcatatgccttgttgcttttatgttgcaccttaatcaaatttatctgattcatgtaagatgaatactcctggtatgtaactgtttttgaatcaagttcattgtacttacatatgactgcctgcaggaaattacatatgttgctcatgaaatgcatattttttttaattttgtgcagtagggtaggaaatatttcttccttttccatcgtaacaacttgaaatggtgaatgctttttaatgtccgcaggtgaagattttggcaatgattttctttcatcttggaaattaccaaaatcaggaaatgacacgattgactttgacgttgagtcagttccgaagaatagcaagaaattcagctttgacaacctgtgagtattaggcttgaaagtttcctttagcatatgatgccgcagtaattgggaatgacagtatgtttcttttatcagggatgattttgggcttgatggagcctttgacaaattgtcgtcatttaaaatgggcatgtctgatctagatttctctggtcctctcaagaaaaaggtgaagcccaacaactcaaatggcaacgatctttctgaagggataaaagggactgaaaaggacaacttctccttttcctttgatttcaatgagtaagtttttcagtgaataattttagtgagtaagttatattggtgaagaccaataaatatgacacaaaatcatgaatttagttgcttcattttctttgttttgtttacttgaaggctgggcaagttcaatcttgatgctaacttgggaattgaggagaatggtatgagtaaatttgtagaaaaggtcaaccctgtctcttcagagggtgacaaggatccaagaaaaggtctttcagttaagggctctgatgttctgggaggtaacattagtaaggaacaaaagcaaacacatgatgcttgtactctgaggcctactcatttgggaaggtagggtaatgtaaagaacgataactgtgcagcttcaaacattattcctctaactcatttgacggtatgcatgattttttcagctttagccctgcaagaatggaccaaaataaagtagatttgctctcaactgatacacatgaagagaaatctaatgagacacacccatcaagagcagctgttaacaagccttctcagaatcttccttgcagttctacacctggtgaagatcctacacacgtgactacaacagcagttgctgagaactgtagagaagctcctttggtggaacttagtaaagttcatatatcaagggggaataatgatagtgggcaatcagttagttcacaattcatgaacaccagcaccacgtgcccctccatctcaagaaaattgacggcccaatcagattcccaaaatgaccagaatgagattgtgggggaaagtgcatgtcttaatgcacaaagtcctgataaccaaaggtttagaggaacttcaatgaagcttctgaagaaaacatcatgtgaaacaaagaaggctgaaaaggggacttcaggtccaaagagtctctcttcatcaatgcagaggtttgtctttgctataagtttctttattaacaacataagacctttattcttccattcagtgcttacccagtgattattttcattaacagataatgtatcttaaatcagatatcagtaatgtaggattaagtgtagcatatcataattctgcttgtacaagggagttcttttcctttatgtgagccgagatgtaattttgtacagtgatttgttaccatgtgacactattatgataaatatcatgcagggatatgagaaatgtcaaacccgcatcattgaatgaagcagggagtttgtctcttccgccccagtcttcaattgttaaagcaagcaggcctcctcaactaacttctgaaacaaccttaaatcaattaagtagtgccaataacatggtaaaaaagatgaatacacattctactgagttgaaaaggtagtagactgtagacagattgatggctagcatgtactcataaaatgttaatactgtatcaaataatgaatgtgctttataaaatgcagggaaagcacacaagctaatgcaagatctgaaaggcctaaaattgcttcgtcaaaaacattctgcaagccagcattacatgagctgttgaccacctccatgaatgccaaagatcataagaattccaaacttaggtaagaaactgctgcccttcaaccttgcaacatcaggaatgtgtcggttcaaaaactttattataatggtgtttacttaatgtatgcacaatactgctatgttttcttcataattctgatctaacattttaacatggacatgatagttccttgataatttttgtgtcccgtctagtataaacttgagtaaaatcaattcacaagaaacccactataaaggtttggtgtgtttgttagcgtatttcatggaaactgtaaatacctcacatacttttagtatgttttcatggtggatgtgtttgcacttggaataggtgtattgaatagaatgcatgcgcactgcatccattctacttgttttcttgtttccagtacagcagaatgctctatatttaccgtattttatccccttgatccttccactgcattgatggttaacaagcttccttttcccagacttgagtctcctagcacaggcaatgtttctacactgaatgctcctagcagcccagcacatagcaatggacataagaccgttgcgagtcggtcactcttgggaagtaccaatgtttttgatgcaggaaaaggcactcctaaagctgacaatagaccactttctcaactgaaagcagcaaagtatagtatctctaccatattgcataaattaggaatttgaactattaactgtgtttttctaaacatattgcataagaagtgactgaaatcatctatatgaatgtagaattactaaagcaggcaccataagttcaaagtctgacttgcttctggagaaggatatgatggaaacgagcgggaggaagggttcccctgtaacaacatccaataacccaaagtcctatggtgaaggaaaatatgtgttgcctagcccatccatgatgcaaaagactcctaaggttattcactggtgcaacattatgttttaaaaaatcatttcctttttctcctattgcttgtatccctgtgtggtttaaccctcattgtcttcatctgaggattacaactaatactttttcttaagcttacattttccagactcaaaaatttgatttgtcaattcatatcaagtttgttgtttgtaactttgtatgtgcttatttcatatcaaagtttgtgaggaatgttatgcccttccacggcataaaaattcaccctggatataccaagtgttaaaaagtacatgcagaagacgatatccactcatggtaagagtggtagaccatatgtaatagctcaaattcctaatttatgaaattccatgtcatactgaagaaatccatcatgcccttatagaaaatttctatgacatctactgacttctgtcatcaactaatctatcaaattaacagacgtgttaaaattgtccaatcctaaaagcatgaagcattaatccacagatgtaacatttaagttgtactgttttgagtcagtgattatattacgggtggtagttttttacttgttcatctttaagcacagtttcacagggttttaatggactgatttgataaatgaaatatcctgcaaaagtcagtttttaagcaaggtttttatctgcagcaaatttactaagctattgataaaagaatacaattttttatgtacatttttttaggagaattcgctattgttagttttttgtagtttgttcatattgttaatttgccttctcaggaatcagcttcagatccaaaagctcctgctatgctgaagcacatcatgaaatctccagctgtgaggttgttgtttcgattgcattttaatgcataaaaatgtatcttgaatattctagttctctcttttggaagtaatagatttattttaccatgcagaacatcaccagaaactgtttcagagttgggaaataaaacagtaagtgccatgaatatatctgattactgcat

SEQ ID NO: 37551 - DNA, 2005 bp, Oryza sativa
tatgcaccttttaactgatatatgcgtaattcaaatttggattttggatcacttaagtttttcacacaaacctatgaaataatgttttactgttgtagccagaactctttagatgtaatttcctggtctggagcggctgccttttattttattttcctttagctgacctgttttttttaccataatgctgatatacagatgtcatcatgtaggcagtctaaattaagtcaccacctgatggcatgagaaatattctaacttgcttgtcttactctgcagttatgcatttcgttgaaaaggaaacatgaagaagccaaagagctagcagtgcgggctattgttaacaacaatacaatgctgatgttaaaccatccaatgtttgaggataaaatatcctactgcttatttttttagcagttaatcactgcactttcacatttattaatattaaactttttattccttaaccataattaacatttgtgctcttcagaaatttgctagcaatctgagatccaagaaggttttattcgaggatattagtgccattgatgctgtaagttatcaatctcatcccatttctcgatctctgtgactgaccttaacataattattcccacatgaagataaaagaggaagtgatattttctaaattaactgtgttgaaaatcctattagtaaaacccactatgatttgccttagttatttactgtagagagagttttcagatggcaattgaaaaacaatacccaatcacttgaagaagataaggtgatggatagtaatgccccatccttggtgtggagattgccgcatttcattatctgcatggagattattatgagcctcacaccaaccgctcataacagagatactcttgattttcaataatagtcatctctgaaggggccattgtgtatgatgattcctgagtgtctgagcaaaatgatggaatgactgtcttagaggcctaattccctcttttcagtatctcattcaggatcctccgttcctatattcaatccattcaaccaaacgctttaccttgcaccagctcctccagagaattaagtgtggaaattcttgtattataagcccatcctaaaaaggccttagtggaatagtgggttagatggtttgagatatagaacactcagatatagaacaaatggtatattcagattcatgttctacaataagattcagggtactatccatgtttgtattcaagtagccatacagggaagattatattcatgtaattaccgggaagtgattagcgtagtaaatgcatgatttttgtctatattagtagtgcaatgctaatttcctatgcttttagaaaaaaaagatttggatttttacattattcagttctaagttcaatggaagcatcagaactgaaaataaaagtggatacgttagcatgaaacactgtgctttcctcagttaaatattcttgtaatttgtcttagatgatctatctgtcatatttcataagaggtgctagacctttatagtgtgatcaactaccataaggattatggcaccatctcttgttctatttccccattggccattcccatgtctcctatacatgtatgcattgtatattagtttcttatcatctctgattgaacagtgagtgttttcagtgttatattagtgccacctaacttcgtattacccaacttgtcatatttctcatcgactgggatatatatttttttcaaaagacaagatagtctcattgactacaataataaaatgaaacacatgatggcttttatttgtatgtgcatttttttaattgagcaacagcaattgtggtttgtgagctattagcctcatagaagttttgtcaacgccagcatatgttgacacttctgtttccggattcttaagtcaacatacttctctatctgacttgctcatttagtttagcatttcaggatttcgtccataaggatattattttatttagtagaattgtgtgtgctacat

SEQ ID NO: 37552 - DNA, 4686 bp, Oryza sativa
gtaaattttatcaaaattgcatcctcgtagaagtagttacactctgttagttcaagcaacgaatttctgaaccaaaccagtatttttcatgactgaagttttcttcaacctcatcattcatagctaactcaatttctttttatcttgttgcagcattaatgtgagactaaaatggagtgactgtgcttcacccaggaagaacaccggtactgtaaatgcaatgtaagaacgtacgatccatgatttgctcctgtgaaggcatttgtttagttagtccagcgggttgtgaaatacccttcctagttgctacacacctgttattctgggaagtatgcggaatttgtacttaggaattggggatgactccactggaccaagagcagagaaaaagaaacacggttcaaggggggcatgtgcgcatactttagttcgtaattgtgtggatattgctcgtagcgtcgtgaactgtgtccttgtggaccgaacgactagagtaccccttgttgttgatccctggtgctctatagtctgtcctgggcaaaatgcgattgaagaagtgctattgcatacggttttatgccatggacaaaaattactcagtaatggtgagtttagacaatgatgctggatgactagcgtcccatttcatcgtagcctagatttgtaggatttaaagtcggttagctttgttgcttatgccttttagtacgttagtgccacgaactggtatatttaggcattttagtagtctacctttatacaaaggaaagagaaagaaagaacacccaggctttagttcgtttttttactcaaccatgaaactgtaagcatgtgtttggttggagggacggtatggattgggttgggtcaaacctagtttatacaaaggatcttggaaattttccttggagtttatctctcttatccgattcctatgttttttctgtggtccaatcaaacgttcattcttgtgttgtgtttttttcctttttttataatcctttgttttacatttccattcctatcagaatcatgtgttttttctattacgtctttttttcattcctgcaattaatttgggctatgtattgtccccttaactctcaaaatcatgcatatttcatatttacctcaagtaaggacgaagttttagtgctcattcggtttagaggattttcataagattattataggaattgaatccttaggattttttttctatatgtataattcgtttcatagtaatggatccacccaaattcctaaggattgtagtcttacaaactaagttcatatgattcttaacatgaagtaaaacctcttgggaaaactcataaggaatggagtgcacgtgacattctatctttatttttcttatttttatatgaaaatcctatttaccgaataatcccttattatgcctgttttgtattctattggaggatgaaaataatgcccgattcttgttagcatatttttgcatgtggcggagttggctaacattgaaatctgctcatcagcccatatatcttgcaatgccctttctttctttctatatttggcaggtggcaggccttattttcttcccatgttttaatagggttatattctccccttatttaatataatctgcattgttttggtccccttatttaatataatctgaattgttttgggaaacataagagccaaagctgacaacgttcttttatttaatattactagaaaaaatgcccgtgcgttgtaacgggtgaaatctattttaatcttattattgttatatagtttagttaagatgaaattcactgtgagatctcttggatatatatatttttagaaaatcatgagctgcagttaggagtctgatcgtttcaagttagcatactagtttttttaaatagatttcttatatgattccttctgtattaccaaaagtgaatatcttataaattgactcaaatacggatatgtattttcaaaagcaaacgaacttaaaaaccgactcatagatgacgtatcaaaataccggtaaaaacatcttcaattttcaatttttataatagtagagataaaaaacaaaaggggggggggggggggagggggagaattaagtggaagacaggttatggatatttacggaggcttaggctggacaaccagatacacactaacagcactaccaatcgaaatatcgaatggtccactaaagctatacttaatcataccgtacgctggcaatcttctcgtggatcgaaagtcgaatctgcttgagttacaacctgcagcaactgatgctgcgtgcatgatctgatctcaaatctgtccacatttctcaacggaatactcccattgccccctcctgatgcattgtggaagccaacgcccaagcaacctgcctcgtgcgttacgtccaacgttggactctcctttatgttagatttgatggatgaaaggaaataaagtttttgggtcattatcggtgagtataagaggcatattacaccacaacacctaatagaagaaggttgttttctgacggtaaaaataaaaataaaaatggcgctactcaatctgctgaaaagatcttcaatacaccgttgtcggcaaaaatcgatgacagattatcgattgatatatagttgtatttactgaagatctgagtgttgtaggtcgtagtatagtggtactagcaaggttaacaaaaccgtacggtcactgtggttattatatgtgataatcttttcagtttttaaagccacggtatacttcacgataaccgtgtggttttcgcggttaccgtgataaccgtcaaaccgtgaggtgacggtaaccctatccaaaacggtttattaagccctgtgttatagttcttgatggtgccaatgataaccgccaaaccgcggggtggtcgtaaccccatctaaaacggtttattaaaccttgggtactagtactcgatggtgccaattgttgggacttgtaggtactgtgtgaaagaactcatgttattagctagtcataaacattagatgattaagatttgatttaaaatttgaaactttgataattagtactttctcaaatggcgtagttttaatagaaaatatgcgcataaatttgtgttgaagaatactaacacaacttattaaactttataagcttattctgatataaaattggatgttaagttttacaattttgaccaaattttgttccaaacacaaatgtttatgacgaaaatgtagtataacgtatatactctcctattctctttttacgtatcatttaggatattgacataatctataatgtacatatttgattgtcctgtgttcgactccccatgaaaacgaattggctttaacggctttgtgttttcagtggtaggcgatgtacccgtcgacagcaaggcgtctgtgttgactttatcaatctataggatggatttgccggcccagtcttcgaagatactcataggggtagagtttgcgtgcgttcataggggtgagtgtgcgtgcgttgtgagtgtctgcattgtactgtgtaattctcaaaaaaaagtttatagaagaatctaaaatatcaaattaattttattaaatctaacattgactatactttcataagtttgtcttgtattgaaaaatactacatttttctataagtttggtttgactaggtaaaaagtcaaatgctttataatatgaaaggaagggagtattttagaagcaaatttatcgtaaaactacaaacttagaagaatgtctatcacaaaaccatatctttaaaagtaaatttataacaagactacacatgaaaatattggttaaagaaactacatatttaattagtgatatttttttcacaaaactacatatatattctaaaagttccataagaacaacaatgccaaagatctaatatctaaaatatgcggttctctcatagctaaattgacaatcgaatctttagttgtatgctatattgtaccttaaatacgtagttttgtaacagtggaacttaaatcagtaattttgcgatacatatgtcatgtagttttggaaatttgctacatttaaatatataaattacttgtataacatttttttcaatttatacaaagaattatgcagtcaaagttatatcttccagttggtttactctcccctaatgcttccttttcgaattgcttcttattcactgcagtggaagattttagggcgtgctgaagaagctgacaggatgatggatttagaagagaagatgaagatcgttgctgctaatactggaagtaatagattggggataggttgattccttgtttttagagttgtcttggttgccacagttctgcctgtcttctgtcttggtttgtcttggttgtgtgtttcttatctgatgtctgctatgtttagcagcagtccctactgtctcttttgtcttagagttggtcttagaggtggtagcttgctcgagtccttttgcactttgttagaggtctcgccctccctatgttgtaaactaatgtctggatttcccagcacaaccttcgggctttcaatagaagccaggtctctgacctttttctattaaaaaaaagcaacttatgactaaaggatcagactttacaacatcgatatggcgtggacgcctatgctagaacgacagctaaataaactacatgca

SEQ ID NO: 37553 - DNA, 829 bp, Oryza sativa
actactagaaaaacgatttttcagggcgttggtctatgatttttgctggcggagaaatgccaaaaccgctagcaaagtcataacgagggggtggggggcaccgaccgccagcgaaaatggatcttcgctggcggccacgttataccggccgctagcgaagatatgttcattttcgctggcggttgggttatatagtctgataggaaagatacaattatttatactggcggcccacttaagcaaccgccagtgaaaatcgattttcgctggtggtagaacaacctccatattttagcaccacccatgtgtccttatccacccacctcgggattttggactatttgccattcacttagatgtagcattcccaaatgccatcttcccaaataacttagacaatttaccccaggtccccacaaaccagctctcctctgccattttacacccaattttaggtcccacggctgccacatcaccaaccaaggtggcactgagagcgtgaaatgtccatcttacccctgcccctctcactcataacacagcctcaccacagatccctctcttctctcgttttcagtcgacctggtctcactcctgcggcggcggcagcggcgctgtcgattcaccggcgacggagctgcgacagccaacgaggtgtgagataaatccgtttcccccttctctttttcagtttggcaacaatttgtctcagatttggttgtttttgttgcagattggattgtctagggtttggattttgggggttatggctccatctgagtgcccgccggggtaaggcacaaatctcatcctttagggctgcaggaat

SEQ ID NO: 37554 - DNA, 700 bp, Oryza sativa
gtgctcatttctcaattcattgatagatttgataccaaggtgatgaacttgcttgttaatataatggacaaatcagacactttagatggctccaatactgctatagctgctattgattctggctctgtagtgaatgatgatcctcctgctcctgctactcatgctgctggtccttacaatgttgttgctcctggtgctgtcggtgcttataatgttgatgctcctagtgttgttgctcatggtggtattgattgggatgaactaaacatccagccattgacagttgaaggtggatcctgtcatgttacatttgatgaggatgagatgtttgacatgctgggactaggtggttctgatattggagcagatgaggcaacaactagtcagtttccaccagttgacctagagcaaggaatgacagaagcagctattcctgtgaatgatgatgtgggtgttgagccaaacagggactgggacagagatgacccaatcatgaatgtagacactatttacccaaaatggctgtcaggcaatatgccatcaatgaagaatttgagcttggcactgagaagtctgaccctaccaggtttaggggattctgtacagcagatggttgtcaatggaggattgttggcagaactcaacatgataagactgttagggtataatccctgttgttaatttttgggtaactacttgt

SEQ ID NO: 37555 - DNA, 32384 bp, Oryza sativa
  unsure (1)..(32384): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaattggaagtcgaagctcttcaccgagtttgtcaacccgcccggcaatcatacgtcgttcgatgaataccctcaaataaccgaagcggtgtgggaggaattctgctctctaaagaccacccaagagtttagggaattaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgtaactgggcgcgggcaaggggtaaggtcaacccggacggctctgtcacatttgagaacaaaagtgatgccatcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacgaaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgtagcacagtgtgtcctactagcgagagtccacccaactttcgctcctgaagtcgctgagggcatggctttcaagccctcggttacagacaaggtccacggtgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaataaatggagctaagcaatgccaagcggaaatgagggagtcatccatagttggacatcacgaccaccagccgttcctatcgtcgcctgcctatataactataggctttgatgacctcttcaaccttttcaggatccgaaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccctcccgctatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttacgttgtactattaatctattttctctttttttttcccttattgacaggttgtggaggtcgagtacattatggctttaatccatttggtaagtatatatgcggttctatgagcaatgaccgaaattgtggctttcaagggtggtgaatttgctgtgcaaaattgtggcatttgaactgcatatatgtgttgttggggatctgtgatgtttgagatggatctgtgatgttatattgggggggtgatgtatctgtgactagaatatatctgtaatgtatctgtgtttcagagggcatggctcgcaaatcctgaggctagccaatatttagcatttattttttttctggaattaactcatcagtgacgggtcggaacaaaaatccgtcgaaggtaacctaacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctctaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgagattgccatcgctctgattgcatccacgagggggaaaaaagatgcagctgaaggcgcgcgttgataagggcgtataactagctggtagtctatatgggcataggactaccctagcttttagcccaagaccttaaccctatacccacgaagtctaataaagttctgtgatatatagtgattttcatctttgtaagatttatattgttaaactgattcacttaagattgcatcaagtgaagccttaaaacagtaactgtattactccctccatcctaatatatatcaacctagaactagataaacacattctattaaaaaatctagatgtgttccacacttgcatccagttctatattgctatattttgagagttgggataagggagtatatcataatatgctactctctccgttctaaaatataacaaacttctaacatttgaaatttatcctaaaatataacaatttttccacctatattccttctcaatcaattataatatttcaccgttcaaattttttaagtattttttcctcttaaccaattacaatcttctctcgtttaattttacttgtgttcttaatacttgtgtgtaagtctaaaactcatattttgggacagaggtagtatttacaagaactaagttgtattagtaaggaccacggcggaaggtaaatgatttcctattgtagaaatgaatatctcatcgtctatattttagcttgtatgcatttctcatttagacatttttttttcataatattatattattataattgatacctactcagtagggggtcacatataatctttttcgtcttttgtaatgagaaataggactacccaatgaaaaattcctggctacgccactggtgttgaatgcggcttatgagctttgagatggaggcggtagtgtgtgagctctcggatggaggcttgggtgacagtgtgagggctctcaaaagcattgtaaaaatagataatgaacataaaagctctcttttacatcaccatcaaaatctcgctctgcacatatatttatataggtcttataaagagataaatcgtatctgtactccgatttatagattaaaaaaaacctatcttatataaaaatttgtttcacaacaatgggtttggttcggtctgtggtttgtttaagagtcaggcgtatctgatgggtggtctagggaccatccaaaactacatagctataatttagaaaagaaaaaaatattcttgaaaagagaataaatatttttttgcaccagtaataattagcaagtcgtttattaatatatcacatggtatatatttttttatcaattatatattttcgttgtatacattttatatttatgacacttaaaaattttaaaattatgtaaggtggaccaccatataaaaatgcttcacagtgagctgggttggacttggagcagtttttggatgacgatctagggcgtgtttggccagtgagccggctattttttttcaacggtcaggctgttgccttcgttttatatgaaaaagaagatgttctattttaagaaaaaaatagaaccaaaacttacaatactacaatgcatagttaattagagaaactgggcgaaaaccacaactataaaactcaaaactcttagggtctgtttggggagcttaagattctaagaagtagctgttaagaagctagctggtgagaatctggagaagctggaaaatccagcttctggcctctagttcattttccagattctacaactacaaattctcaaaatcttggtaaaaaactggactgtttaggagagtttctggcaactgaagattctagaagaagctgcagctgttagaagctccccaaagggccttaacaacctatcaagaccctgaaaataaaggacagtcggagcccaaaacaactgtcgataaaaggccagtgaaccggccttgaatgacgatctccccaactctcgatctcgccgccatcgtggagcttcccctcgccacgcaacgctctccccaactctcgccacgcaactccaatctgcccgccaccagtccaccgcgccgcctgctgtggccgcgatggcgtccactccgctctcgcttgcgggcgcctcgtcccgtctctggctttgacgggcgccaggccatccatggcccccgcacgggaggtgttcgacgaaatgcgcgagcgccaccgccgccatgagctgtttggcatatgctgggaaaaaaggctattcgttttactgattgagttcgcctacactctcgtagcatacgggagaaatcgattcgtttgtctgtttgagttcgcctaaactctcatagcatgggaaatcgtggcatcgccaggttgagctcgcaggcctgctgtatgccagcgggatgcttctctctgtcaacaattttgacgttatgggacctgtaaaactgcaggcacaaattggacgtgttccggaggaatggcgtgcacctgatgatcccctcttgggttatggaatctggttggagacgcggatgagtggaacaataatttctaccaagctctaagcaagtgagttcacatttcccatcaagtttgtgagttcgtatttgtgcatattataagattgtggaaccagatagcgctttcagctttttcatgaacattttttaccttaagttgtagtgcacaaaacaaagctgcaataatttgcgcaaaatacaaagtatttgcctgatgtggaagacatgggaccagagatcatgatggttgtaggcttctactcactaggagactccaaatttaaatgggctgacccagttaacacttaacagttaaaaacatgatagtcttcgctgctgtttttctaaggctactgctattttttaacctatttttcagtaaaattgtgttgctgatgtttgtttaacatatggtctaacaaatttgctttgttggatcctcctagaactccaccatttatggttctaacttttgacacatcaaatcaacttgagtttggtgatcctaatatttatctggagtttaacatgtaagctcgtttgaatttgctgtttctagtatcgaatagacaagaccaaaacttaccccaaatttacttctagaaatgccatctatgcataggtatattactagcaaatttttcacacgccatcctttctgtacataagagtttgggtgaataaaggatgcatctccttactttggaacaaagttgaattaagagttttatgtaatggctaatctactgttaaattatgttttattctgcataaaatcatttcacgatatgatgtgtatcataatggtttaagaacaaattacttacaaaataacaagaaatcctttctatatggtaaaaaataacttctttacttccctgaagcattacaagtgtccatcttagtcttttcatcttgaccattgagcatgtaatattggctcatttcgctttctagtgctcatctgagaatggttttggcattctgctaaagttaggttgtcatcatgggcaaggtaaccgtgtgaactgtatagggcattcgatagcaggtaggggtgacatctgtagacagcagccaacaggtaaggcagtgggttactggggtgcagttttcgctatgggatgtgtcagtgttggttttcagatgacatgcacggtgcataactattgttgaaacccacctaatagggtgaattaaaccaattttagaagttcaggaggcttgcaatatatagttctattagtttcatggaatcaacattacttcaaagtgaatattagaaaatcaaagcccacattgctttcagaacatgtactagtggtgctaatgtttttaacgacatactcagaacatcaccgaaaatccaaaatagccagaaagtattcttttgatgctttctgaaatatacttctcaaagaacgaaaaagataaaatataaaagtagtaataaaaggtaaagtacatgaacctgattttcctgtaatcattagccacccatttcatcttggaccagatagtattgattcttgaggtggagccgaatatgtagatgggttgccttgagcagatattactgaatttgcattgaaaaaactgtaatctaggcagttctccacgctcattgcaccttccaataccttgacaaccattgacatagaaggcctccggctgctgtcattctgcaagcaccacattgcaagcttcatcatttgaatcacttcctcctggtgtgacaccatgtcattactgtgcttatcaatcatatcaagcaactgatcgttttgagccttttctcgtaataggttgatgagctgaacactctcctcgggctgtgagagatcaatatttttccttccacttattatttccatgagaacaactccaaagctgtatatatcaactttttcagtgatctgcgatgttaaccattcaggtgccagatatccaggtgtgcctctcatcactgtcactaccttgctttgatccctgtctattagcttggaaagtccaaagtcagccaatttagcattgaaattctcgtctaaaagaatattctgtggtttgatatccagatgagcaatttttcgcctgcattcctcatgaagataacataaacccttggcaatatccataatgatcttacaccttgtgcaccaatcaagaggagcattgttgtggcggtaatatatccacctatcaagtgaccctcttggcatatattcatataccagaagcctatttgatttctctgcgcaaaatccaattagcctgacaagattgatgtgctcaatgctgccaatagtctcgacctctgccaagaactccttctttccctgtctagcaccttccagacgtttcaccgctacactctcttcacctatttttccttcgaagaccgatccaaatccaccttcgccaagctttttactgaaatcttcggtgcattctcttaacttttcaaaagagaaccgcgttggcattccaggcaatatatcaaattctaattcttcatctagttcttgatacttcctcctccttcgtacatatatagcaacaataacaactaaaacaagagtagtaattgctgcaagtgtagcacctaaaattgtcttcaattttttttgtgtagggtcagaagagggagtaatctgtacctttagataagctgaagagttgtaattaaccttttcaggttgtattgactgcaaggagaatacctctgtcactgaccggcattctccattggaatcattctgaccatacctgaacgctactgctttgcatgagcaattcttcaagcaggcttgcttgcagtcatctctattttttgcattcatgatgatttggctcatatcaaagtaagaaacatcagtaagagtcaagagctgatgatttttgatttcttgacaagatactggtgtcactggtgcacaaccaagattagtcttccgctcgtcaactagctggaagtaacgtgaactagaattactctgaaagggacagatgcattgcccacttgtgcatatcccgtactccccgcacactgttgggaaagcacaatcatcaacatgtaggaattccttcattacatcagacaccatgatccagcttggttctccacgagaccactcaaacagcctcaagtgcccatcagactctaaccttatgtactgggtggacttagcttcttggaattggatactttcatctggatttcctggatgtgtggactgcaaaaagatgctgaggctgccatttgtaaaggtaatccttgttggatctctctggctcatgtttctgctcagctcatgcttaaagtatagttgtggtggtgtggattcaacataaccatgtacaccatcacggagaacagttatatatatcttaccctcagtccaatttgtgggggaggcatttgctctgagcatcttgccctgcagcagtgactgccctgggaccaatgcgtcggtgggatgatcaaatgactgccacactgtcatgttcctctgaccaaacagcacaaggttgccttgctcagtgatctccatgcgtcgcacggattggtctgaagtgccgctcgaccagatgagtctgccattggctttttcacggaggaccaggtcgccatctccagtcagctcaagggtagcattctctcctacagggcttgcctggttggcacaccagacaacccgtgccattttatttaccgggaaagaatctgtgtcagggaaaatgaagactgcgaagatgaattcttggcagggtggggtgcagaagaaccctgcggcaaatgagagatcggaggtttgtggtgatcggaggactatggcacgtaccaacccatcttcatatgggacgctgtcaaggactttgtttttgacccacagtgtcgagaggttggcactgggatagacggagcgctgcccggacaccggtggtgcggcaactgcgagcaccacgaccaccagcaccgtgaagtcggcgaagagatttccaggagacatgtttcttggattggaaagggaggagtgaagccagcaagaagctgtggtcagttcagaggttgacaagatctcctgacctgatgacactaagtcgatgagctgatgtggtcaccggaaagatatatggcctcaccgtcgccggcatggggtcgccggactggcggactctgaagtgtttgatcggctacttgtgttctcgctctctcagtacttcataactatatattaccacccggtgctttagttttttggtttcttgggaagatggaattttggcttgaccagttctaaatggccaataatggttttggtttctgcaaaaagatatgtagcctagtggttactaagtgacctcaaatttcagtttggatgtttgcaatttaaatgtttgcatatatccggttggatgtaaaggccgagtaaaaaatatccgtctctaaaagaaataataaaaaaaagaccaataaggccggtaaaaatacctttctctaaaaaataaaaataatattaagaaaatgaccaatcgagtttccctatgttgtcacgtgatttttaataataaaaaaaaaagcacatattgataaaaataagcattaaaaagcccaaaactatatgctacccggtcaaaattagttagcttcagtacggcatgacaaaaaataactagtggttaagccgggtaaaaaatacccttccctaaaaaaattaaaaataatattaaaaaatggccaataatcatctgtgctcaccatgtgatcgagagtatggtgagtagagttaactatatgctcgccatgtgatctagtttcgttacgttgtcacatggtttttaataataaaaagaaaagcacatgttgataaaattagcattaacaagcccaaaactatgtgctacccggtcaagattagttagcatcagtacgtataactagtacggttagccagtgtattatactattggcacaaatgtgtggaggatgggagcgttggctaaaatagagaggacagctggactaacccatgaccttggtccttgggcttagaattgcaaaagtatgtatgggtgagtagaggtaatctatactgcaatatgtagcaacgtacttgcacgaacatgtatgctgattcctgaccgtctggtcgcgaaatctggcggatggaccagattcgtctcacacgatcgtccggaaaaatcacccgcgcgaaccattgatcctatcccaccacgtaccgatcgaccccactcatccaatcgtacttcctgccttgcccgatgacgtacctcgtgcgctgtcaattgcgccccttcctcaaacctccttcggccttcctcctcgtctccttccgaacaccgtcatcacatatgagccccgagtgataaggacgtcgtcactttatacacacttaattaactccacaagttctaatgataatttgaagtctagttcgacctccaagttctaatgataatttgaagtctagctagttcgacctccaaaattagtaccgacttcaaacatgttgaacatttatgctaactccgatttgatcttgaacatgttggaaagcttatctcgttactttttaaacacacccagtctcatatcaaaattcatcctaagtcaacagaaatcatcaaaacaatacattgttgtttgctgaaaccgaacttgaaccttgagtcttataatagattatacccatctaggaaatgcctctctccacctccacaaccagcaactatctctagctttattatcataaaaagctttatacatcctgtaaaacaattgagttttgtttatttgaattttgccaagtgtcattcactttgtctctagtcatcctcgtttaattagtcggtgactatagattcagagtcactaatagttggtgtgtttatttgccgggtcgattagatctaccaccttaattgtaactatttcttgatgcttaattacctattcgcaatatttagattgtatcttatcttattcatgcagtgttctctcgtttgcattgtaggatcatcaaccacgcgtcagggttagtatgacatcgtttatggtgtagcaattgcacgacgttctggacttgttctggttggtagacacgtcgcacttgatcaaagcgagagttatcacctcaccagaagattgtaccacaagatatagcatcattagttggtatcagagcgtcggttgcgtggtgaagattttagttttgtatatttattttttctatctatcatctacaaaattactgtaaatgggtcttctttgataggtttgtttttttttccatcgtaggacatcaatttaaaatatgggtagttttagcacacttgagcaattgagtcaaattttagtacgcttaagcagtggaggcacatttgccattccagtggacgtatggtacgagtacacactaatctgacaaggtcaaagagcttagtagttgttttatatgcaatttgtttgttttgattggttgatttttctttaaaccaaattgcaatataggagataaagaaaacgtagagattgatccagtagagttttaatcgatctgtctaggtaaaagagctttgtatattttttttaggtctgcatgtgtgtttgcttggctttttcttaaccaaattgcaatagaagatagtaataggaaatacgatggatcaacggcacgatttatcatgctatgctataggccctattgatggggggcgcagacactactggagaagtactcatctcttccggttcgcaaccccctttactcccaggtagcgaatcggaagggagaatccgggactaaagatgacagtctttagtcccggtttaaatacccgggagtaaagcttcatctttagttccggttggtaacgacttagccacgtggctggcacaaccatctttagtcccggttaccaaccgggactaaagattttgttttattttttttaatttggttgtgctgcctactgtagaaatgtatagtatagaaatgtatatattacacatatgtacactatatgtatctatacatatctatacatatatatatagtgtacacatatatatgcaatgtcaatatatacatatgtagaaattcatatgtatatacaaatattatacacttaagaggccatatacatatattaacaaaatatgagtttgcaagtaagtaaatatacacatatattaccaaaataagtacacaaaagtaaatgcatgtgtgcatatataaatatatacatgtattacaattccttcggactttgtaatctttgtttctgttactacgacttcctggcattggaagaagaaggaccggcttgatgaataggctttctgaacgtgcagagatgtagcctagaggggggggtgaataggctttcctgaaattttctcaacaatcgcagcggttaaattgacagggcccggaacctcctggtgatgaacaccggaacttctgggcaggatgagtagcccggaacttccggagttcttgagccaggaacttccgggcagcagagataaattaaaactgagatgaaaaacaggtcctagcaagggaagtttaggcacacagaggaacaagatgaagatcacaagatatcagcagattcaaacaaagaacatgcacaagagagacaaagacgattttttcccgaagttcggatcacacgaatcctactctccgttgaggtgctccaaagagccgggtctcgattaaccccttgcctcacttatgcaaagatctcagaagaggtccacgaccttcaactcaacacttctaggtcattttctagaattgagtgaccaccaagatcaaactcaaaattccttctagaaaaggccacaagtgcacgttgctctacctaggataacctctgaaaactcagcacaagaatctttactcacttacctcgtttccttgcggaggtgaggaaaaccttcacaaactttcccgggacatccacaagatctttggaagctcacgggcaacacataactgtctaggagaagatctcaaagagtaataagcctaagtgacagcccacaaggtatccaaagtgctcaatcaagcctaatcttcaagccatctctaaaatactcctacactctcatctaatctctcaatctcacaagataggctctagatttcagtggaggaagcaaaggaagcttgggaatggctagaaaatcctagaacataaaagaactgaagtggaatggccaaagggtgacctggggacgaaatccatatatataatggctaggtgacgtcatctagccgttactcacaagtttgaactggaaacctgccaggaggttccgggcaaaagtgccaacttccgggcagcacttaggaacttttttgcaattaaacagcgcccggaagtttcggccagaacctccgggtagccctctctgtcccggggagaaaatcatttttcaaaaatgattccaaaaatcttttgactcatggatatgactaagagcactttgtataccctagatccacacttgaaacccctcttaatagtacggtttttcctaaactcaatttcgaaagtgaaaaacctagtctaatcacctttggtgatttttgcacataggaacattcctattggggggggggtctccttgcattcttagccatcacaacttgcttttggactaaactcctgtgaataaacttgataaacacgttagtcccctttaaccaccttgtcattaatcaccaaaacccactagggggtttaagtgcatcttcactttccatcgtaatagaattctcctgtgggatcgagaatctgcccgttgatgaatctcatcatctgttcttgaacagcccttatgaaatcatcgtgggtgaggctatatatcatgtaaatcatctgtcatttggaaaaaaaataggattatacatatgaaaccagtaaacaataattgacggatgaataattttacgtacttccaggtcctggccaatcctgatttggtgtgctaagcagtgcatgtaatagcagacgtagtagccgcacaagttagtcccctattcctgctttgcacactgaaagagaaacaacgagagatttaatatgcatatctaatttataacaaagaagtaattcaatataatattggagcatgtactaaccggaaaattgaacctctgtgtgagtttttcattccaaatcccgcggaccaatgtacagaaccgaatccatgccctatttacagttgttaggaaggattaatttattatccgagatccgtatagtacttgtagaatgattcataatgacagtgcaatatatgacaatacctatctatcacttcgaaaatatgtgcgaaagttttctccggtttatccattgattcgtagacatagattttggatttctcaaggttgaaaagaataaggacccagtggaatctgcaatttgcattagatgatacatgtgtgtgtgtctatatatatatatatatatatatatagagagagagagaggaaggaacaaaattgaagttatgattgtaggaactcacgatgtgttgtagggaagtagtatgaacatcttataatgctgctgcaccgggaaatggaggatattgtcctcggtttgtttctcatagttttgtagcatcagcgtgttcactttgcgggggtccatgaatcctgtattgaatttgttgtgccgacggcacaactgaatctctattctacaacgggtacaaggaatttgtataagctacgttcaaaggaggaacaaaattgaactataaacaatacttacaaagtccacgtgctgagaatagagacgtcgagggcgtcgcggtggtataagtcgaagacttctttgtaacggatccaaagaacatcatctccttgataataatctgagtttcgcaccctcgctccgaacatctctctgcccatccctgatttgtccaagtaccattgatgaaaccggtacatctgtgtaggtagctttctcttatcttatcaggcgtgactagcggttcaccatgtttaaacatgtacttttaccggagctgtttcgataggtgcgtcctctagcaactctgctccatctttagtccagtttctttcaagaacttgcgtatctcaagttgttccggatctacgaacggttcaacctcttgttgtggctacagccccagctgagggacttccattccgcacttcactgctgcaggcttggctttaagagccttcctcaatgttcgatcataatcagaaactacgaccggtttgctcagttcagccatcttaataaagtgatcctgaaccactggggatatagggatcttcttttccggactccatggcttcaactgctccctaacttccactctaacggcttcatcgagctcctccggagtcaagtcatacgcccttttcttgagagcggggagccttggctcgtcagatttggctttcttctttggtcttgatggcatgggctcatatgggcaggaccttgacggtgtagacttggcagttggtgtaggctgaggagtcgttgcccgcggacccgacggtgcagacttggcagcaggtacacacggaggaggtggtggaggcagaggagcgggaggagccggtgtagccgaaggagacggaggaggcggaggagacggtgcttgcggcggggaaggaggaacggactaataaaccactttagtcccggttctttttggaaccgggactattgtggaaatcgcccgaccctctaaagatcacttctccagtagtgtgatacctgactggtcgcgtgcatgcgaggccacatgatcagctacatatgtatatactatctacatgtataatgagtatgtatatattgtatatacatacatatatataaatatatatataaatatagttttttatatgtatacattttaatgtataaaaatatacatttttaatgtataaatatatatatacacatatatgaaatttgtatacatatatatacaaacttggtatatgtatgtacataaaatataccaactttttatacgtatatatacaaagtttatatacgcacgtatagaaataccaaaaatacacgtatatacatgtacataaactttgtatacacgtataaaaagtttatatatgtacgtctttaaataaccggaaaaagaaggaaagaaataacagaaaaaaaccaaaaaagatggggacgcctacgcgtcgggcgcccgatggtgtgggggaaaatcgagcgtgcaaaaccactttaaactattttttctcttaaattatttatccaaatcatgatccgattgcaccattaaattcattgcaattaaatctttaaaacaagaccatacatggatatattccaatgaaaaatgtttttagcttattattgaattattttttaatgttgcacgatgttccgccaagtatatcggatttgtttcactaagtagatcgaaaatgtttcaattgtttaaatcgggtgttgtttcaccttatataaaatcaatgtttcagtttgttgcaaaagaatgtttcagttcactgcaacattagatctatacatagtgaaacattgtgagtatactaggtaaaacatttttggtggaacaaacaatgaaacgaaatcccttaatagagagtttctaaaatatgtgggtaatttgttgcaatggagttgtgtgtgtggacacgtggtgggcccagggggcacctgcacgcacgcacacgcgccccttggcatgcacgcgcgcgggggttgggggagcgtccgatttttgctccccccgccggtcgaccgagcagaatcatttttgaaaaaagacggaaagaaaaaaatgaaggtaccaaaaaatgaccttgtgccattcgccgccctccccctctccgcacgcgctatgtgtccatccgtgcggggtaaggggcacgcagatgtccgagaaatagcattttcactgttggatctcaagaattcaaatggattttgcaaaatttccacacaaaatagaaagacactactatacgtgtctttcgacacatttatcagcctaaatctgtcaaattctgagaccatataagtaacaatagattactaagattaatacgataccaagcacaaaaattgttataaaagttagttgattgaacaaaacgatgactaaccttgatcaattcagtcattgatcacctaagacatatcagatgacaacacaggaacagacaatatttattaacgaagttcagccgaagcctacatgtctgggactttgattatggacgctccaacccaatcaatatagcacgcttttattctacaaaatatttagtaatactattaggagtgcagcgcgctccttagtattccgagcgccaaacatgtattagtccaggcgcacttcaccccacgtcccgtcatcccgctcccatcgttatcagagtaaacgatttacttcgataataaaaacaacttccctactcccgatcccatcccatgtcccgtcatcctgcgtccactattatcggagtaaatggtttacttcgataaagacaacttccctgattcctgtatatattttatttttcccatacccaaccaaccactctcgtccccacttcaatttttttccctttttttcggatctgaattgatccaccatcccagcccacagatcggtgacgcaccatggagtaggacggcgacaccgtggcggttgagggctattgatggtagttagcgatcaggtttgaccgtcaatattaccaaaatagaggagaactagttatgcttgcattgcatatccatgttagaataataatattccattagtatttggttcactaacattttgcagagaataatcattaagtggaggagaatcgacatcaaatcagatgataaatcaatcggacgatgtcgagaatcagacttatgtatgaatgggccaagaactcagaattgacacgatgaattgggccaaaattcacaagtctgcgtatgagagcaacggaggaggccacctgccaattttgggctaggccggcccgacccatggttcggccgaaccccccgcagcgccattcaatccaggtttctcctggacggcatagatgactccccaataacggttggtgggtattaccgatctttccaaccgtcataaccgtcattctcaagctataaaaggagctctcatcctcattttactcacacacctcaagcaagagttctctcatattttctcaagttagtttagtgttctcaagctagtggaataggaatagagtagaaatcggaatccggaagccttcggaagtgttcgggtatggctctagtagctcttctcttctcttttgtaagctttgtacttttattagaatactcttctatatacatttatggtattgaaatactttccgagtatatggatgccaactttacattatgttcatgtcatactgattataccgctagcttatctgggagatgcattggtacgggtatagtgtttgcttatgcaattactctatatcatgacgatgatattagagtagtatctgatagtttaggcgtagtgtctacattacgggatatcattatttggggttatatgctgcggatgacaggtgggatgctgatggtgacagctcattacgggtattcctccgcgcgtgtatatagttctaagttaattttctggggagggtactcctccgtatttagccccgattgtatggtcatgacgggctgtcgtaaggaactcgacagttaagggtggcttctcgaagtatcaggaggacatcggatatagggaattagctagtatgtcagataactaggatgtatgtatactatgtatactagaagtataggaatagattctctttctattttgtttccacttagcttacatcctagccacgcctgacatacgtacatctatacaaccggtatagatgtatagatagatagattagcagaagtggaaaacgtgagaactcataattaaaaagtactattagtataggtatagatagatagattagcaccataccatttctgtcacgttttccatccatctccctcattttccgtcttcttccttctctcttcctcaagaaatggcaccacccgcacctgttgtgacggcagcggcagacatccccaccggtgtggccgcccttgcctccgccggacgacgacaacctcatccaggagatcctcctccacctcccctcacagctgtcgaccattcggccctcgcgcctccctcgtctgcaagcagttgcgccgcctcgtctcccggattccttcgccgcttctgagcccaccaccgggattctttcctcctcggcgttttcaagaacgagctctgctaccccatcttcagatccgtcctcgatcgcgagatcttatctcgctcaaccatttcgccctgcggctcaacggcgaccacgtcgcaagcctcctcggttgccaccacagcatcttctcatcttcaactacaacacccgtgagttcctcgtgtggaatctcgttcggcaatcgccatagccgttccgtcgaagctcaccagggaggggtggagggagaaattcgtcatgaacggcgtgatgctttgtgttgctgctgtcatcggcgacggcagccatgtgcacggcagcggcttctagtcctgccgcttcaaggtggtctcttgatcccgcacccgccgccgccatcttcgcacctactgttacagcggcaggtgcggttggcgccaccgttcttggggaagagagaaggaagaagacagattgatagaaaacgtaacaggagtggcactgtcccaattttataaaagtccagtgacattcatctaaatagctgcatataccatggcacggacctaattgtttttttaaaaaaaaacggagcaatggcctaagttcacagatggcccacacaggcccatgttcatacatggcccacgctggcccatgtggcgctgcgtggaacagttggcccaatttccatccccatccgtgtcaatatcgatacacccttcgcggcggcggcggcggcggaacgacggcgaccggcggtcgagccgatcgaaagcatcaccacgatgatggccgcatcgagaacggcgttcgcctccggcgacctacttctactcactgtctcctcctcggcgtcaatcctcaccctggcaaaaacccaaggtatcatcaaatccatctcgttcagttctgggcgccgtcgtcggccgcgagatccacagtccatacctacacccggcaagcttcctctgatatctagtgattttttcggcatatagaaaaacatcatccaaaaaatccaacatatgtattgttcaggtttagtgataatattgatatgcagttcagatagctagtagtagtttgttttccaggataggcaattcaaacatgaaacatatttgcagtttaaagaaaatgttattagtaaattattcttccagtgcattgtgaaacatacttctcacaagaagaaatatgatagattaccaaagtagttacaaaatatgatgtgcatagatcggtggattttcttgtgctcagtagccgcctatttcatcttggaccagatagaatcgatgcagaaagtggagctgaatatgtggatgagttgtcttgagtagatatcactgaatttgcattgacaaagctgtaatccaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcattcaattcattgtctttagccttctctcgcaataaattgatgagctgaacgctttcctctggctgtgaaatatcgatatttttccttccacatattatttccaagagaacaactccaaagctgtagacgtcaactttttcagtgatctgtgatgttagccattcaggtgccagatatccaggtgtgcctctcatcacggtcactactttactttgatccctgtctattagtttggaaagtccaaaatcagccagtttggcattgaatttctcgtctaagagaatattttgtggtttgatatccaaatgagcaatttttcgcctgcattcctcatgaagataacataaacccttggtaatatccagaatgattctgcaccttgtgcaccaatcaagaggagcattgttatggcggtaatagatccacatatcgagtgaccctcttggcatatattcgtataccagaagcctatttgacttctcggcacaaaatccaatcactttgacaagattgatgtgctcaatgctgccaatagtctcaacctctgccaagaattccttctttccctgtctggcaccttccagacgtttcactgcaactctcttttcacctatttttccttcaaagactgatccaaatccaccttcgccgagctttttactgaaatcttcagtgcgttctcttaacttttcaaatgaaaaccgcattggcattccaggcaatatatcgaaatctaattcttcatctagtttttgatacttcctcctccttcgtacataaatgccaacaataataactaaaacaaggctactaattgctgcaagtgtagcccctaaacttaccttgatacgtttttgtgtaggggcagaagcggagggaggaagttgcactttgaggtaaacagaagagttgtaatggagcttttcaggttgtattgattgcaaggagaagacctctgtcacagacttacattctccatcggaatcattatggtaatacctgaagagtacagccctgcaggagcaattctttaagcaggcttgcttgcagtcatctctactttttgcattggttataatgctgccatcaaagtaataaacatcagtaagagttaagaattgatggtttttcatttcttgacaagatattggagtcactggtgcacaaccaagattagccttccgctcgtcaactggctggaagtagcttgaactagaattagtctgaagaggacagatgcattgcccacctgtgcatatcgcgtactccccgcatactgtggggaaagcacagttatccacgtcgattacatcatccatgtggattacatcagataccatggtccactcaaatccagaccactcatacaacctcaaatggccatcatactctaaccttatgtactgggtggacttagcttctggcagtgcaattcttttatctggctttcctgcctgtgtcgactgcagaaagatgctgaggcttccattcgtaaaggtaaccctcgttgggtcttttctgctcttgtttgtgtccaccaaatatttatagtatagctgtggtggtttggatccaacataggcatataaaccatctgggagaacagtcatatacaacttactctcagtccaatttgtggtagatgtatttgctctgagcttcatgccctgcagcaatgactgcccagggaccaatacatcggttggatgatcaaatgactgccacactgtcgcattcctctgatcaaacagcaccagattgccatgctcagtgatctgcatgcctgccacggattggcctgaagtgttgctcgaccagacgagtctcccgtcgatttcacggaggacaagatcgccatctccagttaactcaagggtagcattctctcccaaaggacttgcccggttggccgaccagataacccgtgccatattgttttcctctaagggtaagccataaccgctattgaagttggcgatgaagacagcgaagaggaatgcttggcagggtggagcgcagaagaaccctgcggcaaaggaggggccatataaagtttgtgttgaccggaggatgattgcgcgcacggctgacccgtcggtgtaggtgatactgtgcgggagcaccgcggcgttgttgacctaccgcgtcgagaggttggccgtgggatagtcagggagctgcccggagacggacggtgctgcagttgcaagtaccactgcaaccactgccatcgtcgtcacgtctaagcaaaagagatttgctggacgcatggtgcttgaattgcagaggggactgcaagaagaatctcttcttaatttggttacatacaagaagccaggcagcaaggagctgtggacattggagaggctggcaaagatgtcctgacctgaatcctgatgatactgaatctatgaactgatgtgctctccggaaagatggcctcgtcgtcgcaggcagagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctgtctcgtcgatttttcatcctaaaaagaaaaaaaagagaagtcgtgccgattatattcaagcattcttagtcgaaaaaagattatattcaagcattgtcagagtagatattggcatggtaggcatggtagtaagaagcttcataattaagcattgccacggcattccctgattcccttgtgccattttcgttctgggagagcatgacaaatagtagctagctaatgaggtaagatcagttagaaaacacctgaataatattggttaatgtaaaatttacatgttcggagagggacggataatttgcttatacttcaatatgtactcccttcatgcgtaagctctcctatatacatgagtgcttattattattattattattattattattattattattattattattattattattattattattattattattattattattattattattattattattattattattattattattattattattattattattattattattattattattattattattattcagattagtaaaatgtccatacgagtaaagtgaatttaattacctaaagagactagtctccgacgttcgaaatttttgctagcgtctattgagttcctctagctgtcataatttcctttgtggaggatcctgtttgcgagtaaatgcttgtatatctgaagacaatattttctcctctatcatccagccagtgaataacaagtgcattctgcaagtaagggcccttttaaatattaggaaggtaaaaaacagagaaatagaaaaaacatgggtcctcttaaatagcaggaatagaaaaaacagggaatagaaaaaacagaggagtagaaaaaacatgggattctaatagaaatgcaagtgtagggaaaacatagaaaaaatacagaaatgatcgtttgattgaaccacagcaaaaacgtaagaatcggatgaaagagatagactcgaaggaattttttcaagatattggacttcttactaatttttctctaaaatctctataggattatccattccatatgaattttaaaagatgggatatgattcaatcctttgtttcaaatgttttcataggatttttttttcatagaattgaaattctccaaaatttctatatttttcgtataaatcgaaaggaccctaaaggttagaatggtgaggtcactgaaccaatttgtgaaagtgattggcagagtaagagttaagacaagtgcaggttggtgatcacgagggcttcttcctgttaacggggacaaactacaagcattgccagaaaaagaatgaaccattgtactcgaattttttagcggattcagattcggacactgacagtattgggtgttcatttaattttcatttatgtatgcttcgagttggacagccaagcgggaaatatccatcacattttcctccgtgatgatgtatagaagtattgctactctcatctccttactgcaagtatatgtaaggatgtgtgaataaatttcagtaaataaactgctttaacaagctatttcaactgccagttcgttagacaatgatttaaatacgagagtacaacatcatatacaaaacatgatatccaactacattactttatgggtgaaaataaagccacattacaacttctcaaagataacatcgaatgtataacttgcatatatacaaaactgcaccatgtcacatgtgtatatcagtatatgccatgcaataatctatatacattccatacaaaactgcactatgtcacatgtgtatatgcaatgcaataatttgactatttccttcgcacccaacaaacactggtggagaaagcgtctgtagtcccggttcgtaacccccctttagttccggttgatcgatctttagtctcggttggtgttcgagctgacatttttttttttttgcatggccctgttgctgcatggtttatatatatatatatatatatatatatatatgaccaaaatatatatttacattaaagaaaatgtgtacacatgcatatagaaaaatagacatgtattaattacaatccattatgtcctagctagctacgattttgacgtagtagtagtcgctatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtaatgaaattttgaatttatttgtacgtacatcgagctctcttgtggtgatgatttggtctgcaaggcagtggcaatactcgcacacatagtagcctcacaagttagttccctgcttttgctttgcgcactataaataaatgacaaacggcgagagatgtaattaatatacacttgtatatatttgaatcagagattcaatataaatgtagagcatgtgtactcacaggaaaattgaacttcggcctttctctccatttgccgcgaaccaaatgatggaaccgataccaagccctacatggagtttaaagatatgattcgtagtagcaattaattaacataagaatttatgacagtacctatctataagttcaaaaaccttatcaaacgtagactcttttttatccattgattcatatacgttgacggtgcaggcctccaggtcaaagagtaaaagcacccagtagaatctgcaatgtgtgtgggatgcattacatatgaaacagttagcatgttcgtacgggaatgaaatttggtataggaagacagtaaaattaaactaactctgtgttgtacggcaacagtatgaacgtcttataatgctgctccttcaagagatggacgagatcgtcctctgtttcttgcggatactggtcgagcattgcgacgtttacttttcgagagtcgatgaatccagtatcgaaaaccccccgccgtcgggccctttgaatctccattctacaacgataaaaggaagtatatattatatatagtctacttatatacaaggacctatttaattaaaggaaacgtaataagaaatctaactgaaagatacttacaaaatccagcaactcataatagaagcgtcgagggcgtccagctggtatagttcgtagatacccttgaaattgatccagagaatgtcatctccttgcaagaagttcgtgtccttgatcctcgctctgatcatctctctaccggtggcgctcatctccatgtacagttgatggaacttgtatatttgtgtggttagggactgcagctgctcaggcttgacaagcggtttaccgagttcgtacatgtatttcacttccgccttttcgaatggtgcgccttgtagcaattgatccgtagttagcccggtgtcattaataaagacttgtattccaaaatctttaccggtcaccaacgggtcgatctcctgatttggttgctctttaagctgagggactggtttggattttccagaagatgctttcttgagtgttcgctcatagtccgatagctctatggcctccttggcaggtgcagacatacccctaaagaagttcctgacactcaggtctataggaatcttcttttctggacttcgaggcttcaattgtctcctgacttctgatgccacaaaagcgtcaagctcatcttgcgtgcaatcgtaccccaggtccttgttcttggcggcatcaacttccgccttctttgttgcccttgtgggggcaggcggtggagcttggggggcccttgacttggaaggtgccggacaaggagattgcggaggagtcggtgtaggagcctaaggaggagtcggtgtaggagcctgaggaggagtcggtgcaggagcctgaggtggagacggtgctggagcatgaggaggagacggtgcaggagcctgaggaggagatggcggagccggaggagatggtgcacgagacgccgcttgtcgcccagggaggatgatgtaccgcttgcgccatagaataatggcgtggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcacatggtgagaggttatttattagtaatcaacatatataagcagcaactagcggaatggccaaatctaaaatctataaactacgagcttacatttattgataagttcttgaagggaatatgcagctcacatggtgtccgctgagtgatgtcatcaatggggcaggtggtttcgtcctgggtttgcatggtgtccatactctatgatcctacctgccccgttgaggcgcagctgctacgatttcctgaagggctcaccattgtaggaggaatggtcggctggggatcatgggaccgatatgcggccatgcattcatcaaccttccttgccacctcctcttgcatgctgagctcgtagctcgataccctgaactcaagatctgcaatcttcgcctcggtatctctcttgctcctcatccgactcctatacgtgtggatgtcctccttgaacccaatcttccaaggaatcacccctttccctcgtgttcgtcctgaatgctctggagtctgcatggcgagtgacagctcgtccttctctctgtcgggttggaacgtgccctgagaagaggcttccactgcgtccgttagtcgacgcgcagcctcgcgtatctgatcgccgaagaccagggagccatcagctgggttgagcgttccaccgtgagcatagtaccagaacttcgatcgttccggccaattagcggtgaccggttcgatacccctctccagcaagctagcctccatctcctcccacttcggcatcgcgacgctatagccgcctgaccccaagtggtgatggtacttcttcttggcggcattttctttgtttctttccatcatcgcctgcccttgttgacctgtcttatatgcaacgaactcgtcccagtgatcccttagctttgggaatgtgtcgaagttcggtgtctgccccttcaggatgtatttctggtacagatctcccttgaagctctgaaattgttctgccattttcttcagagtccaccttttcactttgtcctctgtacctgtgggaagggtgaatgtctcgagcattgtggtccacagcatctctttccacgaatctgggacaaagctctcatgatctccgcatgcccttgttctgtgccagtacaccgtactgacaagcacgttatcctgcacaacccaaccgctgtgacgtacgtagttcttagcggcttccgccggggcactaggtcggccgtcttcgtccacttccgttatgatgtgccgaccctcaagcttcttcgcggcacctcgttgcccgcgtgccctcttctgtccagcggagggttgactgccactagcctcctcctcctggttctcctccacatccctctccacgtgcccctcctggttcccctccgcatccctctccacgttcccttcctcgttcaaatactggtatggatcctcgttcccctcttcttcgttccagtattggctgcttccctccgcgattgtatcgtacaatatctgttcctcatcgcgatcagccatctgttcatacaggaaacagttgctaagtcatgagacatttttgctttaacaatcttatatgctaacaatcatatatgctaagtcatatatgctacgtctaactatcgtatatgcgaagtcatatatgctaagtctaactatcgtatatgctaagtctaattacaaatctaataatcgtatattaaaactataataatcttatattaaaactataataatcttatattaaaactcaaatagtcatatatgctaagtctaggtgacgtatattaggaccctagctagtcaataattatatactaagtctaattacaaatataataatcttatattaaaactcaaataatattatactaaaactcaaatagtgattatatatgctaagtctaattgtcgtatattagaaccctacacaatcttatatgctaagtctaattacaaatctaataatcttatattaaaactataataatcttatattaaaactcaaataatattgtattaaaactctaactataatgctaagtctaagtgtcgtatattaaatctaatagtcctaattgcattaaaaatttaacaatcatatatatatatatttacgtcacttgcctgcgcgaattcctttgagggctagctactactccggcttgagggacgacgacgacaacgtcttttctgcaacatacaaaaagatgtattaggataaacgcgaagtagcatatattgcatttcacgttcacacttcgttcacgatcgttcatgttcacgttctcgttaaggtcacgtttcattcacctacgttcgttcgttcacgtgcgtccatgttaatgtacgttaagtaaggttcgttcacgcatgttcgttcgtttatgtacgttcaaatacaacgttaagttcatgttcgttcacgttcatgttcgttaacgttcgttcacgttcgttcgttcacgttcattcacattcacgttcgttaacgttcgttcgttcgttcacgttcaattctcgttcacgtatgtttcgttcgttcacgttcgttcgctcattcacgttctcgttcacgttcgttcgctcgttcacgttcacgttcacgttcacattcgttcgttcacatggcggcagctagcggagaggcggtgtggcggcagaggagcggcggcggggcggcgcgcggcgcgcgtggcatcggcgtggcgcgcggcccggtggcggccacgcgcgcggcacggcggcggcgttgcgcgcggtgcgacggcggcgttgcgtggcggcggcgtggcggcgcggcggtgccgcggcggcgtcgtggcgtcccggcgtgtcgtgccgccgcggcgtcgtggcgcggcggagtcatgttcggccgcgacgacgtcggcgtcagcgtcggcaacgaggcagccggcggcaaccgagagagagagatcaagatcggagagagagagctagagagggaggcggcggcggctctcactccatagatgcggtgtcggcggagtaggcgtagacgtcgacgacgacgcgcgcgagacgacgatgagatacgacggcggcgtcggcgcggggatgccctaggcagtggcggcgaaggagaagccgagagagatcgctcggggcaaaaacttctaagtgttggtggagaagacgagggcgcgcatcgggaaaatatatatacccctagatctttagtcccggttgatgagaacaacc

SEQ ID NO: 37556 - DNA, 5084 bp, Oryza sativa
agacggcggagtcggcgcgggcatcccgtaggcagtgacgacgaaggaaaacccgagagaggtcgctcggagcaactacttataagtgttggtggagaagccgagagagcgcgtcggggacatatatatacccctagatctttagtcccggttatgagcaccaccgggagaaaagatatctgatatctttactcccggttgttctcatctatctttactcctggttgttctcatcaaccgggactaaagatattttcccactatttctaaattctttttaaacccggttagggttaagaaccgggactactgataagcgcactgaatattaatttccattacatatgtgtttttaaaatagaaaataatgcactaaaattatttaaagtcgaaaaattaatgacaattacttcgaaaaattattgttggctgtagtaaattaagtggataaaacgtagtaagcaaatatatgatttaaaattaataaaaattctaataatcttatataattagcatatgaatgatattaaattaattgttaaaaactctaattaacatatgtaaatatatacgacatgcatgatttaaaattaataaaaattctaataatcttatataattagcatatgaataatattaaattaattgttacaaactctaattaacatatgtaaatacatacgacatgcatgatttaaaattaataaaaattctaataatcatatataattagcatatgaataatattaaattaattgttacaaactctaattaacatatgtaaatacatacgacatgcatgatttaaaattaataaaaattctaataatcatatataattagcatatgaatgatattaaattgattgttaaaaactctaattaacatatgtaaatacatacgacatgcatgatttaaaattaataaaaattctaataatcatatataattagcatatgaatgatattaaattaattgttaaaaactctaattaacatatgtaaatgccacatgcatgatttaaaacttttaaaagttgttaaaacctctaataatcgtgcgtaattcacatatgccaaacaacaattgatcggcggtgacggttgaccgcacgtactttctcctcactattgttccctccttgtgatcgctacgtgagtaaggggtgtcttcatttgataggaggatgctagggtcaatcgtcaccgtgaaaggaggttgcccatccaactgatcgtaatcctcgtcagtcttgttctcaaccccgacgatttttcttttgcctgggagaaccacgtgacgcttaggctcgtcaggccctctgcccttctttcctttgctagacatgtccttcacgtaaaagacttgcgttatatcattggcaaggacaaaaggttcatccgagtatccaaccttgttaaggtcaaccgttgtcatcccactgtcatcaatcattacgcctccaccagtcaacctaacccattggcaccggaacagagggaccttgagaggaccgtagtcaagttcccatatgtcctcgatggcaccgtaatatgtgccagttgttccatcgtgtcccatggcatcgatacgaacaacgctgttttggttcgtgctcttcatgtcttgggctctcgtgtagaatgtgtacccattgatctcatatccctggaatgtcgcgatcgacccagacggtcccctcgctaggaaggcaagttgttggttgatcgtctcgttacccatgagatgttgtcgtagccacacggggaaagtatcaatgtgatgccgtgtaatccatgcatcgaacttaccgatgtttctggcacgaactagagccaagtgctcatcgatgtaaggagataccaatgaagattgttgcagaaccgtgaaatgggctttacggaataaattattgtctaccatcattattgctttccttccgagagttccctttccccgtagtctcccttcatggcatgattcaggtaccccgattgggcgaaggtattcaataaattctacgcaaaattcgatgacctcctctattccataccccttggcgatgcttgcctctggacgagcacggttacgaacatacttcttcagaacgcccatgtacctctcgaaaggaaacatgttacgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccgaatcgatgaccttgcgttcatgaatgcacatagctttgttattgttgcccagacattgtttggaaggataccccttattacaactggtagcagttatgtcatcaacacgtgacagtcatgagactttaggtttgtgaatttcttctccttcgtgcttattattcgcttgatattcgtggattatccagacagtacatttatgctctccaagcattcaaacatactttccttctctgccttgctaagagtgtagctggctggactcaagtaatggcttcctttctcctttggttccaggtgaaggttgccgcgttgttccatatgcttcagatcattacgtgcttccagtgtatctttcgactttccgtacacacctaggaagccaagaaggtttacgcaaaggttcttagtgaggtgcatcacatcgattgcgtggcggatgtccaagaattctcaatagggcaactcccaaaatataaagttctttttccacattgccgcttgaccatcttcactctctataggctggcttccagacccctttccgaacactactttaagatctttaaccatagcaaacactgttttcccgctgcgatgtttaggcttcgtacggtggtccgccttacgttcaaagtgcttgcctttcttccgtaccgggtggtttgctacaaggaatcgacgatgacccatgtatacaaccttcctacagtgcttaagatacgtactttctgtttcatccatacagtgagcgcaagccttgtaccccttgttggactgtccggataggttgctaagtgcaggccaatcgttgatggttacgaacagcagcgctcgtagattaaactcctcctatttgtcctcgtcccacacggggacaccttccttcttccacaacagtttaagatcttcgaccagtggtcttaggtacacatcgatgtcattaccaggttgcttggggccttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcatcattctagcattccccttgttcctgaacaaacgccttagccgtggtcttataaggaaataccacatcaccttagcaggaattctcttctttgttagctgcccgtcaacttctcctggatcgtctcgtctaatcttgtatcgtagtgctttgcaaatagggcatgcttctaggttctcgtactcctcaccgcgatataggatacaatcattcggacatgcgtgaatcttctgaacttccagtcctagagggcagactatcttcttagcctcgtacgttgtctcgggcaatttgtttccctccgaaacaatgttcttgatgagtttcaataaatcgccaaatgccttgtcactaacaccattttttgccttccattacaagaactccagagttgtatccaactttttgtgcccctgctcgcaacctgggtacaacgacgttctgtggtcctctaacatcttgtccaatttatggcccccttttcactttcgcagtcctccttggcgtcctgcaacatctgaccaagatcatccgcaacgtcgttaccatcagcatccctttcctcctcgcccgtttgatttccttcaaatccaacgtactgagcaaagtccggaatattgtcatcttccacttcatcttcttccatttcaacaccttgctctccgtgggatgtccaacaattatagcttggcatgaaccccgactcaaacaagtggaaatgaattgtcctggatgcagaatactccttctgattcttacacttgttgcatggacaacaaataaaacccttatgcctgttagctttggtcactctcaaaaaataatgcacgccgtcaataaactctttggaccgccggtcagcgtacatccattgccgatccatctacatgacatgaaaaaaaatcgtacacaaataattattcttacaataatgacaatcatataataattataaaataattacgaactctttcaacagttatacaataatgacatatctttattcatttaaaaatcataaaatattacaccaaataattcttatttactatttctaatgttttaaactaatattaatgtgttttacttcttttaattttcattttagtttgttttctattatttaagattaactttcactatattttccttctcaactattttataaaaccttctttagcaaatcaactaaatttctatatattctttctttcccacacaaattttctctcttatcaacttacaactaaattttggagacaaaaaagtgtgtaaaacatagctccaaatgtaatatgacaaaaaaaaatattggaggatgaacttgcaaaccttttaggcacctccgatttgtatgtaatcatcaaaattaattcactagaaattttggcatgaccttctatcttttttgaagaaattttgaagcttgctcgggcagctggaggaggaagaagacatatatatatataggggtgggactttagtcccggttggtgttaccaaccgggactaaagatcccgggggggcctgacaggccctgacagcatttgaaccgggtaacgggcata

SEQ ID NO: 37557 - DNA, 63038 bp, Oryza sativa
  unsure (1)..(63038): unsure at all n locations
tgaaccgggtaacgggcatatttgatctttagtcccggtagccccggtttttattgcatctaggactattgtggaattcggccgaccgacgaaagatatttctccaccagtgaaagtgtgagttgtacgtatcatcatggcaatatacgatacattcgatacgcggatatgtgcaaaagtttcattcgaaatagatatatccatttgttccatatgcgcgtcattagaaaaaactcatttggaaacaagtggaaatttgtggagttacgcacatgagaaaaaaaaaacatacacacacagagcaatgggaaaaatgggaattaaatcatggggcccacactggccagtgtcacgcgagaaaatggatattttgccatcctcaaaacatggtttcgttggaatgccatctaaaaaacgcaatttgttaaaatgccaatatggaccgcgcgaccacagccactttgctattttctccattttctctcttttctccattttcaatttcattttcgctggagtagagcttgatgagacgattttgcccctgcttgccggctaaaaggggatcgagatctcgcgagctaccggccatggctcgacgcgccgcagccgccgacggagagtcccgtcgccgccttgccgctcctcatcctcctcgtctttctcctctcaacttcactcggtatggtcgccacaccggtgcgagaaactcgatgttggtttcttcgcattccaggcttgttctgacgcgctcgcgtaccgttgtgtttgcaggggcgtgcagttcggcgagcaagaggggcggcgacgggcgacagcggcggtgcggtagcggatgaggcgtactactccagctgggaatcggcagtggcggtggtggtggcggggcgacgaaggctagtccggccagggtcgtcgccgccgacatgccggagccggtgcggtggctgccacccaagcttgttcttcccggctgcgtcgccattgctgcacggacaaggtttagctgctacctagctggagcaagagccatcgacaatactgcagccaagaaggacattgctgagaagatcaatcacgcaggcttcggcttcgatgggttggtgtatgtaacgttgagttcttggagattgaacaagggcagagagatgttaatgctgccattttgtttttcctcctcctctctttctatttattttttttctgttgtttgttcttcccttgcattttttttttgggtgatttccctgctaatttgttccatctttgccatgaactttgtatttactcgtaacgcacatcatcgtcttgctctgttcaattcttgctatttaaacatcttttagtagatgaacaatgaaaaacttctcctacttctatcttcagctctgatgcgtgttagtgttcttgtggctagtgcacccgtgcatgcacatttcagtactatagtatttcacacaacaatggaccggcgatgcaggtgacggtggtggcggcacttaccgacgggcagagaagccagcaactagctgaaatggctcaaccagctcgatgcacaacggttttcaacatccaaccgaaggggcaatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtcctaagaaggcaattgtatctattaattaggatattttatgtaatttccttagagatatgtttgggcaaaagtctgccacaaagacttatggtattttagagtttgttagagataagaatcgtgtccgatatagacatattttgtaatctcgggtataaatagaccccgagccccatgtaatcaaactaacacacgcatcgccacccttttaacttttgttttgtttcgacgagttcttactttcgggttgagctgcatcggttttgatcttcaacaagaggtaaaacttgttatggtggcttgcgttattaggattagtgcttccatctttatgatactctaatcttatttatgtaatttgtcgagttatcatatatcttacataatctccggcaatatcgctatctaaccgtcaatcggctaacgtctggtacgagaagtcagccgattaggttaaatactgatgttgacttagattatataggatatctactactctatgaaatatccaacggcttgattgtctagaaattgtccttctttttatacttatagctgcatcagttaggtttgatcttataagtcgtgattagaatctcaatctgctttttggttgccaattagggtagtatcggggtttcagccgattttacctgatttagctttatatttcattatgttaggatatcattacaataaaatatgttagcttctgtgtaatgtattttacttgctttaatatcgagtagtatcggagtattagccgatacgtgctagatctatctgatcggttatgctatgaacagatatatagtcttgttgttaatatatattttgatctaagtgatttatactgtctcggcatggcgaccgatctatcccaatcacttgatttaagtatatatcgacataaggactatatattattaatatctacagccgatcgagtagatttagttcttccgtacttattaacatttgccgatcgattcacatatgacatcggctcagagataagtgatatgtcatcggcaattagtcgatcggctatcgtttatgaatttaaccgcggtttctttatctttgtttcttgttgattgcaggatcaaatcaactggcacactcatacacctaaaggcaagcttttagacctgcattggagttaagcagatctcccaggccttgtgtttttacatcaacacgcgctgggatgagactcctctgactttgtgtagtacaactgcaaactgcacaaaggttgtgtttaaatctacgggtgaaaagttttggtgcatcacatcggatatacgggcacacatttgaagtattagacgtagactaataacaaaacaaattatagactccgtctgtaaactgcgagacgaatttattaagcctaattaatccgtcattagcaaatatttactgtagcacgatattgttaaatcatgaagcaattgggcttaaaagatttgtctcgtaatttacacgtaatctatgtaagtagttttttttatatttaatactccacgtatgtatagatctaaacattcgatgggcaaagtcaccggatatccgtggcggtgcgtggaacagttgggcccttcccaatttccattcaccctttcgccgcggcggcagcggccggcagccgagccgcgatcgaaagcaccaccacgatgatggccgcagcgagaacggcgttcgtctccggcgacctacttccactcaacgtctcctcctcggcgtcaatccccaccctggcaaaaacccaaggtatcaccaaatccatctcgttcggttctgggcgccgtcgccggccgcgagatccacagtccatacctaccaccaggcaagcctcctctgctatctagagatattttccgccatattgaaaaacatcacccgaaaaatccaacatatgtactattgctcagatttagtgataatattgatatgcagttcagatagctagtacatatttgcagtttaaagataatattattagtacattattgttccagtgcattgtgaaacatacttctcacaagaagaactatgatagattaccaaagtagttacaaaatatgatgtgcatagattgcgatggattttcttgtgctcagtatcccacctatttcatcttggaccagatagaatcgatgcagagggtggagctgaatatgtggatgggttgtcttgagcagatatcactgaatttgcgttggcaaagctgtaatctaggcaattttccacgctcactgcgccttccaataccttgacaaccatcgacatcgaaggccttctgctgctctcattttgcaagcaccacattgcgagcttcaacattttaatcacttcctcctggtggtgtgagaccatatcagtacttttcttatcaattatatcgatcaatacattgtctttagccttctctcgcaataaattgatgagctgaacgctttcctctggctgcgaaatatcaatatttttccttccgcatattatttccaggagaacaactccaaagctgtagacgtcaactttttcagtgatctgtgatgttagccattcaggtgccaaatatccaggcgtgcctctcatcacagtcactactttactttgatccctgtctattagcttggaaagtccaaaatcagccagtttggcattgaatttctcgtctaagagaatgttttgtggtttgatatccaaatgagcaatttttcgcctgcattcctcatgaagataacataaacccttggcaatatccataatgatcctacaccttgtgcaccaatcaagaggatcattgttgtagcggtaatatatccacctatcaagtgaccctcttggcatatattcatatacaagaagccgatttgacttctctgcacaaaatcctatcagcctgacaagattgatgtgctcaatgctgccaatagtctcaacctctgccaagaattctttctttccttgtttagcactttctagtcgtttaactgcaactctctcctcacctatttctccttcaaagactgatccaaatccaccttcaccgagctttttactgaaatctttggtgcattctctcaacttttcatatgaaaacctcactggcattccaggcaatggctcaaaatcaatttcttcatctatctcttgatacttcctcctttgcacataaagggtgataactgtgacagccagtacaaggataagaattgctgaaattgttgcacctaaaattgcctttgttttgtttgctgtggaagcagaagcagaaggactaagctgcaccttgaggtaagcagaggagttgtaatgaagggcttcaggttgtatcgtttgcaacgagaagacctccgataccgagaagcatgtgccatcagaatcattctggccatacctgaacataacggccctgcaggagcaattcttcaagcaggattgcttacagtcatctctgtttgttgcattcaggatggtgtggctgacatcgaagtatgaaacatcagtaagggccaagagctgatggcttcgcatttcttgacaagagattggtgtcagtggtgagcaaccaagatttgcctttcgctcgtcgaccggcttgaagtagcttaaactagaattactctgaaggggacaggtacattgcccacctgtgcatatcccgtattttccgcacgccattgggaaagcacaatcatcagggaataccttgattacatcagacacgactgtccactttgctcctgtattagaccattcatacagcctcaagtgcccatcaaactctaacctcatatactgggtggagctggcttgtggcagtgagatattgcttggctgagtggactgcacaaatatgctaaggctgccattggtgaaggtaaccttggttggatcttttccactcttgtttgtgttcactgaatgagaatagtagagctgtggtggtgtggattcaacataagcaaacaatccatctggttgaacagccatatacacctgattctcagtcgaatttgttgtagtgctgtttgctctgagcttcatgccttccatcagtgactgcccaggaaggagtgtgtcagtcggatgatcaaaagactgccacaccgtcacattcctctgatcaaacagcacaagattgccggtgtcagtgatctccatgccagccacagaccggctcgagctgccgcttgaccagacgaggctaccatcagcatcactgaggaccaggttgccattgtaagtgagctcgagggtggcattctcccggacggggcgagcccggttggccgaccagaccacctgcgggatcccggtggtcgtcatcgtgatcccggcgccgctgttggtgtagacgatgtagacggcgaagaggaacgcgtcgcaggggggagagcagaagaagcccgcggcgtaggaggggccgtagaaggtcttcggtgaacggaggacgatggcacgcacggccgacccgtcggagtagccgacgctgtgttggagcgccgcggcattgttcacccaccgcgtcgagaggttggcagtgggatagtcgtaccgctccgcagagaccggcggtgctatggttgcgagtgcgatgatgacgatgacgatgatgaagaagaagaagttggccggaagcatggtgcttggatgtgaactgagaatgcgatgaagaaccaattaagcaagaaacttggggcatttctgccagagatgagagaagatgttgtcagttctcacctgatgtcagcatggcaatggtggagctgatgcggtgaccggcaaaatggtctcaccatcgccaaggtcaccggactctggagtctgcagtggtcagctacttgtcttcttgatctctcagtaagttcacacttcacaccaagctgggctagattattatggttttggtttatctgtgaagacagattgacttgaccatttctctttggggggggaggggggggggtcaataattagccgtgccgacaaatggtagtcgtttccatgtaccaaattgctgatatcatcaacattaacaattcaattcaggcgttgtccctttcagtaaaaacaattgaggcattgtccttgcatataaagaaggcaattcaagagcaggtattggtacggtagtaaggctggtaaggaaacacgggaactgacgaactgtattgtttaatttccaattcacgcgttccagatcttaaattggttgtaaggatcagttcatatgtagatttttccagttggtatgatcacagtatcacaccaatatgattgtgggatcttggtcaaagtttccattcgatcctgactgcttgtacagactctagtggtttatatattaaaaataactacatgtacatgtccatttattacaaaatttcactctttcatctgtccatgtaaggggttttttttcataggtaaagaataaaatttctactgcatgtttttataattaaaaggggtttcagaagtataactttacaataaatggaaggtgttgatgataccataacttggagatggacgagcaatgggaaatatagtgcgagatcagcctatatagcacaattcaacggaaggataagctcagctgcagcaaaactaatctggaagcaatgggctccctccaaatgcaaacactttgcctggctgttactacaaaataggatttggacaacggatcggctgcagatcagacaatggccaaacaactatttctgttaactatgatacaggaacctagaaacaactcaacatctcttcaaggattgtccttttgtgcggcaggtttgggagagggtcctagggaggctgaactgcaatgaaattgacctgacacatgatgaaaatgaatcgctgttgaactggtggattaggagaacatctcaaggtgggaaggaaaaagctaaggcaaaaaaatcaatccacatgttggtagcatgggaaatatggtgtgatcggaacataagagtatttcaaaatcaagaaaaaaccctgcagcagctactagacaagattcatgatgaagtcaagctatggagaatatgtggagcaacaaacattgcgagattatcggcctaagaccttttgattgattagtgtttttcttgtttctttttatttcttcttttatttttcttttcttttatttttctttttccttttctccttcaccgtttggtgatcatgtaaatagtttctcccctacttaatataacaccaacaatgctggctcggttttcaaaaaaaaataactttacaatacagaagtattcatacattttagattttctttttttttggaatacgcaaggagcacatttttttccattatttacaatgtgaaatgaaaaacaagcacgggactggtactggaggctagggatctaatggggatatctcgcgctagatttggctaccacgacctcgcagaggtaaaactgaagggacccctacatttgccgacttccaaagcacggcttcttccgccatcgctttcgccaattcgatccaagacttgctctgttgattgaagatccggttgtttcgctccttccaaatcgaccaggccaccagcgttgcaatagtgtcaaattcccggcgatgctgctctctcaacttcatccggctttcacagagccagaggtgggtagacagtccggattgcctatcgctcttaatgtccaacaccaaagctgcctcgactcaggtcagcctaccagaatgtggtcgatgctctcctcctgttgatcgcaaagaacacaacggtctgggtgaggcaacccccggctccgtagatgatcagcggtccaacatctgttcattgctaccaaccacaggaagaagcggcatcgaggtggagcaaacgatttccagatcggggtcaagaggaaggagatccgaccaaagaacagagccttataagaagatattgagctgtactgacacgagctttcccattttcagctgaaagaatcaggagtggtagggttacaggtcaccgattggactagcgaccaaagcttcagattctccaggatggcttgaatcccaagtgccccagcgatgtccccgatccatcaacgatccgttagtgcctcggccaccgtccggcgctggtgcacgtgaggcgaaacacgatcgtagatgttaggggcaatggatcggatgcagccctcttgcagccaactatcctcccagaagaggatcgtttgtccatctcccagctgacagactgtggatgcagccacgaagctcttctccttttgcgaccccgggatgtctaggccttgccatggtttacttagtgaagtccgttgtagccaagtccatctggagcgaagtgcaatacccatcaactccagatttggcaagtctaaaccgccatagttcttaggagcacagaccctcgaccaagcgacccggcagcaacctccattggcttgcgccttgcctgccagagaatcccgcgtcggatcttgtcgattcctttgatcacccacttgggtgcatcgatagtaatcagcaggtagattgggattgcactgagtacaaactgaaccattgttacatgacctatcaacgacatttggttggatttccaagctggaagccgccgggctatgctgtcaacgaatggctgcaagtcttctttcttcaacctgaagatggaaaggggtagacctaagtacttgcaggggaaggatgcaacatggcagggcaattccggctgtatcccagcaagcaactcctctgagcactgaatcggcagggttgaacattttccaaaatttgtccggagcccagaggcctcaccgaagacgtagattttctttcaaaagaatcatctgaaagaattatgcaggatcttacatttgtaaatgaatcctgcaatttgtgatatcctgcctggaagaattatgtgccctattcaggagtcaggacacaaaatatgtaggtattttagcctaacaaatatgtaggtaatgtctcgatgaaagcacttaacattttctttgtctgtatgtgtttggatggttgctttttcttaaccaaattgcaacagtaacataaaatatgaaggttaacccactaaaggacataatttgttgcaccaacaatgattatttctcatactttgatgaccggcgtggtttacaaaaccatttgaaggttgaaatgttagttcctggcgaattaacgagattaaaaaatgcgactgtataatttgtaaaccaaaatctgaatcctagcggacagttcaagcaaactaaaaatggatttcaaacggcttatggagaaaaccgatcagtttgagccaaaaaccaacctgtgtaaaaccatagaataaatgtaagaacatttagaaaattgaatggaatttaggaaaatctggaaaaatgagaaagactagcaagatcattgctataatttggacaaacttatgttgtctacaacgttagagcatctcgagtgtatgaataaatcaaaccgtcgcgccacaaaacgaaccgaacacattggggagagtcgaactgtatatgtcagaagactcgaaccaagccgaataaaaaaaatgcaccattgcatggtgagcacatacatactgatgcgtggaaagaaaaataatactgcctctatttctaaatattggttaccgttgactttttagcacatgtttaaccgttcgtcttattcaataacttttgtgaaatatgtaaaaaaaaaacttttgtgaaatatgtaaaactatatgtatacatataggtatatttaacaatgaatcaaatgatagaaaaaaattaataattacttaaatttttttaataagacgaacggtcaaacatattaaaaaaatcaaacgcgtcaaatatttcaaaacggaggaagtaatttagttggctttctctttgctcagaatgagtggtgggagccgcaaaccggtgtttacactgtgaagttcgaacactcagacacgctactgattttgcacagcaaaattgatggcacactggagatgcccgtatagttgacaaaaatgttacacgcactgacaataacaacattataaagggctttcacagtgcggggacgtagcgagtttcttcgcactgctagctagaaaaatcgccacctgtcaaccgggagtgcaccccactagagtccctcgttcccacgttgagatacgctattcttcccctcctaagtccacgcgcggcggagaaagagcttctcgtgtgcactgtggagggtgtggctctgtcgcgcgcgttcccctcgcgccgcctgggagaagaatcccaaaattgccctcccgcccccacctatttcttcctcccgcgcaagatttcgttgctcccacgctcacatggttgctcggctccgtgggtgggagtccctcacgcctcgccctctccaattcacggccaactcgccatagccgctcgcgccaccgacagagttgttcccatgcaatcctcaccttcccctccagagaaacccttgctcgagctctccctcgccgtcgttgtctgcaagaggtaagcaaaccctagccctgcatggttaacggtggcgcgccgccgagggatgggaggataagaagcgtggcaggataggagagcggatcgacgtggcggatggggaggagaagcggcgccgtggatgtggaggagaaacgatgcgcacgagtggggaggaaaagtggagcggcgcggcggaaggcagagcgagcggcgctgaggataggaacgcggattggagtcgatgcgtcacgagaaggaaggggcagatggggcagattatctgtggcccattcggctggggcaccggctaggtatgtatttgtgggctgtgttacctcactaataacataatccagttaagccatttaaaagaggtcgcaagcactgtggggatgcatggcctatggatgattccgggccaatttcgtggataaatgggctagaggcacgttaggagtaccttgtcctatgagtgtcttaaggccacgagtaatgtagaggaaccaagtagtatatatagattgtcgaaacaagatttcggtaatacttaaagggggtggctatcaagctagaaaagtggatgggtttgaaaacaagaaattttatacaggttcaggccttcttattcaagaagtaataccctactcctgtccggggatgattccgccgagtatatattgatcgtatgatctggggaaaaagaagtgtcccgagaggaacccggacccctccttatataggggaaggggtccgtattataaaatacagtccatatcccaaacggaatatatgattacagataaaatacaatcgtaaccgactaagatcccgggtatttccttgacatacaagtttaaaaactaacccgaatcctcgtaaagatattctatctatatttggtgtcgtgtacccaactaaactataactgccatgtagatatgggatatctataatctccacagtagcccccgagacctttgcagtcgacgaaatagctttttcagaacaaaaagcaaaaatccgagtgcttcaattcctcttgctctggcctgccgagtactaaaatcaaagactgtgaagggcgaaaataaaacatggtgcatcgagtagatgcacctaattaggtataacccccgactatgtggttagttgaaaaactaaacgtgtagttaagaaccgagtggttttacaaccaaacatcatatagcaaagcacgcatggtattcagtaaaatacccagccgactgcttctcaacttgaatatatcaagaataaaaatatgaaaagggcccgagtgataaacactcaaaatgtccacaaaaagacatatttgacaagaatccgagtaagaaactcttaaaatgatctaccaaatatgataaaaatcatggtaattaagaagtttaatagcctaggctataaccctcaccataatcaaaataagcatataatatgccaagagaatgactcttaataaactagtcatctcgaatcaacccaaatagcttttgcagcctaataaagcttacaaaaatagtataacacctttctgtcgggcacctttttatttgcatcgtggtaattccaaagaattatcaaactgcgttaaaaaggattttaacagcatcgggtcacatcattgtgagcacaaattgccaaagcaaaaagcgcctaagtccatagggatcacaacgggccacgctggtaataatattgggctgaagtactgtacaggcataggcccattagcactcccgatactctaacaaaacaccgaagtccaagcgacgcttcgtcttccccgccgaaactctcgtcatttccccactccttgttacagtacaaagctgcgccgacgaagctagggttcatcaatccgccccaatccattctcaaaaatccacgaaacttctccacgcgtccaccgcaccgattccccattcccctccagcaacttttcagaccgaatctgactgttcgactcgcacccatggcggaagagagagaaagtttcgagagtcagtaggcgccctccgacgtgacggaggagaatctgaaggaaatggtggcgcacggcgttcttccggcaaaggagatcatcgggtggtggccagcgtttggcgaagcgttcccaacccccgatacacacgaggtcgtggtattttctcacttcttttatggtggattttctcttccaacttcaagattcttccgaggaattctaagcttctatggaattagcctgcatcacctgaatccaaactccatagtgcacattgccaatttcattcacgcctgcgaagcttttctgggcattaggcctcatttcgccttattccgccgaatcttcttcctcaagccccaaccgaacaagagcaaaccatgcgtggttgggggcgccagcttccaactcagaggaacactaagccaaaagtatttctccatgccctttaagacctcaaacaaaggctggcacgcaaactggttttacgttcaaaatcctaaacccgcactccccgagtactcctgtcttcctcggatttaccaggacacatggaattcattgcctatgggagatgaagctgctcaggcagtggaattgatggaacgaatgctaaagctgaaggaacagggtttgcagggagaacaaatcactcggcacttcatcaaaagtcggttagctccaatcaaagagaggtcccacacggcttttgagtttgacggcaagcatgatccaaatcgtgaagatctagactctcttgactttaaggtcatgaaggaaagaatatacaagatcttctcaaatgccattgttatcggctattcacatctgttgccagttgtgccatacaatgcattcaaccctcctccaccggtatgtactcaaacacttcagccttcctcaaaatatgatctcgtctttttgttaaatcaattgacagtggacgatattatgtctaggattttgctctgatgaagtcggatcccccaatcgctcagcgccgatcacctcgccgtcagactggtcaggggagcgggggaccaaagatccggtccgaagcccagcccaacacttctaatccagccggccagtcagattcctgtaagaggaagttagtgctaagtgacgacgaaggcgacgatgctgaaaagactagagatagagaaacaaccagaaaactcccgaagcaagccattccaaagaagaaaacatccagtcatcctatgccgaagatcaggaagtcttccaggtataaatcatataacattcttccttgtactgatgctcacttatcatgaaaacaacgctgacagtacaactcaaactcgtaggaaaccatctgatatagatccttctgggaaggactctgatccgactaacatggagacgagttcttccaaggaaaccgggccgactgctaaggatcatccgagtgacaatcagccggcaatcgacaatgtagaatccggtgatcaacccccgactggaaaccaatcggccgaagctgaagccggagttaatcaggagcccccgactggaaaccagtcggacacagggccaagccaagagattccagaagttgaagctcaggctgatagccctcgcggacatgatgccagcaacgacccgaggcctggatctcctgctaagacacaagagccgactcgtcctcgcccgggaatcatcacgggtaaacaccttgcctgaaaccgtgttaatccaaccgactttaattgatcatctgatctttatccatggatacattaggaccaatgattggtgatgaagaggaagttctccggatacgtgcggctgaagactcgcgcccttccattttggtcaagtggtgggatgatgacttgcaacctcaaggaattgtaataaaccggcaaaaagaagacgaagaggtatgcctactgaaaaaggcgctcggccaagcgattctcattgtaaacgtaagttccttgacgcctgacctcagccatcttgtttgccatctagctcgagcgctgataaaactgttttgcagaggattcaccttaggagcgaggcgaagaccacaaccctagagaaattagttcctcatcttggaacccttgaagctgtcagagatcaattgcacgaagcaaaagagcttgccaagaaaaccgagcacgatctaagggatcggatcgctgagctccaggagtctaacttcgaactaagtggttcatcaaaaggtacacaaaatccgtccgactaacttgtgctgtcatctttgtagcttcaattaaccggagttaatgtagtgcaagctgccaagatatctcaattggagaagcagattcaggctctagaaagcgacaaagcagagctggcaagacagggggactcggctttgaaggatgttgaaggtagcatcaattgatactccgaaagccattgccttctgtatgctgactcattaatatgaatctgttggtgcagaccgcaagatcaagtcgcaggctcaattcgacgtcctggttggcaaaatcaaaagacttgaaggggccagggatgaagttgctaatgttgctaccccactcgtccaagcgatgttcatcaataacaatggcccgagtacacttgatgcttccgaaatcttcgacaagctgagagttgctccggatacatatttcaagaatatcaaagaagctggaagtatgggagcgagtctggcgttagcaatgaccaagtccctttacccaaaaatcgacattgatgccattgacggctttgcagacgggacaagcgaagaagctgttctcgatcttatcaatgatgcacagaaggttgctgacaagatagcagttgatgtagtggagagatttcaggacaccgatcttcgactgactggtcttgatgactctgatgatgagaaaactgatactgattgatgtaatgtaatgacaatgattctgatgatgatgatgatgatgatggaggcacaatttgtacaatactgatgaatttatgctgtgcccaatgtttcatacttagcttctgatttcttaaaagtttttgtcaagccttattgagcctaaaacccgcaaaagctatttaaaaactttcagtcctcatggactaagccaaaaaattaagcaaggcaatgataaatcgaataagcaaattggactaataaaaatcacactccattattatgacaatagcccccgactgataacttcaagggaaagcttgatgttgtcagtcaagatagggagatacagaagcaaacttaagcataaaaacgacgaagatgttcgatattccaagagttgtcaataggtgtaccgtcttcacgcttgagtcgataggaacctggccgagtgacttcagagattataaatggcccttcccataaaggagataacttgtgctgatcccgtgtagtttgaattttcctcaaaaccaggtcgccgactaagaaagcacgcgatcggacattacgattgtgataacaacgtaacccttgcaagtatcgggctgactgaattaaggctgcttcacgggccttttccagtcggtgtaggtcatccactcggtcttccccgtagcgctcttcgcgaaaattacgaaaacgcaatgattcaaattctacttcactaggcaacattgcttctgctccataaactaggaagaatggcgactggcccgtagcccaactgggggtggtgcgcaaggaccaaagtacagatggcagttgttccacccatttgccggcataaggattcagtcggtcaaaaactcgtgcctttattccttggagtaccatgccgttggctcgctcgacttgcccattgctcataggatgcgctacggaggcataacaaatcttaatgccgaagtcttcacaaaaatctttaaatactccactggtgaattgagtaccattatcagtgatgatctgattaggtaccccaaaccgatgcacaatgttgatgaaaaaatctctagctttatctgccgtgattgtgatgaccggtttagcttcaatccacttggagaatttatcaatagccacaaagagatgtgtgtaaccgccaactgcctttttgaacgggccgaccatgtcaagcccccaaaccgcaaacggccaggacagcgggatagtttgcaactcttgggctggcaaatgagtttatctagcgaaaaattgacaaccttcacatgtccgtacgatcttgtcggcatcggacacagcggtgggccagaaaaaaccttgctagtaagccttgctgacaatggtgcgtgcagcagcatggttgccacagataccagaatgtatgtccttcagcaattgtctcccttcttctaaggatacacagcgttgcaaaattcctgatggacttttcctgtacagctcggtctcatgaataatataaagcctgctgcgcctggaaatccgctcggcttcgtctttatcttgagggagttcagaaatcgtataagaggctctctccagtcggtttcgaccatagctatgttttgagtgtccgcggcttcaactgtttctctcttgggtacggttggctcataaagatattcgacgaacacatcagaaggggccgcttcgcatttggatccaaaattcgctaatctgtcggctgcttcattattgtcccgaagaacgtgagtgagttcgagtccatcgaacttatcctgcaactttcatacctcttgtcgataagcgatcatattgtcgttgaggcaggaccactctttcattacttggttaacaactaactgtgaatctccacgaactatcagatgcctgattcccaaagagattgcgatccgtagtccgtgaaggggcgcctcgtattctgccacgttgtgagatgcaggaaaatgtatccatagcacatagctcagtctttctccagtcggggaaattaaaacaactccggccctagtgcctgaaagtctctttgacccgtcaaagtgcatagtccaatactccatcttttccttgggcgtgtcctcttggcactcggtccactcagcgacaaagtcggctaaagcttgggatttgatcgaagttcgcggtttgaacgatatatccaaggacatcagttctaaggcccattttgcgattcgcccgtttgcttcgcgattatagaggatatcactgagtggaaacgatgtaaccaccgtgaccgagtggccttgaaagtagtgggataatttcctgacggtgattagaacaccgtacaacagcttctgaacttgaggatatctcgtcttggaatcggccaacacctcactaacgaagtagatcggtcactggactttctgaacatggccttcttcttcacgctcgacaaccaggaccgcgctcacaacctgagaagtggccgatacgtatagtaatagcggctcttgtgggtgtggtgaggccaaaactggtggagtagtgagaagtttcttgaaatcttcaaaggctttctgtgcttcgggtccccactagaaattgtctgttttctttaacagtttgaagaagggcatcccccgctcgccgagtcgtgagacaaaccgactgagcaccgccatgcatccagtcagcttttgaacgtgtttctaggaacacggcggcttcatgttgaggatggcgttgactttctccgggttggcctgtatgcctctgtgagacaccataaatccaagcagcttccctgacagtactccgaaggtgcatttttttgggtttagtttcatcctgaaagcacggatgctcgcaaaggtttcttccagattcgtaatcaaatcatccttctgcttggtcttgatgactacatcatccacataggcttcaacattgtgaccaatttaagtcgagaaacatctctggatcatgcgttgataagttgctccagcgttctttagtccgaaaggcatggtgatgtagcagtaggccccgaagggcgtaatgaacgaagtcttcaagcagtcggattccttcaatcggatctgatgatatcccgagtagcaatccaaaaaactgagcagctcgcagccggcggtcgagtcgactacctggtcaatgcgagtttgagccatcgcgatctcgcgggtttgagccatctcgcaactttccttgtcacatgtgacagcttgcttgatgtcgctccgtaggaatatgactcctcgaggaccgggcatcttcatcatcatgtaggtatagtgcgggacggccatgaacttggctaacgccgggcgtccgagtatggcgtgatacgctgtcctgaaatcagcgacttcgaagcagacgttctctgtgcggaagttctcccgagtaccaaaagtgaccggaagagtgatctggccgagtggtgttgccgatagccctaggatgactccgtggaagggtgcattactcgggtttaactcggtgcgagggatctacatgtcatccagggttttggcgaataggatattgagtgcgctgccaccatcgatgagagatctgcgaagcttgacgttgcgaaccactgggtctagtaccagggggtaccgccccgggtggaccactcggtcaggatgatccgagcggtcaaacttgattgttatctccgaccaccgaagatattggggcgtatcgggctggacagcattgatctccctttcagtcagcttttgctttcttttagactcgtaagccagagggccgccaaagatgtggttgagctccttactgtgatcttgaaaacctgtcgggggatcatcatcatcatccttctttttcgacgtactttgttctccgtcaggggtcttccgtgcattcttggcatattgctctgcaaactgcttgtagacgaagcaatccttagctgcgtggttggagttgggatgatgcggacattgggagttcatgatcttgtcaaaagtgttgacgcgcgaacgttgtcgggaggagtgtgtagtagtcgcgacgagttcctcgggcttacgcttgcggtccttgtgattgttacttccaccccctcccgtagtcggcacatctttctttgacttccaagtaggacccgactgcttggatgcgataatggcgtctttggctttggcatactcgttggctttttcaaacatctgtttgactgtcttgggaggcttgcgcccgaacttgccaactaggtcttcgtggcgaattcctttggtgaaagcaacgatgatgacgtcgtcggtaatgtcggagatcttgttgcgctgttcagagaagcgtcggatgtaatctcgaagggattctccagacttctgaatgacgttgtagagatcaaactgtgtgccggggcgttcaaaggtgccctggaagttggtgatgaagtggtcacgaagttccgcccatgatccaatcgtgccacggggtaatccatggagccaggaccaggcagaatccgctagggccacaggtaagtagtttgccatggccttgctgtctcctcctgctgcgcggattgcgagaccgtagacggtaagccaagactccggattagtggtgccgtcatacttctcgattccagtcggcttgaagccggctggccaatccactcgacgtaggtcgttagtaaaggcagctactctatccacgtcgtcgtcgtagcgatctggtgaatggcggtgacctcgtgctgcacggcgctgattgattatatcgcgaatatcgacaggacgctggcgaggtggggagcgaggccgttcaactcggcactccctgtgtcgctcaggaggcgagtgaacagatcgctcgtcgtggccccagctcctgcgattggatcctgtgccggtgatgctgaggcttggctggtaataatcatgagatcggagatggggagctcgactgccagtcggcgtgcagacgcttccagagttaaccgggaccgaagcggcgatcatggtcttggtctggttcaagatgttgacgacgtgatcagcttgattgagtgcgtcttccttgaagagggtgtcgaaaagggtgatcgcagcgacagcgttctgttgaagggtgcgaaagaccgctgttccctcgacgtcttgctgcccgatgagatctcgcgctcgtcgccctgcgtccaaggcttgttgtcgttggtcctcggcctcctttgcagcccgttcgcgttcttgttgctctcgccgcagtcgttcttgctcttgtgcttggcgctcctcttctagtcggcgtcgctcggcttcctgctgtacgcgttgtgcctctgtttctcgggcttggcgttgttcttccgtctcgttgtcggccatgaagacgccaaagtagagagggatgtaattgtcttcaaagctttcgtcgaagtcgtcgaggtcacggttgtcgtagcggtagccgaattcgtcgtactccacgatctctgttggtcgtgagtcgacgccgggggagccgaagtagccttccagttgatctgtcgaaaccgtgccgagtggccggagtatgacgccgacttccctggagctaggcaaggtcggtgttgaagccgacttccgcctaggcctacggggagaagacgcccttgtagtgaagacggcagccaagtcgtcggggagtttcatcaggattggcgagtaggccccatcatcttgatctggtggtgttgaaatagatgggatctcgtccgagtggtttgaagccgactcgatcgagataagcttggagtaaatcttggtcgagttcggaacaccgaacggggctgagacctagtccttccctgactggattgaatccgagtcaaggagagagatcttgccgaagtcgttggtgatgaagtcgaggctgccgaaccgaaacgcctgcccgggagagaagacgaggtcgtcgatgccggagacggaacccatcgcactaatcggcgaagaacttgacgctacccctacctggcgcgccaactgtcaaaacaagatttcggcaatacttaaagggggtggctatcaagctagaaaagtggatgggtttgaagacaaggaattttatacaggttcaggccttcttattcaagaagtaataccctactcctgtccgaggatgattccgccgagtatatattgatcgtatgatctggggaaaaagaagtgtcccgagaggaacccggacccctctttatatagaggaaggggtccgtattacaaaatacagtccatatccctaacggaatttatgattacagataaaatacaatcgtaaccgactaagatcccgagtatttccttgacatacaagtttagaaactaacccgagtcctcataaagatattctatctatatttggtatcgtttacccaactaaactataactgccatgtagatataggatatccataatctccacatagatgggtcccacaataaatgacattagttgtggcagatcctatatgtttatagggatagttacagataagtgggtcccatgggtaaataaaatatttctagtcccacctaccgtcaccgggctcggatccagacaagtggacgaccaaccagagtggcaacaggagcagcgagcgcacggcagacttcaatttcaatatgaacatatatatatatatatatatatatatatatatatatatatatatatatatatatatatatatatatatatatatatatatatattctctaaatccagaagacagatgagattctaggattatccttttgggcaaagacttttatgcatacttcttctgggttatctataccatactgtattcacataaagatgatacacgctagctaaagatccaccgggtgtaacgtcataagcacattggaaacgtaaataattgtaaccatatacatataaaatgacagcaatggaatcccaatcctctgcttttatttgtaaagtctctgttcctcgatgatcgaagcccaaacatctatgaagcacctcatgtttgactagccaattagataaccaaccctgctgcattatcttgatatctctctctatgtgtgtgtgtctatatatatatatatatatatatattagaattctccaatgcatcatcacatttgctaaccctagtgatgaaaccacatgcaagaatttagtagtatgattttaagagtgaagatttgtctagttctccgcacgtacattttttgataatgctaaacgatgcgtcttttgaaaaaacaattataaaaaagtttttttaaaatccatattaatttatttttcaaatttaatataattaatacttaattaatcatgagctaatagttcatttcattttgcgtatcttctcaatattatgtttttctcaaacacgggaatatgtacgcaagctttacaaaattttcccgtgcagtacacaccaactagcaaatatcacgaaaaaatcaataaaaaaaactgcatatgtgctcttaatagtattgcacatatattcaaagtctcatattcaaattcatcatattttagccgtaacaaaaattaaaaaaaaagttacggcttaatttgaagataaaatttcacacatatgcataatactataggaaataggtgtttgatattttatataattttccgtaagattcactagtcggtgtgcatacgttctcccgaaacacccccatatatacgataactagtggaaatgtagaaaattacacagccaagaaaaagaaaagaacagtagaatttcagaattatttcacacacatggacagattaagatactctgcagtaactgcaccgtgcctttatcactgatatatgttaaccttcggatttatgtgtactcgactggatctgatcccacgtgggccacgagaaaatggacatttagccactttcaaaatatggtttcgctagaatgccattctgaaaacgcgtttcactaaaatgccaatatgaaacgcgcactcactgccatgcattttcgaaatcattttctctcctccaccagatgatgagacgaaattacccttcctggtgagcgtggtgagcaggggacaaaacgccatggcctcgccggcatattgagtggcggcggcggcggcagctattgtcttctcccaactcggtcgccccatctcactctccaacctactgctgaccacatcgagagaacaagcatgggctgcctctttggtctcaatcccatcgccggcggagatgaagacgatgatcatattcatcaccaagccacggtcgtccttgtcccttttgcgttccatactcaactcatcttgccgaacaaactttcttttgacgccatcgcgtttgatccattgtagcaacgggaacaccgccgcgccatcgtcgtcctggagcgcgctccggagcaccgccgcttcggcatcgtcgacgtccggccatcctcatccatcccggagcaagccaccgcgccatcaactcctccttgaggtcctcttcaaaacccctcaagaaccgagaagaatggagcatcgaggagggagattgacatcgtcttctccaacttcggccgccggcgtcaatcttcgattccctccgctccggtgacctcctcgtcgattctttgcgcatgcaccatccctgggacctaaccaacctcatggatgcacatgcatggcttcacatcgaattgaatgagttggcgtcgtctcgccggagctcagagccgccgctgagacgttttattcatcgctgccatcaaccaagcctcatggcctttgctcggcctcgccctgtcccacaccgtcgtcgccaactcgttccgccgcatccccgacaggtcgacgccctcgtcagcaacgatgacgaccacctcgccgcgctcgaccatttccgccggcagcacaaaacgaaggagagaaagaaagagaagagatggacctgccattggccccaagggcatttccgtctaatcaccacaaagaagaggcaaaatgatttcggaattaagagaaaatgagaaaatggcaatccagcgagttgcgccgccttgatattggtgtattctagcgaaaccgtgttttgaagatggctaaatgtccattttctcgtgggccaccgggctgtgcgaactcgctacgtggaatacttgggcccttcccttcctttccccaatccgcctcatccgataataccccccacccctctctcgtttcggcggcggcggcgcgcggccggagcccgagctgagaccaccaccacggcaccaccacgaacacgacgatgatggccgcggcagcgagaatggcgttcgcctcatgcggccgcctcctcgccccctcctcgtcgtcatccctccccgccctgccaagaacccggggcagcgtcgccgccagcggcaagcatcccgtctcgttcttggcggcggcgagatccgcctccgtcctctgctactgctccgacgccaccgtcgcgccggccccgcaggcggcggccgcggagggggaaggggaggagggggagaagaaggcggaggttccccccgtggaggaggtggcggcgctgctggacatccgggtggggcgggtggtgaaggcgtggcggcacccggaggcggacacgctgtacgtggaggaggtcgacgtcggcgaggagcagccgcgcaccatctgcagcggcctcgtcaactacctccccatcgaccagctccaggtctaaccatacacacaatccatccaagatttcttatcatttcaattcaacattagagataattcaatgtaagagtaagcactcaccgcggcgtatttatgcttttgcatagcatatggatcacaaaaatgtctcatttcaatccatccaagatttctcatttcaatttagcattacagaaaattatttgagagaaaacactcactgtggcgtaattaagaagctttatttagactcggttaattacatcgagatgatcaatcgaactgagtcaaccccggcctctgcataaaatgcacacaaccaaaaaagaaagaaacaactagaaacatctcccaagcacaaaagtttgacaaaaacatatatccaaaagcttacgcactacatggatcgcaaaatttcttcattacaatccatccaagatttctcgtttcagttcagcattacagaaattctttgagagtaaacactcagctgcggcgtaattatgttttcacatttacatggataaaaagaaacctctcatttcaatccatccaaaatttctcatttcaattcagcattacagaaaattcatgtaagagcaaaattatgttttagcttggcatggatcgcatgattgtgcatttcagaacagcaatatgtgccttccaagtgtcgtatatcggtatatggaccaagatgtatgctggagggtatgcatcagagagcggagcaagataatcggttataatcatttttaatttatcaggaaatgcatggattggattaacctggcccaaaatcccgatgctttactctgcaaagttagcactctattttggtcaagattcaattcgcaccaaatctggctgcgcatgtacagccctagtgttaacagagttcgggaacgaaaactatgctagtcaaataatgtgtaggtccttttggttatttcttttcgtactactgatgacaactgctattgtttgtgacacatgcaggacagcaatgtgattgttcttgcgaacctcaaaccgaggaacatgcgggggataaagtcaaacggcatgcttatggctgcatctgatgcttctcatgaaaatgtcgaattgcttacccctcctgaaggatctgttccaggtgaaagggtatggtttggtactgaagatggaaaggatcgccaatcagaagctgcttcaccaaatcaggtaacactttgggtagtttaaacttagattaacacattgttgttttaacaattgcatttcttatgaaattcaagaaaattgatatagtttaatgtagaatttaagaaaaatattttagttaacagacctcacctgtatatgtattgataaactatgctacagttttatactatacacatcccaaactaaagtatttttcagcatcgcagttaattggattgttgtgttcttttaggttcaaaaaaagaagatttgggaatcagttcagcctcatcttaggacatcagaaaactgcacagcatttcttggcgagcacccgatgcgtacctcagcgggtgtggttttctgcaaaactttgcagggtgcaagagtgtcataagtctctttcaagaagctttttttttttcttctttggtatccatattgtgtaccttactgaaaataatcatatggtatgagtaaaaatcttagagcaagatggtttctgaggctttatggaggtcgttcacaattttgtagctttctgatgtcaaagctggaacattttacttcaattggagattgatttataatttgatcatgagaattcgaaatgtgattaactttgtaaggaagttatgtggtactttgataaggtgatttctgctcttaaggatccatgtgcactgctgccaaattactctaaacaaacagtaaacacaacccattagccactatatagtggatattaaccactatatagtggatattccggtcgcctttcggtctgttttcctcagcaagttctatgatgtatgcaaatgttgtgatttctaaacatttttttgagcatatctcgatgtcatagagatcaaggtttcccttaccgtttttggcgcggttaccgcacccccacggtaaggtggttaccacggtccactaaaaccgagcggtagccgcgagacataccgtggttttaaaaactgaaaaggttaccgtgcatggtaaccgtggtaactgtgcggttttgtaaaccctgatagagattaccataagccgaaacgattttagcgccttaagtgtccatataaactggttgacagttgcttcacatgtattcatcataaattttgaggaacaatgagatcggaaactcatgaactgactagtttctcttacaaatgcagtaaatcttggattacccatcgatctaatgccatatggtaaattgaagatgcacatatatactacatcaacatagctgctactttgatttccgtgatttgaatatgttttccttgtagtattgtagctccttaatgctttctctaatgtcatccatcgccctgtggttcttctccttccttggagcatgtttcctttctgcggacagtaaacaaaacaaagcaaggttatgttttgtggagattctgtaactttttggtctgtaaataaaggaaattaaaactgctatggagaaaataagttgatttcaatcaacttcgactttttaaaacagctacctacgatgtatatggattgatatacatcgacgatatttttttcctcaattacaacgtgattctctttttcaattccacaataatgtgtgggaattcagttgttaaagaataagtcagccagcagcttggtcaagtgcagaatttgttaattcacggaggaaaatcacatcgcacacacccaaaagtgtagcaatcagatattaaactgttgaagcagaggactacaagcacagcacaagactgaaagcaagaattaacattacatttataaataccggagtaattttacctttggggaaccatcgggagcacaaagccgatatactgcttacatcaactatcacatgagagaaaatggctgccagatgtggcatgtacttctataaaacaaaacaacacagaaaattgtcattcaaaaagtgtttcaaaacaaaattcataatgctaactatcctatgctagctcataaggatattggaatacttttcacaacattctttgaggttacataatttatttatataatgctgaaggtgaaatcatttggctactatagtgatgtcagttggacagaggtgacctttgcttgctagatacaaattcaatattacctaaactgaacattttcaacacgataataaaaaaagttatgtaaatatacaaaatctcagatgcaattactgatagaagggacattgaatattgtatcagaatacaatttttcatataccaaaagaagataacaaagttgcatatggaaggcggcttaaggaaagtccgtaagttttatttgagcaatatatgctctatgcacaaataacactgcagtgcaattggtatgcagataaggtaaagtctgcaaagtgttgcattaacttgagttctgcaatattaaaaaaaaaacgctttccaacttaacagcacagataatattttctgatctcattctttaccaataaatctaggataaactaaatcgaaatcgcacactggcctgcctcactccagatttaaccagttcaataaggccaaataaggacataataaaatccaacgtaaaggcatttcaaaattacagcctggccatttgcctaaccatttcacttttaactgaggttaagtgtatgctttctcttactaaccttcaaaaatagtaaatccatatagacagaattcccagctatcagtggagtggctgagcctatatacttcctaataaaatctagcacctgaaaataattgacaaaaggaaaccttcattaggaaattttacattggaaagagaaacattcagaatatgaaaacatgcattgaacatttgtcagaaatgtacaattgaccaaaaaatagaaatagaaagaacgcttgtatgcaacagtaacaacacagacagagacacacacatgcacaaaggtagttctacacacacaacttggtaaagtttccatagaaactgcaatcgaggagaaaaaaaaggtaaacataaatggcaaatggtgcagtaatataatgtattattgtttgcaagcaacaaaatcacaacagatatcataaatatcgttcatcttacatatgttggcaaaatacattaactatcaaaagactgaaagagacctagtttacacatagagcagcacaacaatagaacatgatttcactaaagctatactacttaaaatgttagtagtggtggtgtccatttccacaccaccgctatcactaacatctgggccccacaatctatactgttataccacttttcaacaagtctactattggctccccccaaatttcaaaatcacctacttgttcaataagaaaaatcatggtattacttatactaaataagtgcttattaattgatttaataagctagaaattcaatttgttttccattgcaacgcacaggctaggctagtatatcaagatgattgtacactgtagtcacatgtacactgcacgtatacagtatcctcatttgcaaaactcatgattgtagttgctgtctagcaacacaacaaagttccacctagtcatctactcatcttgaaccgcgatatgtggtggataacgccattgaacactggtaaaggagttcgatacaatacattggccagtaggcgcctctttctatcggacaaaattctgcttaactataagggcaccttcagagattcagatgtactaaaagagaagagcatacttgtttctcagcatcattctcagaaatgtcgctctgcagcaccttttccttcagccctgaattggtttcatgagtaacagatttttgctcacaagtatatcattttgaggaagataagctgtttaccgctagcgctgtgatgaactttgcaccattcattcatgtcatttacacattccttgctctgtcttataaccaagtcaggaccctgcaaagaagtgactagctatgtttagcaatatctctggatttgagataccatcactacccaataaggtaatcagattgcctatgccagttgtgatcaaattgcagtattgatcaactgatatagattagaaacttgatatacaaagttaaatttgccaaacaacatggttatccaggatcataatgggattaatagaattggaaaaataagacatagactaaaccccaacttatcggaatcttatggcatatctccttgcatctttcctataccctaatattcgtaacataacaacatcttgattcagaatatatttgtttctattcttagatttacattgagacatatcgagctaattagtactaaaaacaaaataactcaacattccgatagtcctgatggatttgtagccttatttagcagtttttaacatctttatagaccatgagcttggatagaccagtttcagtatatgctactacgagcaatcattgcatagtgattaagagtcacatattgcacagccatataaaaataaactgttaaggagcatcgtaaataccaatgaaacatattattataagaaactgttcacttcctaaattcaaaagtcaatggtgcactacaagttaggtatttctgagcaaagaaaactattaatatagagcaatcagaattgcagaaacacttagtttcaatagacacctctattcgtttggtaagtttaccgtctgttataatacaagcaatctccagtatgcgatctttggtgatatccaaacctaaacaattaaaaaccagcaggctcccaattagtacactgtatagttttggtttaacgcatctacaaatttaacatagaagagaacaataacaaaaatgagagtgaaatcaagaaaccacagttcagaatggaagactgaaataacatgggaaaagttcctttttaacaaattaggaatatcaagtgaatcagtaatgacctgtatattgtttagcaacagtacaaagcatacaacccaccattatgtgtgcatgacaccagaattcagatcaactttagaaatgtagtagtatgtatctttacaaagagtgaaaaaatttatcagttgtaaatcatggccataatttattgatagagatatagcatgataaatatttcattgcaaactcaaacgcttaataaccaatttgatcaatattgtgtagaaaactggagataacacagttaaggctttatatataaataatggaaatatagctctcatggttgaggaataagttttattaagcatatttaaaaaaatctaatgaactcaaaagaaacatacagcttatgaaaagaagactaaccagtcatttccaagtctatccacactaatggcttatcataatcacttgatgatgaagcaaggttttctccatcgtggtttacaatcattgtgtgattcagcctgattttatctgcaaagtaaaagtaattttaaatctcatcctgaggagacagcaattaaggattggtgctatgcctacaagacaaaacaactaaaataaaatatttattcgtcactgcagaaatcaagttagcatgttaatgcataggtcattgatctattgttagaggatagatttttatggactttcgtgattctatcactgacctaggagattagatcaagtcccctaacaatacattattgctttctgatacagtgtaatttggacttctataacaaaaaatgcattggaagaattgactttagttttcaataagccacccactatacattgaataagactgcatgactatttagaaagcttcacaaaccggtgaatggaataaaagcctctgattttatgctttgacaaacaatatttcaggatttaggactattgatctatgagatcagacattcatgtttcaatttttttttcaatccaatctaaaactggcaacataatatcatatttggttatgatgaatcgatatcatgagaaccagtagattatttcactatgaaacatcatggttgacagcagcgcatcacttcattgacccagcaccgaaatacaccgccaccaccacgggatcaacatttagcagcacatcacttcattgacccagcaccgaaatacaccgccaccacgacaggatcaacattggtacaaacagagagcatcaattcaattcaacaatgcaaaggatggaacagcaatagagcgctcttcttaccaatctccgtgctgctagtaacagcagcagcttcggccttgctggatgttggtggttccgcaccttcctctctatcgtcctcagcatccagattaagaacagagaacatattcgcgagtttgctcatcttttcccccaagaaaagagtgacggagctgtaacctggagcatgcggggggtacagttgaaaccccccagatttgggggggaaaggaactgctattagtattagggtttaagagagagacagaagaagccttagcttccatccagatctagtagaagagaaagataaggttagggcgaattggaaagaaagggtggtcactcaccggaggcggaagcgggatggatggaaatcgggcagcgcaggagagcggagtcgagggcgagaagacgcggcggcggaagcagcaggacgacggcggcgccgctgctcttcgcagtcggcacggcagcaggtgtgacggagtcgagatcgatcgactcgtcgtcacggctcacgaaggcccgcgaacgtgagggcccattaagctcacattgtcctagctcaagcaaaagtttttatattttttttaaaaaaaaatacgaaaatgctcactgccgggctacccctgcgcgcccctccccacgtgcgtacctattcggcccacccacttctctctcctctttttccacaaaagatatttcacctagtgtattttcaatgtttcactatttatagatttataatgttacagtgaattaaaatactcttttgcaaaaaaaaccacatattttagaaactctctattaacggaatttgatttgtttttttcaaaaaaaatgtttcatctagtgtacttacaatgtttcactatgtatagatctaatgttgcagtaaacgaaacattccattgaaaaaaaaacccacatattttggaaaccccctattaagggaatttggtttattttttttgttccaccgaaaaatgtttcacctagtatactcataatgtttcactatgtatagatctaatgttgcagtgaaccgaaacattcttttgctatttgctgaaatattgtttttatataaggtgaaacaacacccgatttaaacgagtgaaacattttcgatctagtgaaacaattccgatatacctggtagaacatcgtgtaacatttaaaaataattcaataataagctttttttttgtcagaatatatccatgtgtggtcttgttttgaagatttaattgcaacgaattaatgatgcaaccggatcatgatttggataagtaatttaaaagaaaaattggtttaaaatagttttgcacgtaaatcgggctgacgtcagcgcccgatttccctcgctccccgtcggacgaccgacgcgtagtcgcgtatgttcttttaaagtagggcggaacacataaatcctcttaggattttgttttgtggcagacgatgagagggttacaccatgacaatttcacaggcagccccttctcattctcctctaagacgatttatcataagaagataactacctaccatctgcaaaatacgggtggggtgttgcctgcaaaataaccatttcccgatccagaggaaggcgatttatatggcccggctatgaaaagccttccctccctttgtaaatcattattgtattcctcagaaatctagaaaataaaaaagaaagaggaggtaaggggggataagaaggaagcggcggtactcaatagaagataaatacttttagccattgacttttcaacacattggtactagtaatgacattattattgcaagttactcccttcatcctagaggcctagaggggagaggggaaagaagaagagtgggcaatttagtcataaaaacttgaaaaatttagtgaaggagtaaatagtagtatatggcctggaaatttatgatggtatggttccaattaaccctttaattacatattcacaaccactttttttctccatttacctattgtccatccctaaaaattcttagtagtacggactactcactgcataaaaaagaaaccattctgtttcatttacttcaccagattattcaaatatttgctacaccctattaaatttaggttttctcaaaaaagttttggtttcagctattggttaagtttatttcttaggatatttaatatatcgtgtattaagtagataatttgtaagaataatctagtcgataatctaaattatacagggccagttaagcggagattaagtttcaagaggaaagaatatgctaccctttttgtaaatgacgtgtggttgaaagtataatatcaagaaatttgaataagaagtgacctttgaataagatgaatggttacatgttataatgttataccaaaaatcaatgacattatttattaaaaaacagttgtaatattttgtttcattcgaccgaagaagataattaattcgtactccccgtactcattaaggaaatcgttttagacagtaacacggtctccaaaacacaactttgacttcttgtttctataaaaaatatttattgaaaagtgatatatttctataaaaatatttattgaaaagtgatatatgtatatttttatgaaagtatttttcaagacaaaactattcatgtaatttttatattttcaaattattaatgatttatatatctaaggtttaacttaaacattgtcctaaacgacttcttttatgagtacggagggagtatactcattgaaagggcaacatcagttctgaattccgtactctttgtgcttcagaaatactgcagtttaagaactctattctacctctgtaacgagggcaaaactaaagcaatttgatgacttctgtccagctaaaatgttttttacatgccgtagtcaaaaactagttagtacagtataaatttagtatgttgcatctcaaacttttggtatcagtctctctcagggaggcaaaatgcctgtaaatttttcttggactcttcccttcaatttcactacctttgggcaaaccttcccaggacgataaaataggacagagcaatgcagcatctcaaaattcccggataagcttatgcatggttacagactgaaggtgaacatgacttgtccaaaccaaaccagtaagcttctttgtgcataaaattatctgcataaacatttgatatatcaaaaccatcatattaagagcattcaatccagtaaatagacatactgcagaacacaggacatctagcaacatcatacacatgttgaatggtcccaaacgtaggtgcagtgaattcatgtgtattacctgttgctccaaaagatccaacacagatggccatctttttccatgcttttcatgtcagctcccttatgtccttcagcaggtaggctattcctcacgctgcctgccttccagtgtagcataatcaagcatcaccagacctacataatgcacaccatcataacacaaagcaatcagtgtaacacgattttttttcacggtgaacataattcacaaagcaatcagtgtaacacgattttttcatggtgaacattattaagaaccgttgacagcaaagcacattattttacaaacagtttgccaggactgattcacagaaatagcaaaagttcaaatcacttgacaatcatcatcaacccagggcagacaaaggcaaagctgattaaatggagcacaaggtggaaaatagaatgcctggaaaaatgtaatgaatgcacccacatcaccccagtacagtctcctaaacataacataagatcaatgcaaagttaaacaaaacatcattcaggatctggttcatgttcagaagaaacaatgaaaggtcaagtgtttctttctgctgtttgaggccttcttttaaagcaaaacgaaaaggtaaaaatctataaaaggaagaaacaagcagcctttggcatgtatttcaaggaaaatggtatatcatgtatttcaagtcacgatagtatttaaaaataaatggaaaataaaaacttgtggtaacttatgtcagaaaactctatagtttacaatattcagagttgttggtctaagtgtcaaatgtaaaagtgaaacatggaaacttcacattttgatacagatctgatcaactccatgtcctccgatagacaaaaatgagcagtgactgtgttgcgtaagtacatactgcagatagtgcaaaccacatcacacatatatggtattcttttaagaggaaaatatggtaatttgacacgctcacgtatttgaggaacttacacttgaaaaatctctactactttaaaattccgtagtggtggcggtgactccaaccctggaagacacgcggaacatgagctgttggatcgccatatccaacgctcccagttatcagttatccccatgtgcttgtgcttcccccctccgcccgcaacccaaacccacgtcgctctcccgatccaaccgcctccgtccaaccgccgccgccgccgccgctccatcccctcgtcgcgcctcgccgtcgcaccacgatgcgccgccgccgctccatcccctcccgctccatcgcgccgcaacgccagattcatcgccgctcccctccctctcgaccgtttctctcggcgccatctccgcacatccccgccagcgccggatctcccttctcgccctgtttccttgctgaagcattgtcgtgatattcagtttgatctgctcgtcatatcgctgccgcacaactcgccgaataccaaggctcgtaaacaagcgccgccgctgccgccaaatccaccgaaaccaatctacgcggccaccacacgatggatgcatcaccgtcaattccgccctcgccgactccgccacagccgcctactccaccgccactacagttgtcaacgactccgccgccgccactcccgtcgtcgccggctccgcgaccgccgtccgtgctgccaccgcccttgccgtcatcttcggcgccaagcattgtcagcacagatatcgatccggtaagttaagcacctagcttaattagtccatgaaaactatcgatatatatgtgtgcgctgtattgcgatttgggttacttagctaggtaatgttaatgcatggtactgtagattaatgcaaggcactgtacgttaattaattattaattgaagcacctagctagccatccactattatattataaaattattacttataatatatcaattgcattaatatatactcctacactagcttgtgcgcagttctcaggcttgcttctttacttatatgaggaactcatctctcgcactcgcaaaactgagggactcattaacgcatgattaattaaatattactccctccttcccaaattgataatcatgtaatagaatccaaaatttctcaaattgatcatcatattactgcatggacacagatttcatctaaatacaattaatgcagtatgagagaatgtgtgcatgctatgatgtaattggcatagggttttaatcgatgcatgcattgtgggagaatacgtgcatggtgtcttgattgatgtgatttaaattgtccttggtcttggtacataaacttatatgatgatcaatttgggaaggagggagtagtttttaattagaacaaatagatttttatggttttatacaataactctaacaacataactcagcataaaatcaacctggccatcagctcattttacgaatatacaatactctgtgtggcatgattcaccaagaaaaaaaataattgatagctatgatcgagcaaaataaagcattgtaccaactaatgctacactaatattgacctccctgccgacgtgcttttttccagtgttatatataatctccatgtgcaatatagatatccttgcttaatctcatgtggtactcaggtcaatcaagacgccattcgtgctgatatgattacaacctgaccctcgaataaagcaaaaaattcggaatccgaggagcatggaaattttcagtttgaaataagtagcacagcctgaaatttctttaactgggaagaccatttgtacaggtttggtttcaatcgaagctacaggtttaatttggaagatcatgcagccatgatgctacaaatattaatcttgatggtttaaattaacctatttcatctatacaacttgattcagcttaatttagttcctacattagtgcacagttattcttcatttatttgtgcgtacaggatctatggaagagggccattaggtactaagagacctattgtgccattatattcatgaattttttggctgtttgtaacctgtgaaaacttataaggatgtgatgaaattattgttcgtgccataataaggttttcatcataataaatttaattattcaacatcattttactgtgattttaaattggtgtatattttttacccgttgcaacgcacgggcacctacctagtaaggaataaaaacaacatggaataggggagctgaacaattacttcatcagatatttattgttgtggcatgattaattgtgaaatgcactatttgaatgagaaatccccatccatatacatcaggaagctaaacatcattgaaagactatgaccgtggatatactataaaaattaaacagaggtctatttgtcaaaattgaatgacaattccaaagaggaaattatatcattgactatcagaataatatgacatggctaactacatatttgtagtttccaaggcctcatgctactcacaatatttagcgtgcactactgtcacaaatgtaacaaaaaacaattgaataggcactatcaggccaattaaaatatgccaatatgtggctatagaatgatatattactgtatgaaactatgaatagcaataagacagactcacctagaggattcacccaataaatttgtaggttcaaatcttccatcttgtgtgaataatccatgtgccttttggtttgttgaatgtccaaatgcattagtgtcatcaatactgcgtagttttgcttccagaaggttgagagatgagtctagtttcactattttcctagaaatggatagtctattagtccatagtttcatcagataggtacaagatgtaattcagagaagtatttatgctgacctacttttagtaataagcaagcaaaagcttagtcaagcattagattttctacagcaatgggaaagccattaacttctctcaaaaacagcatgattcatcttttatattccctccgtactcgtaaaggaagtcgtttaggacaatgtttaagtcaaaccttgggaatataaatcatgaataactctcaagttgttgagtttgaaaatgtaaaaattatatgaatagatttgtcttgaaaatactttcataaaagtatacatatatcacttttcaataaatatttttatagaaacaagaagtcaaagttgtgttttggagaccgtgtcgctgtccaaaacgacttcctttatgagtacggagggagtatatgctaaatctgtgctaattgccaaatcgccaacaatagcttctcatatccttctctcattgatttgcaaaaagaaagacagaagtacaaatttcaaagtaatcaatacaaaaaataacaacttctacaacacaattttctctagtgtcgtacaccaattcataagtttagaggcataggttgtgaaagcacgttcctcgcacttagcaaacaatgacaagagatatccttaatgctcagcatgaattgacttgtaaaaaatcttaaagaagatttatgcaatccagttaagcatgtcattctccaatacaacacttattccacaaacacgaggaaatcctgaacaggctattatcaaattttactccaatagagaactaaatggattcataagaaattaatagtgcaaaaatgtgcaagcctcctacaaaggtattttccaattcacacttttttgtgatggtactagccctcctagaaaaaaatagataggtaccatcacaaaaaagtgcaagttgaaaaatactattgtacttttttgcgatgctaccaagtaaaaatgcccttctgaaaaatacaaggattgaacgttgtatcccttttagagtcttgcaggtcaataattttgtaaaaaccaactcgttcccataattccggtgagttgtgagttccacacgatattgcatcaaaatagcttaaacattttccaagatactattcagaaacaacacatgattccggtaagaaataatttcccataatgctatgagattgtgatcctgaatcattgaactctagaggcaatgtccgcttccctgtattgtacacatatactgacttcttttcatgtgccgacgtatataattaccctgggtaattaactatttgccactcttacgagtggtgataaaggatttaccactagacccacatgtcatagatatatgagggtccacatgtcatagacaacgagtagcaaatccttaattagcacatcttaaaagtggtaaaaagttaaatgtccctagttacccatatcttagcacaactgtaacacacaagcagctatagcgatatctaggaatacacaaaagatttgggattttttattttttattttacctgtggaggagggaaagcttgtcattgcattgcgccgcgaacgagttgaggaactccaccgtgttcgctatgaacatgttcacctgcaatgcggagagagagacacacacacacacgcagtcagagacgccaaaagaccaaaatcgtttgctcaccccgaaggtggagcaccaccagatgagatcgaccgtggagatcggagagggggtgagggggcgagtgaaggcggggcggaccaggtagatggtcctctggtcggagacggcgatggccctcgcgctctcctcctcctcctcctcctcctcgaacccctcgtccctcggcgccggtgcggagggaggatgcggcggcggcgagcgcatggggctcctcgccgcggccgacttcaggtggcgcagcatggcggcttccggatcgagccgagccttggaagctggaacttcaccttgcgcggcagacaaaaatcaagaacacggcggcggcggcggcggcggcgtagaatcgccgacgagcgagcagagcaaatctcgtactgtgtccgtgtgggatctaacctaagagcccgttacgaactgccaaaaaggcccatcatggcccatgggccgatggtcaccttgctttaggctgtgtttagatcaggggtgaaaaattttggcacgttaaatcggatatacggacacatatttaaagtattaaacgtagtctaataacaaaacaaattacagaatccgtcagtaaaccgcgagatgaatttattaagcctaattaatccgtcattagtaaatgtttactgtagcatcacattgtcaaatcattgagcaattaggcttaaaagatttgtctcgcatattagtcgcaatatatgtaattagttattttttagcatatatttaatatagatattcaaatgttcgatgtgacgggtgaaaaatttttgggtgggatctaaacaaggccttactcattttctgcagagtaatcgatgcatggggtcccatagatatgatgatccatcatggcatcatttcctctcatgggagatgagaggacctccacctctaactttttaggtctgttttcgaatgccgaaatccaaaccgctggacagaaggaaaaggggttgttatactatgggattttgttgaatgataatggtacatataaggtattaggtgatacttgacgggaacagatgaaacaacatatatatcgaccgatatctgttggtatcaagtctcgcaccatctagtatcaaatctgatataagatcgattcttaaatatcacgcagtactatacctctacttctctctttctccacttcaattcaccaccaaacaattcatccccaaatttatccccttccccctcctcctctaagaaagtgaagaacaagaaataaagagaaaaatagtttgtggttagatctatgaacctgtggatgaaagataacacctccatgccttcaccgacctcgtagacttacttccatgttgtcactgctgcaagtggtgctgaccagcagtaacgcctcctctccctcatcgttggcatcgaggcagcactgaatgaggttgtggaggccacaagtagtgccgactgccgaccaacagtaacgcctcctttcccttatcgtcggcattgaggcggcgccgaacgaggtttgtggaggccgtaagtggtgccaactagtagtaacgcctcctcttcctcatcgtcaatgtcgaggtagtgccgaacgaggccgtggaggaaagggaagggaaaagggcgaggttgtggagtaaggggaagggagggagcacacaacggcagcggcgccacccactcttcatctcacctccttcctcaaaccatgtgagtttctctttttacgaaagaatggtatcatgcggggtgtggggtaagcattcccattccgagctaggtggatagcattttcgttattgtttggatgcttagtagaagaggacttttagatataggatttcaggagagagatagaaaccagaaaagtttcccataaggtataggcctcttttggatagaaggattttaactttaaatgccatatggattttgtttcatatgtctcattccaaatgaaaataagaatgagctcatagctcatgttttgtttttctttgagaagtcccatgcactcttttcctttctctctcttacccaaacaaacttctttcaagattccatgttgacactagttatagtagtcttgtgtgtttggcatccaatttgacaagagcatgatattcatcaattcttaggttccaaaagaagccctcaacctcatcttaattaaatatccttccaaaatatcatgaattaattcattccaaagtaatattataggaattacaaatgcccattcctttgttgtaaaagagcacctagaaaacttttctatgggatttcaatccttcaaaagctatttttcttttgttccaaaggaacccttagactaaggccctgtttgtttcagcttaagattactgtaatctagattattaaaccagattactctaagctggattataataagttgacatagaataagctgcgagctgtttgtttctctatattattggaggcatctaaggatagtgggtctttagccacccaataatctgaaaaaagctcctccagaggagattattagattatagtaatctagcttatagatcataataatctacttgtttgtttcagcttactcataataatccagattataataatagtaagctgaatcaaacagggcctaagttcgtatatacctttaggagttagctactccctctttttcttagcatacattttttgaactgctaaatgatgaacttttggcaaaaatcttcgatatagaagtttatttaaaaatcaaatattttttaagtttataatagctgacacttaattaatcatgcattaatgacccatctcaatttgcgtgccgctaaaaagatgagctggaacccacgttagtaaagattgatacctatgctctacactaaaagttgggtctactaaggcttaggccagtcccaacccaaaacactagatataattttcataaactccacatcatcaagaaattagtactagacaccactctttcaattcaaacaccacttttccatatttaaatttaatgttacttatctcacatgatgtcttgaatgttgtgtagaaaccatgtctcatgcaagacctggtttccttctttttctcatttattcacttgctacatcattttttttaatcctaggtggcaacttatttaatgctatggacactgtcggtgatatgggaccgggagtatcatgaccagaggcttgaggcagacacaatcgcccacgtagcctggcaccttcggggacgtcgggcccgagggtgaggtgtccgccctcctcctgatttcccccgaggggggggggggtcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaaaccctaagcaaggggaggcgcttgagagggtcgacaaatccgcggcgtcaccagccgcaggtgatgcaggggaacagcgagatggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccacccccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagttcctccaggtctatacgaccgggattgaggccgctgggggtgacgacagggtcatggcgaacttctttcccatggccctaaaaggacaggcgcggggttggctaatgaacctgccacccgcgtcggtccactcttgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagcggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccctctgcccccaccgccccgaggcagcggatggccacttgcgacgaggtcccggtcaaggaggttgccttgggcgacggcccatccaggaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggtgcaaggccggtccggcagaaagtgcggcggcaagccccggaacgtcaagccttcatccgcgaggaggtggctagacttttggaggccgggttcattcgtgaggtcatccacccggagtggctagcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcctttcgggttaaaaaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaaaattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaggccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgtgccccgaggggccacttggacgaagaacgccccgggggtacggcccctagcgaggaggatcggccccgccgaaaggtgcaacggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctcacagctgcctcaaaccgcccactgggtgatgcagttcgacggttctctgtcacttcagggcgccggtgcaggggtcacgttgatctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgcaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatatgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcaccccccctcgggtgtgcagggttagccgggggctaccacacatgcacatatattcctttcagcatttcaataaaagcagtttcaatttcctaaaggttgtgtctgtgccgttttttccttttgaagaatcttgacttgaaatagggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgtgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaaaaaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggttctctcggcgcggacgctttcaaggttgcggcgcgcctgctcctcttgcgccgcctcacggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagcccctctccacggcgccggcatgttcttccagcgccatggcacgggcctcaagggcctcctcgcgccgccgggacgccgcttcggcttccgttgcccgccgctctcgggcggcagcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctaaatccgtctagtaccgcggtgtttgcggcggccaaggcctgcataatgggctcggcgctcaccggggcgacagaagaggaggagaaaagccgccttggagaaaaagcgacgcggcttggccccccggaggatacgctgagctcggggatgtcccccgggcccgtttggtcctgggcgtcgcccggtgaggtaggcccaggcgacgcgcccgcggcctcatcgcgagccgcctcggaggatgtcgcctgagggccgcccgagggactgggcccgagtgacgcgccagcagcagctgccgcctcagcttggcgagcccgggcggcctcctcccaggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcctcggcctcgaactggccggacttggggtggcgggaggaatgcgacgggacgtctctgaagcagaagaaaaagccagaagacgaacaaagtgagcaagaaaaaacttctttttggagaaagatggttgcaatgagagtaagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccggccactggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacgcggtcgggatcgatgcagagggggaggatctcctgaggaaggtgagacgcctccgcggagctaaggttcagcaccctttggaccacgatcttgaagtcctcgggagcccaatcccatctggctccctggtgggtccgcatgaagtcttcaggcccagtgtactcccaggcgctccgagcgcgccgttggagcggcgcaatccggcgacggaggtaatcgccgtacaccatggccccggtgagcccctgggatcgcaggcccgccaggcggtcgaggacggcgtcgtactcctcccccagatctaccggcgcccgccagttagagacctgcgccgggggctggcttggaaggcggaggcgcgcttcgtcggcgaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccagtgtcatcaccgcattgggggtgaggtgcgccatctggagattgtagaactccagaacatccatgaaaaaatgagaaaatggcgggaccagcccagccatcgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtctcgaatagaccgcccattatggacaaccaaagttaccaataccaatgtgcatggattgagaccgttgggtattttgcccaactacggaaaccggtcccacctgtcacagggtggcgtcacacctgaccgcttcccttgggaagggaaattgttctggcacaacgccgggggctactgtcggtgatatgggaccgggagtatcatgaccagaggcttgaggcagacacaatcgcccacgtggcctggcaccttcggggacgtcgggcccgagggtgaggtgtccgccctcctcctgatttcccccgagggggggggggcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcagacaccatcctagtcattgggttaggaatggccttaaatcccatttgaaatgtacaaggccaacgtttagtgtgcagtgtcatgcttttgtgcttgaggttatccatttcttagaaataatttttttaaaataaattcttagaagtgtctaaataaaaaaatattcatatgtggtggtaggtgcacagatggaagagcaacctataaggtaacaacaatttgagtattctcgattttttggtgccacacggtacacccctttagcttggagttgctatagttatgacaggttgcccttgccattagtggtggtatgcaatcatcccaaatattacgaagagttaacctctagaactaacaaacatccttaaaaaaaacaaattttgctaagaacattcaaagtttatatagtttgctggtagatatcgtaaaaacatgatacgattggaggacacactcaaaatgtggtaatttgttatagaatactttcggccaattaaagagagaaagtctttaaaatataagcttagcttctatttgaaaatttgaaaattatgcaactctaaatcttccatcacccaaagtacattgcttgcatacatcatattccatcaccaaagtcaggttagaagcttttggctcgaaggacattctcgtctttttgaataatctctagccaattaggctgaatgggtcctctagcaaattattagctttttacagtgttctccaattgttatacatttttcgatgtctaccaacaaattacacaaactttgagtatcctgtagcaaaatttgtcaaaaaaaaaaggtacaaacaagcattgattttctcataactccgcatatttagctttattgcaaaaaaaaaaagaagacaaagaaccttcaaaactttctaaaatatattataaacactactactttattgaatcatctccaagaaaagagtataagctttacaagaatatatcctatttatgtgaagtactaagatctttacctaaccaaaagaataatcatgtacacgattttgaggcagctcagactgaaaacactcaacaatgctaacatcacatgaagcctcttattactatacaggaaaaagaactgctccagtttgatctaccctgcaaaaatcaatacaatcagtctaccaattgccaacaaacatagttaaaacataacgtctgcaaagaaaggaaggaaggaacaggagagaaaacggtcatagaaattcccgatcgaccgagcgccgtttccgtataagggataccgtttctgaccgtaccgtttttggctatcttaaaattttttttctaatttctttctgcatcgtattaatatcgatattgagtagttaaaatgataaatatggtcaattaccggccgatcgagcatcgtttctgaagagatgctaccgattccgatcgttttcgaccgttttcacccctaaataggacgaccttgttctatctaaataaaatggtaataagctctccccctatatggactagaacacttcaaagttgcctcaccttaaaatgtatcaagatttaggggaacatcttcatcaggcttcgcttttggttgagtttccttgccaattagtttcagaggaacatctagttcaggggggctctgcacatatagttatttagataatcagtgatgcactaaacaaactatctttgtcgaaatgtcttgatgctcgaaacattcaaagtaccatgcaacgtatgagtggccaattgatgtcttgaaaaaaggaatgttgcttgatgtcatttgcaccagcatttgaacctatacgatttgaaggatctctctgaagtaatccatggattaattgctttgctgcaagactaacctggagaatcatagtgatattaataaatgagaacaaatgaaaactaaaatacaataacgaagtgtaagataggcataaacattttcttatctaacacatgctaacacatacccttaacatgatatcttacaggcttgctggacagattgtaaattggactcaacctttgtagttgcaaattgaatacagtatgcaaaaaatattggcctgcatgacaggaaacttcactggccatttctctaaaaaagaagttcttaccggaatgctactgggaaatgtaaggtctttgtgcagtatgttataaaatgtctttttcctgttctttcctcggaaaggtgtacgcccatacagcatctcatacaatagaattcctatagcatgggaattgatgttagctggatgtcatcttattattagcataatgcatatcaaacaatataataatgccatatcaaacaagttctcatggttaggtacttaggtgtacctgaaaacacatatctagtacttacacatcttataattatctagagagactagggatgtattggtgtggtagatacatatacagatctcagaaataaacacatacggagggcagtgtaccttcgggtgcttctaggcatttgacatctaagcagcatggttcaattgacacatggagaatttggataggttggagtcagcacataaacccacatgttctaatcatagcacctaccggtaccttttacacggaggccacttccatggaagggctaggcatgagaggatttttagaagggatattacaccattcaattttatgtttgttttgatccctgttatctagttaaactgactaacctacttaatgtgatgtaaattaaaaaagtgtgatatagatcagttatagcaggcaaaagtttgctgcagtgcaacttgtgacatgagttttgtttaattatgcatagcagtgtagcacaaaacaattaacttaaccgctaattatttagtcaaagtggtaatatggactattctctgggtggaaacccatgttcaaaatcttgtttgaatggcacatggattattatgaataatttgatgagattttagttgaacctcaaacatcttttaggtgattgctataagactataccaactaccaagaagatcgaataaataaaactaactcttttaatccattctgtgcaattcttgtaatcaactagttcataagatgacccaaaaaaatatattaggttattgcttaccgagagcccaccaatcgattgcacttgtatgccctgcacccgttataacctcctaaaacgatgcaaaagttagacaacaatcatgctacttgctgagaaagaatcagagaccaacattgacaacaagcggtttcgtaagatgaactgaaaaatgaaaagcatacatgtaaaattaactaaaagataaaaaggctacacctgggtcttatgataatgcatatcaagttgaaattaaaacaattactccaacaataagcataaagaaaacacaaggatcattcttactggagcgatatactcttcagtaccaacaaatgaatttgatggagtggaaggttctgagacaaatgttggggggagaaattcttgtgaccttcttcgttttaatgatgtggaattttttatcacctgcaggagatttaaccaacatcagggcaatatcaagtgttttaagtgcgatagtttcttatgaacaacaaaaacacatgctggaaaccaccaacaagtactcaatataaacatgttcttgacaccattactgactttgaatactatgcaagtggaaaactcaaagctcattactcaggaatgaagtatatttttgttttaaagtttgcgatcacacattctagcatacagactataaatgaccaaaaaaaatgaaggtaaatggaattagcaaatattctataaaaactgcagcaagcctgaaagtttattccctcaacttacgtggggttttgaagtcgtcaaaaatgaaagatcaaaatcagtcagtacaatgtgcccatctgcttggagcaaaatgttttctggcttcagatcacggtatataatacctacagcaggaataacacatgcagattagcaatctttgatctcataataagtccaatggcaaatcagtatctttaatgaaatagaaatagatcgccgattgttaacagtaaacattattaatacttggtttcactcaatgaatctgttcaaaagataggagcactaaattatgtaaacacatctatacctaggcaatgaaggtactcgagaccaattacaacctctgcagcataaaacctacagaacggatcaaaataatgttatataataaaagagagagtaggtgagtcgaatgatatagttaacataagatgataaggattcatggcaagaatctcaattatcttatttttatatttctttactcctttaaatgttccttgtgggggtggtggtgagtctgcctcacataactagtcaaaagagaagactgaaaagaatggatatcgaagacttctggtgggtgttcgagaaaaagactactggtagtattctgttacatttctttcttctttttttttttcatacatgtagttcttcaatcctacactacatgtatgtgacaaaattatttactagaaacaatttcattctattgagcctcagaaacagtatatcacaacaactgaactcaacagctgtttgcaaataatcattcacaagttagcaannnnnnnnnnnnnnnnnnnnnnnnnnnnnnnnnnnnnnnnn

SEQ ID NO: 37558 - DNA, 616 bp, Oryza sativa
  unsure (1)..(616): unsure at all n locations
atgcgtgttagtgttcttgtggctagtgcacccgtgcatgcacatttcagtactatagtatttcacacaacaatggaccggcgatgcaggtgacggtggtggcggcacttaccgacgggcagagaagccagcaactagctgaaatggctcaaccagctcgatgcacaacggttttcaacatccaaccgaaggggcaatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacagagtaaagtcagctgaaatccgaatcggctacgatcaggatcggcagagtccgagttggatagggttagccaattgagttgaatctgacaatgtagcacgatatacgttgtcgggttaggttaacgagcttcatgaggattgtcgtgcatggatagagtc

SEQ ID NO: 37559 - DNA, 691 bp, Oryza sativa
cccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaagggtcgccggcctcgtcgccaccgccgtcctcgctgctggtgtcgccttcctcgtcggagctgggggcgaacgcgagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaagcctgcttgccgaccggcgcgcttcatgcgggagaccgcgtcccaaagcatgccgg

SEQ ID NO: 37560 - DNA, 560 bp, Oryza sativa
aggcacacctgaatatctggcacctgaatggctaacatcacagatcactgaaaaaagttgacgtctacagctttggagttgttctcttggaaataatatgtggaaggaaaaatatcgatatttcacagccagaggaaagcgttcagctcatcaatttattgcgagagaaggctaaagacaatgaattgaatgatataattgataagaaaagtactgatatggtctcacaccaccaggaggaagtgattaaaatgttgaagctcgcaatgtggtgcttgcaaaatgagagcagcagaaggccttcgatgtcgatggttgtcaaggtattggaaggcgcagtgagcgtggaaaattgcctggattacagctttgtcaatgcaaattcagtgatatctactcaagacaactcatccacatattcagctccactttctgcatcgattctatctggtccaagatgaaataggcggctactgagcacaaaaaaatccaccgatctatgcacatcatattttgaaactactttggtaatctatcatatttcttcttgtgagaagtat

SEQ ID NO: 37561 - DNA, 606 bp, Oryza sativa
gccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcatctggcgcgccaggtagggggctcagcgtgtgctttctgagctctcagactct

SEQ ID NO: 37562 - DNA, 1056 bp, Oryza sativa
actatttgaactagtataattcacaaataccaacatgccatctctaaatatggcatcttcatatttagttcaaaataattgcccgtaatagcatatattgttcaagaacatgtcctctaccaccacaagtgtccatggagtgacatcgattatgaatgaactcactaggcactccaatccaatgaaaccttaagccccttctattaaaattcatccactaaactaaactaaagttgatatattcgacaagcaacgcctttcgattcatcgatacatcacctaagagccatgacagcaatgataacccatgtaacacttagaagaaaatggcacaagcaaagcaaaagggaaacaccaattccagtagtcgatagaagcaaaaaacaccgtgtaacagcagaatcttacatagtcccggaaggccagcccaacctccatgcacttgaacatctcatcggtgacctccatgctcaccatggtcacccgctcctccctctcccgccctagaaaaatcaacagcaaggggcggaccccccaatttttttggggggaaaaaactgttattagtcctaaggttaagacaaagagaaaacctagcttccagatcgagaagagaagatcaaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgc

SEQ ID NO: 37563 - DNA, 3798 bp, Oryza sativa
ttgtaagttgagggacgccggatatctggttttgtggttgggggacaattttgtaactcgatgacaagttaagggaccttcggtgtactttttcctatattatgtatgggtttggcccaagtttgttgcttgggtcacaatgggctccgatccattttggcccaagaaaatgaccccgagtcgagcgaagcatcgaggaattcccaggcagccgccagccggccgatcccccgtcgctcgcctcacttcgtcggctcgtcgtcgtcgtcgatgccgttcaccggaggactgggggcggcggccagccgttcgttgcagcgcggcggcgagatacttcttctccatccaccggccgcccgtcgatcgcacattcgcacgtacgcgacgctcctcccgcactggccggctacaccatgctgaatcgggtcaggactctccacacccttcatacaatttgcttcgatatatatccaactatattcaggagaactaggggtttcgattgatcgtctgaattcatttttgtcaaatcgtaatgcgttagtagttggggatagaaattggggtactaggctactagtaattacgaatcggaattaatatcgaatgacctagattgccatttcaccaatgtgcatacactgatatgcgcagagccacatatcgatttgctggggtgaattagaactttctaaaaaaaaaaagaactcgagacaatctggagtatacatggattctgcgtctctagttcagtacgcgatccatggctagctatgcgtgctcgaaagtcgaaaccagctgaatcaggccctgtttttttcagtttgggattattataatctagattattgagtcagattactataagctagattgtaataatctgtagtagaataagcagttagttgtttcttttctagattattagagtctagattattgggtttgcaagtctaaagaggaagtggggtggcatggtgggtaatttttcactcaataatctggaaaaagctcacctaaatgagcttatcagattataataagttagctccagattataataagctacttcaataagttgtctgtttctttcattttactcccaataatctggattataataatcccaagctaaaagaaacaaggcctcggtgactttattttcaccatatttattcagttttctctccaagtagtacttctcttcaatttctacctacattatattgacacactagctagtttatgcgcggatattctcgatcggttggcaacatatttaaaatggatatttgtttttccacattatcgtatcttggattaattttggtagttcaacacacaccatacatcaactataacatacaccctttgtccggctggttgttcatagagtatcaattacacagtagcaaaccgaaaaaaaaaatcgtttagtttacaggaaactttgtaaatcttgaaagagaaacacttatatgtatctgtttcttgatgcactcttggaagtgagacgtacgtactgatcaaatacccgtacgagaagttttttttttctttctgtggctgccgatgaagctcatagaagatatctaatagcacaactgcatcaaatgaaagtaaatattcgattagagtactagctagcttgttccagacagctgaaattgatcgcctttcgatcgaacatatatagaataggaaggatatcttgataagcatagatgcatgggggataattaaacatgctaagtctcttttgggatcgatttgagttttgcttttcaaaccgcagcaaaaatgaaagtaattattgctaattctctagatttgatctaaagttgctactacttccattaattggtcatgacaaattggcatttggacattctaatttacacggtatttgagatgaaactttgaccactattttctatcaaaatatatttgtaaagttcaataaaattataataccttctgaagaaaatttatacacacatatatatgatgatttctattatttatacaactaagtatacagaggataatgattcttaaaattataaaagtacaaattaagtccaaaacaacatgttattatgacatgagggaatttaattctttaattactagttgttttaagaggactacaaattaaagtaaaccatatacgaacttattttttagataatggattatattaaacacggcctctacaagtcacaagcacgagtatataagactctcctgttatatgggtaaagcataaataagttttaaaggcggacaacaagcaagaggaacttatgattagtctcagtactaacttacatgcatgcattctaatcagtctagctaaacatatatagtttgataactatatgctccatctgctagctaactttgttgctcatagcaaagttatggaataatatgaggtaaacatgatttttatatatattgagaaatggagtgataattgaatattcaatatatgcatgaagcactcagaaatggtttgcagttttgttttgccacttgccatgcatatatgtgctagaatgggtagatgtctgcttaatttgcaccagatttgtggatacttgttcaaattattgtagaaatatggaagatcaattatatccccatatatgcagttttgccagactagctagcaaagtcacaactcacaacgaagctgagaatgcactttcttgctacatcttaatttgtctgagtagatatatattcctatgcatcatcacgtggtctctcaaaacaggagagcataaattcaagcataggctgatcaactctttaatttgtgttagtagctactaccactgcgcttatgctaataagggctaggggtaccgtacgtaccacgggcatttcttacttgtttctgaaggagtatactataccttcgtcctaaatatagttgattctggactagacaaacaattgttcacatatatatagccataagttttatatttgggatggaggtaatagaagcaccaattgcaacaagagatagcatgaaaaaaaaaccattagcaagagcttttagaaaatttcttttgagagcattgatgaattcatgaattgtttgaagagaacatatcgaattggacaaagccatccaaagattatcttccaagctgtacattatagtgacatgatctgaaaagttgtcctcgaccatataaaaaaaatgacatatatttcttatcaaattttcaggagcatgcatgattgcaagttttttttcttcattcattcattctagagtaagaactagagagagattctcattacatgatcaaaacgacgaatcgtctaagcaaaatcaacaggtaaaagccaacttaacaagaccatctttccacaatgagcatacacaaaaacaaaccctaaatccaaatatccatgcaaaagtaggcacgcacacacgcctacacggccactcaccttgtcgccggccgtacacatgcggcatgccgtccacgcgcgcggcgtcccgagctgatcaggacggcgcccatgccgaggcgaacacgacgttgtgccccttccacgtgagcacgaggtcgtcgtcctcccgcttcatcccccacccggccgcgtggtcgttcagcatcgccttcacctcgccggcggcctcctcgccgaacgccgccgcgcggaacccggcggcgcgcatccgctggccccacctcgtcctgtcctcctgccgctccaccctctccaccccttcctgcgccagcacgttctccaccttccaccccacctccg

SEQ ID NO: 37564 - DNA, 3659 bp, Oryza sativa
  unsure (1)..(3659): unsure at all n locations
cggaggatcgggggcccctcggcgcggccggcgagcatgtcgatgagcgtcgggatctgcatgcagtgcgtcgtgctgaggtcgacgatgtgcacgacggggaacccctcgacggcctcgacgatggcggcgttggccgccgtgtacccgaaccggtgccacggcgtgaggtcgatgaagctggcgagctcgacggccgtgaaccggtgcacgtggagcgccgccgactcgacggcgtccgctaccgccgcggtcaccgccttgcacgccccggtcctggacgcccgcgacacgagcgcgcacaggaacgccgctgtgagccgctggttggagtccccgtccgccggcgcgatgttgttgagcacccacaggatctgctgcgtcagcgtggcgtcgttggcctcgatggcgttggcgcagtgcaccagcagctgctccatgcagcccgtgctgttgaggttccccaacgagatcttcgacgccgccgccgacgacgggaagtagccgctcccacccaacgtcgtcgtcgacgacgacgacgaccacggccgcgctcctcctcctcccctcgtcgcgccgacgtcaaggtacaaccctaaccctagtccatgcccattagggtgcagaggcggtggaggtggcgcggtgtgcgtgaactgcatcatgtagtggtggcaccagcgcggcgcaagcagtgcagagacgcgattagaaaacagcggagacgcagagctagtacactttgagcggtttgaggcacggatttggtgcttgtacaaggcatatatagagggctgtgcacttgttgctcggaggcgccacacgtggtctcatactctcatcccaagctgccgctgctagctatatactgctacctagctaagccaaattccattagaactttgggaacaacatggatccaagggagggaatggagagaaagagaagctggccagtgatctagtacaaggaatatttcagtgaaggatcgatcgagcagagatgcaactgtagatggtttgtactatctagctggggaaaaaatggcaagaaactaatgaattcttcgatctcccatgtacttaccatctacaaagaaggatatatcgagatctgagagcactgttatggtagctaattaaccagaagctaggaataattagccgatcgagatggcatgcggttctagctagctaggagccagcttgaattcaagattcaagctgcggagatttctgcttgattgtctacaagagaattttatctaggatcgatgaactagcagatcagggagcagttgggaaagcgaggagaggatagatggggaatgctaggggaggggaaggggaagggaagaagaggttacaagtcactaattatagagggaattatgtagtggtttcttggattgttctggatggccagctattcatatatttgtctatatagtaactagtaattatcaagatcgctagcatgtcacattatgaacaatattttataattactctgcttggtaaaaatatataatgcctgtaaaataatgtataattgtcaacacgccaaattaaaggttaaaatgacatctagtggcccccgttttttacaagtctgatagcccattcggacttcaaaatcattcttattacctcatctgaattatctctcattttttctgcaatgatttaagctgtctatgatagagtaattttgcttctctctaaaagatagctttgtcgtatttacaaaaggagacatgggttgtcgtgattgtaatttattcgattttctttggaaaaaaaacttaattcagagaacgataaaaaatatatgagttaaatataacaacatactgatcctagcctcctacaaaacacacatgctcgtgtgagtgtacatctacctgtattgtgttgcacatagctagctagtataaaattgtgaatataaaaaacttttctatagattaccttttaaagaaagaaagtatggaggcaaaacaggagttcgatcataattaagtatcataacctcatggaggatgacgcagatcgacgtacggttgaaccggtgcactgtacagttgcgtgtaaatatgtacgctaaggaattttatgcacatattaaatttttgtaatccgttttcaaaaaagaaaatgtaacccgattattttagagagagggagagagagatagagagatcacggggcatatcatggtgaaatgatttggtcagttcgcgttgggccctacatggaacaaagctacaactagtttagtaattagagagagggtccattctatttaatatcctcattgttgcaactggaaaacgactctttgtatggatctaaacttacgcgtccaagcactggaaactattcagctgaagaattttatagaccaggtatgctgctctgcagcgcgtagacacacacacacacacactaacaattcgaccaaattgattgatagatggcacttgtgacatataagttgcttataatagaatagtaggcttacacttcgaatatttccatttgttcttaatttgccatagaataagagtgcatttgtttaaagttaatcaagcaaatcatcttcttagttaattacccaatgtcgttatgattttttaaggctatctacataaccatatcctcgatatgcctttagttaagtgcatgttaatttgcgtgccaatgtcggtctgtgtcattgctagttgttggaaaccatcgggataaaattccaatagttatacattactacatctgtctcatagctaaaaatagatacattttagaatgaaggtaataagatttcttcactacctgtgttaatatcggtggtgctgccactactttatagcaattagatccaaaacaagaattcagatataggatcataaagtggtagaactactgcagaaacttttattggttctgcttattaaccagttgtaggcgttggtttctcagtcggaaccaatttaagagtactaatgcctaatagcataggtgccggtttaaaatacgatacttataaaactataagtaccggttattatactacaaccatcacctataaatccgaactgtgccggttatgctatcacccagcacctataaattagaatgtgtcgggtatttacttaaaaccggcacctattaagttttataaatatcggtttttcaataaccggtaccaacactcataaaatcagcacctatacctattaaaaccggtacctattatctgggaggtatttgggtaaatactatagatatcggtttttttttaagaactggcatactctagtgaaccaatgttgcgctataattaatctcagttaggacgatccattattaccacagttgtaatgacagaggatgtttttggtagatttcaaacatacaattccaagggaggtgtgagcctatcatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37565 - DNA, 525 bp, Oryza sativa
tctaattcctgcagccgcaattggtacagaaaattctagcatggcagtccctagccaggtgacctttctctttgcatctaagacaaacaagcttctgattagtagccataccagcaggcgtggagccagagttgggaaggtcccccttctgctgctctgtgtgcacctctgtctctcctttctgcccttgatcaatctccttcagcttcaccgggcgatactgcagttcctgcttctcctgaccttgttgggggccttttgaatcagcccctttgtctccctcagatccttcaccatggaatcgccttgcgggttgaaattgaggaggttgatttggaggatcttggaaaccatcccatctcctcccagcaccacctcccccatgaccaccccactgattgttgcggaaatcttgccgcggctgattccgccctcgccatgcaccaccctgattagccatcctgttcccctgaacaaacttcgcaaaccggcgagaatcaccggagatggtccctggccaccttg

SEQ ID NO: 37566 - DNA, 1411 bp, Oryza sativa
ggttggatcaagaatgtgctaattctgctcgtttcttttgatcaccatacttgtcaactcctgacgagctgcttagctgcaattcgaggcaaatttcagaatcttaaacgaactcgaaccaaaacacaaacaccaaaaaaagctctgattcttttattcttcagaaaaggagtaactgttttgtcaaaggaaaatgcgcccgttgcaaacaaacccaaagctgactgctaatatctcgggccagcccacttcacgattatctgtcctgaaaagtttcggcccagtcacctatagccgcctataagcccactagtccctgcaacgtctaacatatctcccttctccgctaatcaaaatcaaacccatccaacgtgctgtaaaacgttagtagtaaaacgattttgctatatatttattaaaaatctgttaaatgtaaatacaatataattgtgtagtataattatatgtaactataatgctcataatttttatatatgtaactttcatataattttaaacggtaagatttatttcaagatttgtgtaagttgggatgaaaaaaataatagtgtgcgcatgggtgagaagattcggtcttacgacttccggggcgcaaaaataacattttaccgtgggatttttgaaaggtagatacaaattgtattttagttacactataaactatgattatccttgtactagtatttatgtatgtgcataataaatgtatagctagttccgtagtaaaagaaaaaacaacatctctccttcaggcgtccccaccaccccaacggccttccgcgcagaggccaacgggccaaacccctcttgtgggccgtcttgtactggcccactacgcagacagcgccgtaccgtaccgtacaagcttctcgccgcgcgcgcggtgcggcccagcgagccacgtgaacgaacgcgttaagttcatctaaggtcccttaatttgtcgacgaatccgattttcgtccttcaaccaaaaaaaccagttacaactggtccctcaactgtcaaaaccagtgcagatgaggtccctcagcggtttggatggtggttttggctgatgtggcattgacatggcacttacgtggcaatgtgagctggaaaaataataaatctcgtgggacccacatatcagtttcacccaaaaattaattttaaaaaggtggggcccacgtggcccccacctgtcattctcagcctcctcttcttcctcatctccccatctccctctctcttcaactctcttcctctcctttctcgcgacgcgcgcgacggcggaggctcggctctggcggctgtggacggaagaggtaggggcggcgggaggtggacctagctgtggcgaccggcggagaggaactgggcatcggcagcggaagcggagtctcgaagg

SEQ ID NO: 37567 - DNA, 3148 bp, Oryza sativa
attcctgcagccctgagcaagaaagagcctgcatagaatctactacagagttcatcagtgtatgcaaagaaattaacttctcagaaaactactgattgtggtgaaaggataacaataggattgtatccacttgaactgatagctagatcgaatagtgcaaatcaagccatagtgaaagaaaatgatgtacattcagattcagataatccacatagaggactattgggctgaagaagggaatcggaagactcactttcagctgaagcactctacactctgcactctcacctgcaaaagagaggatggcacacgtccgtgagaaccgagtgcgtggtgtgggcagactatgaaccttacaacggcggcaccactggaggcgcggcagagtgccgttggaaggcaggaccacagggccgtgacgggatggtgatacgagccgaaaggcatattcacgggggagtcgactgtgtgcggcagcggagacaggcttcatgacatacagatccacggcgccggcgagggcagggcgcggtggtgtgtggcggcggtagggaggagcggagcgaggagcgcgcggcggagtcagctccgttgggggcaggccacgatggagtgtgtcagcggcggggaggcgcggagcacgctggagtcagtggagcacgctggagcgtcgtgtagtcatcacgcgggggatggggccgaggtcggctccggtcgcggcggtggacctcagcgccggtgccggcggatggggccgaggtcagaaccggccgcggcggctccggctgcagggaaaaagcagcggctctggcggtggggatgcggcggcagtccacacggggaagaatcatatgctccggcggcggcagtccatgcggggaggatatccagcgaggatgcggcggcgcagcggcagaacatccggggaggaggaggagctagcgaggaggaagagaagcgaagtcttcgcgtgtggagcgatgtcttcgcgagtggaggaggagtgaagtattcggcgtggcgtggatggatggatcatgcggtggtgaaatcaagcgcgcagatggacggtagagatcgattcgagtgatttggcctgtaggattggagggggacaactgcttctttttatattagtactagtgatcgtgcacgtgcaatgcacttatgatcaatatttgattgaaccatctacctacattgatgtgtagaatgtttaaaatgttttatgtctagttgcacacagttaatcaatgttttatgtctagttgcacacaatgttttaaaatgtttaaaatgttttattgaatcttgaacaacccaattaatcaactttgtataaataatattgtaactccatagtattacaaataagcaagtgctaactgctaaggatctaacataagaaacaaaaactcttaaatggtcatctcttaattcgtatgatccttgttttcaaccattttttatgaacatgaaaaatcctagaacaatactacatgagcaaccaaaactccatttagtgtccatagttctcacaagctccatttatcctttaaggagtgtatgcctgccattctgtcccaaaggaggcttaccttgctccaaaacagatttggtccaccaaattatagttttcacagcgttcagtgtcactgacttcaaataatagagcttcttctccttaatctctagtgatggacgacaacttgcctctcgatcactactattgttagtggacgctaccaattggacaataggactcccaatatcacttctgtcaagagtaccgatccaaccagtttattgcataaaccaacttcaaataccagaaatataatgaatattttcatgattagtttgatccggcacctcaaaaacttccttcataatctacagttaatttccatagtttagttatgagccttcatgttgtctatatcggggatggagattaaatttaagtcatctacattagaagctatgaaatttgataaaaaaaattaggattcctaaggatgatggtaactaaacttattcaagataaggtggcaactggagatttgattataaaatttatattcttgacgaaagctatatataacttaaaccaggtcacaaaaaatgattctttattagcaaaaaatctactcaataagacattagacatactttggcattccaaaatacttagtagtttcttccagattgctacatttatagctaataaggaagacataattcaatacaaatactgagagtgcacaaagtgaactggagaagtaaaatatcatctggtatgaaaacagagttcacattattccagtgctaaaaaatagttcacgcattgtgtgaaaaccataaggaaaagcatttagcaaagttgacaggaaaaaatgttttccccaaacaaaacagtatcaattggggatttaaatccaaagcgtgatcatttacttcgcttcagttattcactttgtttattaaactaatatgcatgaatcaatttcactctgtttgttaaactaatataaaggagtcaccttgcatattattattccttcaagcctcattactcctcattcctttctgttgactcttctcactgcatatgcacctgatctcccttgcacatgtaaaataaattgaccgagccaagtatcaatagcatgaatccaacaaattcttgctatagagctgtatataccgttttccacggctatggtgcaccatatattcagatggaaactaagatctgaactaaattaaaaaagtgtgaacttgcctgtgaacaaattgtacaggcacaatttaaatactttggaaacagaattgtgcaaaaggaaaaatataataacctctccattatggacacctgctctgcaacgggtaattgtctaaccagacagtaaatgcaaaaattggctgagaacatacaaatagtaagcttcttggagaaaacgatcaaacaaattctgacatacaaaaagtaagcttcctagagtgataattttgtaagatgcagtgcaacattttaattacacgtgaaaaagcaaacctccagtgaaagatcgaagatactggtgctccaagactgtggacctaattccagataattcattcaggtcaggaataatttgaattgaca

SEQ ID NO: 37568 - DNA, 4932 bp, Oryza sativa
tatctccccgcaatattttaaaagaagaaatagataaataagtaaatattcatatgatatacattttgaaagaaaatcatgctaaaattagaagtcacaaagttgcagaggggcgataaagtactaaacacatatcggataaatatttatgcatacctagaatttgttggcaacaaactgctccaataaagttttaatatataatacttcatttagcaaagcgaagaacagggagactaaccaggatactacaccttagtttaacttagtagacagagcatcaaagaatgccttcatcggccattgcactgtccttttgggaactccaagagtataatattatccttcttcaattcatatccatgcaaacaacaaagatctcaattcttcagttcatatccatgcaaacaacaaagacctcaattttaatgaaatggttagctgcttgctcatcttgtccctgcaaatagtttacgaagttcatccctttatgtccagggagaggcattagacaatatacaaaatgtacttcaaggtattgctttagatcgattgcagcactgaaacacaataaaactggttttgcttcaatgataacattggtgcaatattagacagtactgatgctccctgcgtataccaaagaagctccctgtgtggtccattgaattaggatgcagagaagagatggttgacctgaattgcaagaaaggggtagtaaagggtgcttgggattactaacctgatttagggatgaaccttgtttgataattgctgttgtctacacgctcgtgaaatcatctgaaaatcagcggtagcaggattgtgaaacgccagatgtggccgatggcaagctcctactgggattgcaacgccatgaggggatacgatgccttcgcaccacggctgcaaatccattgataggggctgcacaggatcaactgaaaggatgcaaatccattgatatgttaaaatcttcaaactctacggccaatttctgattggcaattgtgaatgatcaagaaaacaaatggtgatccacaaattgacacatcacaaaaacatgtaaaataggagaaattggtattaccttagggttcagggggaacagtgttggttcctttagttcctactcaaatctgacgggaaccaatcagcgcaagatgaacctatgaagtggattgcggcgacggcggaaagggaagaaatcgattccggcgagggcatcggtggagtacggcggtgtcggtggaaggggacgaccctccggcggcgcgaacggggaatgtgaggaggaatagggcggaggaggagcaccggcgggaaaagccgccggcgacgccggaaggggacgaaatcggttccggcgaggaggaagagggcggaggaggcggaacgccggcgggagcagcgttggactgaggcggggcgaggaggagcgctagtccagcgtggtcagcgcacgctcatcgcgcgaggaggaagcggacaatagctggcagatggatggatgggcgtcgctggcggatggatggacgatctggatcaggacagaggcagatggacggtagagtttgatcgaggtgatttcacccgtaggattagaggggggcaactcctcctttttatattagtatatactccctccttccctaaatgtttgataccgttgacttttttaaatatgtttgaccgttcatcttattcaaaaaattttgtgaaatgtgtaaaactaaactatatgtatacataaaagtatatttaacaataaatcaaatgatagaaaaagaattaataattacttaaagtttttgaataagacgaacagtcaaacattttttaaaaagtcaacggtgtcaaatattttagaatggagggagtatatagatatagatatagatagatatagatgtgtactcatcgtagtgctctgctctgcagagtagcaaacgattgcggtgatgcagatgtgcggcttgcgagggtgcagtgggccgtgggccaccagcctgtggcgacaacggcctgtatgctggcttgattgtgaagcaaacaggacaaaaacgtggaggcatgggccaaggcccaaggcaagaatttccgtgaggtattagcatctgaaccaagatgaacagccctctctctctcaaagaaagagaaagaaagaaacaaccaagatgaacaacgatccctctcgaaaaataaagaaacagatgaaaactggaagacaaagcaagttgttcatctagagcctcgtgcaacatttccatgttcacgttgatcacatcccttacaagctctaattaccagtaagttttagactactagaccatgccagagaagatgactacatgacaaaccatgtcgcgtaccgtaacacttggacacagtcacaacacagatgaagcgaacacaacaatgatcaccggccagagaaaaaaaaactgaatgaacatagcagagaaaaaaattcgagatgagttcagaatctgagaccttgtcttcgtcacctctcgccatgatatatatactcttctccattatttacaactttgtagcttgctgctagatgttctcgtttgatggctcttggaagttggaaaccggcttatgtagtgatcatgagccaatcatacaactggtctcaattggactggtcaatatgatggcataggaattttggaaggaggcgagcctgcaatctgcagggactcctttcagcttttcacacttttacagttttttcagctcggagctcgtactcgcagcatcctttgttgatctgtgcttttctttttggtgggaataactctcaaatgcttttcttttaggctcgatttgcaactcaatttcaactgtaagctaatactagggtagtagggttgaacctaattaaatgaacttattcgtttccctatctgagaccatgcaatatagtatctgtcttttaatactgatgtaatgccaatatatgggacaccgctgcctatgagccgttggataaagctagccgtggcggagcggggatagattctgttctggagcgttactactacactagacactagtagtacagtggtactagcatatgaaccaagatgaaaaacaattaaaccttgcacaaagaaatgttgaggaacaagacatgaacacgggaagccagaaaatagtcaagtagttcttcagatagagatgcatcatacggcatattatgaagttccttacatgttctagtggccaagcaagaaccacaaaggacgtcacagtggaacacacaacatccgtgcccatcaacaaccgagatacacaacacgactagctacatatgaagctactagtactagataacacgactagctacttaaacgccatgatccttcccatcgactgaatctggttgatctggtcgacacgacgacgaacacggtacacatcgatctaaccgtccatatccccgttcacacgcacgtaacgctgaaagacaatgagaactactccagttagtacaaattagcgaattactacacatttacacgtgacgagagaacaaattgtgtacacaagctcacttaccaggacggtgcacgcggcgacggcgaggttgacggcggaggcgacgccggccaccggccactccagcgaggtcgccgccacgaagccgccgtagctgatgtaggcgaggaacatgccggagacggacgcacaggtactgacggcgagcagccacgcgacccagctcgccgccggcggattcctcttcttcttctcatccatcagcagcacgctcgcgaggtgagcctgcgccgccaccgtgagcagcgcgaaggcgaggcaggtcttggcgacgtcctcgccgccggagacgcatcctccggtgatgccgccggcgccggggcagacggcccagccagccatcctggacgagaagaagacggccatggccaccatgaacacggtgatcaggtaggacagaaacttggcctgagaaaagaaaaaaaacgaagcagagaagaggcaatatatcaagcgtaagaacgcattttgagacaagttttgcagagaaaatctgatcagagacgagtttaggatgtaatgaaccttgtgttcgtcaccgctcaccatgatactcttctccattgtctataaacttgctgcttgatgtttctggttttggtggttcttggatagctggatgccctggttatatatatagacggtagtcttgtgttcatgaaccaaccatacaatttgattcaattgggtggtcaatgactcatttgttggtgcattggtaaaagttttggagggtggtgactggtgaacctgcagctgcaggactactttcgagcttcactttttgagttttcgtttctgctcctctttttctcatccttatctctatgcaatgtaatatatcagattttttgctaccgctgtactgcaaatttatgaatttattagcaacatagtacaagtatggtagtggtgtgtgtatccattgcacatgactggccccattgtcacctgtactgtactcttcgggtagcagtacagtactagctcgaatccttttgtgtcggaaggaaacgataaggtttgatttcactatcatatcaagattcaagcagcgacaaaaaatggcagtctgctactactgtagctgcaaacctgcaatgcagtgcaggtgcggcaacaccatagcctcgttcccatctgtcacgttgcaatgctgcacacaagtttcaaaccaattgtacgacgggtcatggacacaagtttcatggccttgtttggatcctccgggctattaaatagccgactggagaagctgtccaccgggcgccatcacatcatcgagatacatcggcgcctccatcttgttgtcgacatccacgatgataccttcgccgccggcgttgccatcttccccac

SEQ ID NO: 37569 - DNA, 750 bp, Oryza sativa
tcatttcaatgtgaaaggcacaaaggtggaagtcaatgtctctgaatggactagtgaatctgcagccatagggaagatgcatgtggtgtgggtggtaatagaaggtctgcctgatgaaatgaaggggtatcaggctctctttgaggtgggatccaatctaggagttgtcatggaagtggatatgccaatgttagctgcaaaagacattgtcagaatgaaggttggaatgatggacgtcaaacaatttccattatgatcctatctacacctgaagccctgttgtatgaagcttgttttaatctggagtcagtagtagaaatgggatggcttaagggacaacagcttgataagcaataggaaactactctaagagttgaagagaaggaagaacagaaggtgctcaccaaaggtaaacaagtggaagagatgaaagaattgactcaacatgtggttggggctcaacagaaaggagattgtagtcaggctcagatggaatcagttcataggttggttgaagaagacagaatcaaagccattcagatcctgcaagacagtcagttggctttggccttgcaagaagaggatataaagggacatctcaatgaagataaggggtgtgatgaaaatcaaactgctcttctgattctgaaagatgatgataagatggtttctcaggaggtatcaacagccaaagaggtgcaaaggagtcagctggttgctagtagtgaggatgatatagaagggctgcag

SEQ ID NO: 37570 - DNA, 559 bp, Oryza sativa
tacagtccatgttaattaccaagtggcgtgttaattaagcatgttacagttttgtactaaactaatctagcataaaagttgtgcaaattgtcacctaacctgtgtgaaataggagtggcctagtagtagtagatccaattacccgacatgtcgaccaggcatgcatgtgcgtctcctgccgttacacggacaacggacaaaaacagtagttaatgcctcatttgaaaagtccatatcagtccctggcaaccactagtaattagctggcacatatcattaccatttcatcaagtagcgattattataacattccattctttttaagtctctgttaccgtactatctagcgaattaacaatcatccataattgctagtagatccatgtgctccagcactatatactagtacaggctacaaatacacagctcatgtgacctatacagactcactgttgcagtagtagtagtactaccagtacagtatttagtgcggcaatttttcttttttattactcctccattgatatagcactgcacagtgactgacttgtcaatgcct

SEQ ID NO: 37571 - DNA, 1258 bp, Oryza sativa
ctattttatggttgccggctgagtactggaatttcgttagaagaacttctaagtttaaaatatggtgcaaaacaaagctggcaagtggcaacaaccgtagactccaagtcttggagtgcaatgcgtagccaaccagacaatcaccgacgcatgggtagatcagcatctggacggacttgctagtgcttctcagcttagcaacgacgcgtgtaaattgcggccatatagcctatagcaacatgcgaactaccgcttgcgtttgcgtggacaaaaaatggttttccatttcacctactacgcgcaagcaaccaacgggccaaagcaagcagagacggtggtagtactacggtgagctgcgtgtgtgctgtgcagatgtaatgcattttttccaccgacatgaattaactaacgacatcaattatcagcgagcataattgacacccatatatgtatactaatgcatgcactgtttggtactaatataatatggttccaatttgatgattaatatcattggcatgtgcaaacgtacatgattattacatccacaaattactacatgaagccagtatattatagatatttaaatccgagtacctaggaaaataccgtaaaatattcgatggaagagagcaagatatcccttcaaatagcctattctaacagggaattcctatatcttaaaattattttattaagttgatgagaaaatccataaacgctctacggagtaccagtaggagaaatagaagtcagtttttgactatccgatatagtataccccaagagagtttttacactagttacagtttgccttgcagtggtagtcacggattgtggagttaaaaatcacggcaaaattgaagttattactcacccgtgaccgtagcacggacgtacgcacgattccctgcacctggggggggggggggggggggccttgggccacggctgttgctgttgctgttgccgctgtcctccagcacagagcgatgcgaaattgattgttccaggctggtgttttctcccaccccttcttccatagtaccatacctgcttggctgcgtgcaccgcagcaacgagtgtaccccaaaccacgttattgtggatcgatcatgagtgattagccttttcacgggaggaatgcgtaaataaatgatggataaacctgcaggccagtgtcggtaccgcatttaattagggaatcatcgagctgtggtttattattagtcgagcggaagaaaagggatttgtagcg

SEQ ID NO: 37572 - DNA, 2499 bp, Oryza sativa
actaacaaataatgaaaaacaataatgaggctcatcttgctttgctttggacaactttttcatatctttggaccatcaagaaagaaaaatgcatattagcttacatgtcttcgaattgacattgacagattagctttataactttatatgtagccctcattaatcatttgaaatcaaacattgaataccattggaagtctcaatgcactttcactaaaatatgaatagaagatccatgtgatgctattaaaagcaacaaataaaatgtagtactaatagaaatgcacctcacagatcaagacagtaatatttctttcatcatcaaaatatactccaaacatatttttcttcagcgagcggacagcgagtaatatagaacacattttaattagtcaacatgagcacagcgagcgatgcagcccagtacatcttcattgactacaaacatatacatcagttttccacttctttcttctgccaatatacaagaatttttcgtattttcagaagagagatgaagagacaagtcaatgtaaaatatttcctagaagacaagtaccaaatggtatatattttgaaccattaactttaattatatcagcttgtaccatgcataaacatttgaaaagaaacatacacatgtaacacattgtttacaggaaaaacttccacccgatcagattcaaaatgctacaggcaccatatactaaaacaaggcggctcatctatctgggttggaggtttaacaaatatgaatatctcagcaaattgagcagacaaactaactatataccattgtcagtgttctcttccttattcagaaaacaattaatccgtgtgtttctgctttgaaatacaagtcaccaacgtcaacaggttagtgttatctggtagtcatgctcaataatacgaagaatatattctatttatcaactatctttgagtgtactttgctataacttcaaacaaattttgctgttcttgtttagaatatccaggatgaagctgaggaaggttgctaacaaatattttggcatcagtcaactttccattcctacaatagccctccactattgaattgtaagttctctcattgggcttgcaaccttgagtgaccatatagcgtactaactcaatagcttcctcaaacattgagttggagacataactcttgacaaaaatattgtatgttacaacatctggtttcagacctgaacatttcatctcagagaacaatcttgatgcttctttcatctgtccttttcttccatatgcatagatcacagtgttataagaatatctatcagggcgcacaccacttgacttgatctcagtgagaatattttcacacttttcacaatcacctaaacgagaatacatatgcatcaagctattgtaggtagcagcactgaggttgatagcactttccttcatcagtgaaagaatcttctcaaccttcctgaccatcctgtttttcccatatatggaaaccatggcattaagaacattaatatccaatgaacaccgcttctgtcttagttccaggaaagccttttcggcctcagctaaattattaactttgctgttgaccaagaccaatgttttcactagccaattatgtggttctatcctctctgaatatatatcatctgataaagctttcattttgtctaacctctttgcatttgcatacgcatgaagcaatgaagaataactatactcatctggcttacaatctcgctcctccatctcagcaaacaacttttctgcttgttcccaacgcccaccacgagccagggcagacagaacagcattataagttgaaacatcagggtatataccggcttccatcatcctcttgtatatctgcattgctaggtcaaacaaaccacatcgactatacgaactaataagtgaaacatacgtatccctctcagggatgtaaccagctttcttcatctccttgaacaccccagacacttcagaatccaaaccattctgcccaaacacagctaagagcgtgttccaggtcacaatatccggcacaaaaccagcagacctgaactcatcaaagacagccatcatctctgggaacttccccctcaccccatgcatcttgatcaatgcattgtatgtgcacaggtttggcttgcatccgttcctcaccatttcatcatattccacaattgctgcatcaattttgccagctctgtcaaggccagagatcaatgtcgtgtatgtcaccacatctggcttcattcccttcacctccatctcctgcttgagcgcaactgcctgttccaacaacccatccttcacatacgacgaaatgagtgagttgtaggtcaccacactgggtgggcagcccacacgctccatctcctggatcacctcaattgcttcgtcgtgccttcgcgccttaccatatacatcgagcagcgaattgaatgtgaccttgtcaggttcgaacccagaagccttcatttcatcgaacacctg

SEQ ID NO: 37573 - DNA, 7004 bp, Oryza sativa
gggattcgccggggtttaggggttatggacgccggcggggtggtcgccgccgtggatggaggaggattgggtggacgtgggcaactccgcggtttggatggattggagatttgaaaatgacgggtggtggtagtgggccggggaggggacgggctgaagtgatggtgggctcttgcgtagtgggcatcactgggcggggttgggaacgtgactacgggctactgggcctaatacagcctaagacgagggccccgtttgatttgagggataagtccattttaccatcctaaactcttcgctttgtctaaaatacaccctcaaacttcaaaaccgggtatttaacacccttaaactttcagtaccgttcatttttcatccctaatggtttgtagggcagtattggtacagtaggatgccacggggttggtggcgaactcgacgcggtctagatctaggggctagaggcatcgatggcgtgggagaggttgaaagaacgggagctgggctgcagtggaagacgagcggacgggagtggaggtccgcatgtccgtcgaggcggagttcgagcttacctgacctgccccaagttgagcatgcgatggaactcggggagacaatggcgacggtcgaattttttccttgctgctaccgtggatcaatctttcctccattggacaaagttggttttttctttctgcgagctagtagaatggatcgattggttcagaatcgatttttccctttgtgcaggcattgatggactggtaagcgactcacttccgttgtttaggtgagcaatcgagtcgaagaagcagatcatctgtctcatgcagtcctacccgaatgcggcaagggaagaggacacgcagctgtagctcagagctcgagctccaggcaaggacagccacgagacagagtttggcacatgccgacagaggtggagctccacatgcgcggcggaggccgatgaggaacactcgggtctcagggaggcacggatctcaagcttgagctcacctgtgccgagataccaaaggaagggctcgggaatgtgccgctcaaccttgacctcgcctgcgccaagctgccggagagtgaggcgtagttcgttctgctccagtagagagaaggaagaaaggaaaaatgacaggtggtcctaggttgactggattgcctcctaagaaaaaaccagagcggtttggatgaggggtataaattgcatggttttaagagatgaggggcgtctaatacccgattttaaagttaagggtgtattttagataaatataatagttgaggggtgtaaaatggacttatcccgatttgaacggactattataccatggattgtctacaaattaattatttttataaatagaattttcagaaatagcttagaacaaatgctctaaatagtgcagtagaataatgatttcgaggaaatgttattttctgtgagtttttgaagttaccagcttttagtgttttttaagataaggggaagagttttgttaaaaataaaattaaatccgacccaactagggatgcacaaaagtctagaaaaataaaatagaaaaaaacactaagacaaacctaaacatatcatgttgtcttgtagcagctcactcaaatagaaccaagacaagaggttaatcctagttatttactccgaaacaacgccctcgagaaatacatgacattttgtctgccgctgctattggaacacaaggctagattgttattcgaagcctgacatcacaccttcaacaaaggaataacacacaagcagcgatgttgtggaatcattaggttttcactctggagtgattgctagtactctgtgccatcatctggatggacttagcacaatccactcacaatctgatcataaccacaattccacaaaaccgcctttagcattcgctgaccaagcaaccaatatatcagattgctaactatacagaccaagcagtaccaatgtgtagccaccaaggacaaagtactagcctactggatctgccaccaccaagcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgaatggtcaacaacgcaagcaactaactaacaaactaacaatagagtcataacatgcaatgcaaataatgtatggatcaacctgattaattgggtcgtcgttccattcccagccgatcgatcgcttcaaccattcgatatatatagctgccctaagcaggatcggttatttatcgatcgattgattgatgtgtggttatggccagcggtgtggtgatggtgatggtagtggtgacggcgacagcgatggcgatggcggtgcaggggagccgtcactcggatttcttcgtggagggcgaggtgtactgcgacacgtgccgtgccgggttcgtgacgaacgtgacgacggcgatccacgccgcgcgggtgcggctggagtgccggcactacatgagcgctagcgggtcggtggagagatcggcggaggggacaacggacgcgacggggcactaccgcatggagctggtggaggtggacaaccgcggtgccgagttggtgtgcgcggtggcgctgctcagcagcccggtgaccgaatgccacaagatggaggtgggtcgcgaccgcgcgccggtcaccctcgttcaagacgtcggcctcgccaccatggtccgccgcgccaatcctctcggcttcctccagactatgttagctagatacgctgatacggatacgcgatacgtggatacgaagatgtggcatttgtgaaaaactaaggatacggggatacgtctatatatatattaacaatataaaaatttaatatataaatttatgaactcttgcatggaaataagctcgtataatgtcatggaaatattttctaataattgtaattgactaaggttggtgaagcgatttaaccccgagaatgatgatgcagactgaagactgccaacttgccaataacttgccaacaggtttattccaagagtgtaatgaacatacacgtcgagagtgttagatgcattagcacttgatattccaatccgaaatttcatccgatctaaaagtagcactttgtaccaagaaaatagaaagagggacaagaagttaaaaaagaaaaagaaaatcattgctaacactagcatagctgcatgggagaggccaacaactgaatcgaccgatggaacttgcttgcctcactgctgaagtaagtggttgcctggttggagatggcgccggcggcggacggcggtgctatgcctggcggcggcagcactgcattcagcatccggtgttacgcccgcatatggcgacggcgcacaactctgcgattggcgtccgtcagcggcagcggcgctaggagtcgcgagccgcgtggggtgtcgggccatatgcgagaaccacggaagcgacgaacggcgtggagttgcaggataaagcgatgtttagttctctcgatcgtatccagaaggtatctcaacgtatcgggggagtatccagattttttttttgatttttctgaaaatcaccaatatcgccgatacacatgggatacgtatccgatacgtatccgtatccttccacgtatcagatacggatacgtagcttttgggaagtatccaggtaatgtagcctccagacccgcccactccccatctgcggtgaccttctcaagagctacgcgctcggcaccgcaccaagctactagctacctcatacagtgctccctttattattatttcctcttcttgcttttatatttatattatatccgtgcgttgtaatgggtgaaaagattctaatgataatatatgtttttcatgtataatcatgttaatgacaatgtttgtattttaatgagtggtttgtttttttataaacggtgttttttttcttgcgtgattttctcaaaccatttttttagaaatggcgtatttctttcaaatatttttttcatagcatgtttttttttgcattttttactgacgacaaaaaccatattttttctccctttttttcttttatttttttgtgttttttgcctgttttttcaaacaattattttctcgcgctttttttttgcttgttttttcaaatgtccttttttgcttttttttttcaatacaggagaatatatgacgaaataaaagccgtatagtagatggcaaaaaatcgatggatcctatccgagtcaagcatccatcaatttagtattttctctgacagttttttcaaagcgatttgttttttaatagacggtgttttttttgcacggttttttcaaaccattttttagaaatggcacgttttttctgaccgtttttttctcgcgcatttttttatttgttttatggaagatggaaaacattttttagcgtttttttgcgctttttctgacttttttctcacacgttttattgaacggtttttattttctcgtgcattttctatttttaaatagttagattagattagagatagagaagagatatatagtaattagaaatcgcaccactatgtttcgcactttccatttttttctcgcgtgcattttttattttatacgaaccaacttcttattttttaggaaccatttttgtcgtcacatttttcgcctttaaaggaatcacattttttttctctttttttctgttttaaaggaattggatctagtgttttttgcaccactttttttttgccgacaaaaaaaaccaggcgaaaaaaatttgtccgatccaaaacaaaacgggcgaaaaaccgggcgaaaaaagaaaagaaaaatcaaatctgtctgatcaaaaaacgggcgaaaaaaagaaaaggaaaacaaatccgattccacggtaaaaaagggcgaaaagaaataaaaaaggaatctgtctgattcctaaaaaaacgggcgcaaaaaaaaaccaggtgaaaaaaaagtccggccaaaaaaacgaatccgcgtggacgcagtaaaaaaagagcaaaaatattaaaaaaacaaatctgtcggagtaaaaaaaaagaattatatgcgacgtggtaaaaaaaaaatcgaatcctaatatatttgacgcggtactatatatctctatcttctctatctctgctacttaaaaaattaaaaacatttcctatgtccataataacaaaaaaagggcgaaaaaaacattaaaacaaaaaaaaagttcgattcaatttacttccgttgtccgtgaaaatcttatcttatcttaatctcaatactacttatatatatatatatatactacttaaaaaataaaagaaatttccgtcgtccgttgggaaaaaaactgataaaaacaaaagatcggaaaaaaaaagtccgactcctccaatggaaaaaaaaggagagaaaaaacaaaaaacgaagagaaaaaaacttccatcgcaaaaaaaagatgtccgactctaaaaaaaatccgactcctcggcggagaaaaataaaggcgagaaaaaacaaaataagagaaaaaaacttctactataaaaaagaaaaaaaaggtcctccgtccccgcctgtgcgatgaaacgccagcaaaaaaaaaagaaattgaggaaagggataaactagattgaagttcccaaaattaaaagaggataaacgatattgaaactcccataactcgaaaagagggaataaaatatattgaaatttctcgacaaaattctctaaattcgaagaaccctaattt

SEQ ID NO: 37574 - DNA, 3616 bp, Oryza sativa
gtcgtggcacggctttgcgccgcccttgggtgcgcatcctagccggcgaagcaggagccgctcagtggtcgtcgctgcacgcgcgcaccagcttgccggaccaccgtcgttccgctcactcgtcgccggagagaaatgggatcaagagagatggatttgggacctagggttttgcccctctccccggtcgatgcttcattcgtcgcggggatgattggagccgtccattagattggacggctcagattcgcccagcattaggccgtcgccgccgttgattacgctgcgcccaatgggccgcagaagtgtatcggtccgtccccgcatatgtgggccgcgctcagttgctcagcttgcgggccgtcgaattgactcaactcaccaaagatgggctagcccaagtttgggccggcttgggaagacctgggccgaaagcaaatttgatcaaacaatgtggctcacatttttcaaattaaagtccattggataaactcttaagtaggctcgaaaaataaatctaaaactaaatcctaaatccatgctaattgataaaattagactcggttctacctatttgttaatatatcaaattagacttgatttttacagaattgaggttttcaaggtgtcacactatcaaacggtgtttttcctgtagcaacgcacgggcactattgctagttagaaataatgtgtaagatagctagacgacgatataaacttacataaggtgatgtggtttatcataatttaaatagtatatagaatgatgatccaaatgtaaaagtaatatgatgtggctttatgagagaagataatgagggagataattgcgaccatagattaataatttgatggctagaaacaatttgaggtgatatggcttaatgagaaaagagagaaataacattaactaagtgaggatgaattgtctaggtatatagatattatacaaaatgatggggagatatattgaaatattttgagaattatgtggaatgatgatttaacatgctcggatttttaaagctctaaaattttagtgagggtgaactatataggcatataggatattataaaaagtgatggagaaatatattgaaatattatgtgaattatgtgtgatgataatttaattatcatgcttgtattttaaagctctaaaacttaataaattagcatgcttacatgaggtttgagatgtaataattgttagtggataatgtggcatctttgcatgttgagctttagaatttagaagaccttaactttatagaaagataggatattaagataatggaaaatgtatttcatctccagactccggttatatctaccctatagttcaacaaatactttcactcatcactcatcactcattctttcatctaccctaaagtttaacaaatactttcactcatcactcaccactcattctttcatgcctcactcaacggtctagattatccgattgagatctgacggccggaatagctcccgcgtaatctcgcccatgcgccccaaaatttcgcccttttttcatcccgatcgattctagatcgcgaaaaaatccggcccctatcagttcgctttttttctaatataagtcaaaacggtaataagccaaaacggtttattagggaataaaaataaatttgtaggtaaaacttatatatatatatatatatatatatatatatgttctttgtaacttaaaagccaatgctgaaaaagaaactacgtagaaaatatcttaaaatcaatcttaaaattaagtttgaaaatttaaaatttggcttattgggccgccctcggcgccgccgctccctcgcagcctcgcccttcacctctccgctgacgccgcccgtgcctcaccacctctgtcgttccaccgcgccactacggctcctccctccccatcgtccccatcgccccctcgccgcgccacttccccatcggccgccccgatgcacgccgcgtccccccgcgccactacgacgcctccctccccggtgtccccatcccccccccctcgccgcaccacttccccatccgccgccccgatgcacgccgtcgcgtcgcccgcgcctcaccgcccccggcgtcccccgcaccagcggcagaatggcgcaggccacttcatgttccccaggtacttcgaatctgaggcctcctggttgtggaacaaggaatcactagcaccctcctccctctctgctctactcttcttcttgcaaatggctgcttctggattcctgtgtcctgcctgatgcttgcttgcttgtgctttgcaaaggattaacgcctagacgtcgtgcattggatctggcaggagtgcaattgaattcctcatgctactcatttcagatgattcagccacctgtagaaaatgttgagtgcatgataaaaaaaaactaaattttcctgttgtttacttgtaaattgggatttgcactacagcaatctacaaaatctacatttttcttatctgttggaatggggcggtgtggatttttggttaatttttccaacggcaggattttagctcgatgatacatcacggcagatgcacttggttctgttcaggaaagattaactatgcattctttatttactgattaatattagtatgctttacattctagcgtgtgaaactgttaatgttagtactgcatttcctttacttggttgtaggattcatgtggtctcacttgtgttgatgttttagcaattataattcagattgccctggatggcatagcatatgaatgatctgagatgtcttatacccctaatatttacatgcaggattatcattacttatttgcgtttgttgcaccgtcatttcatttatgtaggtattgcctcgtgatgaagcaacatttcggtttgtcaatgaagccaacaagaccaagagcggtagttctctgtgtcacaaggtagctgaccattattagatcgaacaatggttttatcaggacctagcatacatattcagacaggtggtctacggcgtggcagcggtgcggtcacaagttccaccacggtgagtgcctttctgcgttcatatctctctgtactgaattgatcttgactagcataattatatgctatcatgtttgtacacactgcaattatttctcatatttttacctccaatcgtatggcagcaggttcatggtagcacatgggtttggtaaatctattccaacgaaaaatggtagtgtttgatcattcccttcgttttgtatagctttggttaaccttctgggtgaggtgcactacaattccttgtatgccattgaagttgagtgcttctgcttttttgtgatatatgggagtgaagaaaaggtttcctacaattcctctacttggcctcagatcaaatgatttgaggggcagaaaacgaaacatgatggtattcagtatcaaagctaagtttttttattctttttgcagtcataaaatttgatggaatactaatgcctgttgcagggtaatttgccctcaatctgaggtattgccatgagtattatcattttctccctgcaaattgcaacaaggtaatttgctgctagaaactttgcgcatctatttttttaggaaaaagtacgaa

SEQ ID NO: 37575 - DNA, 26376 bp, Oryza sativa
  unsure (1)..(26376): unsure at all n locations
ttcctgcagccctgccgcttgacccgcgcggcgcgcgcccctgcccaccgcccgtcccgcgccatcccgcgccgccgcccgccgtgtgagagagatagagatagagagtgagagtgagagtgagagagagaggagagagaggagagactatgacaggtgggtcccacattttttaaataaataaaatgttaactggactgccacgtgtacgctacgtagaccaaaaccaccgcggattggatcgaggggggtaattcgtccggtttgcatagttaggggtgaagaatgtccggttttgtggttcaggggggtaatttggacgaccgcgatagttcggatgggtaattcgtactttttccatttttttaacaccataccagagtttcctgtagtatatattacaaattgatcaataatttctggttataacatttacaaggtgtttttttaaatggctacttcgttataacatggtgttctgttcatgtgaacttgtgaagtggctgagaaagtctttttagctaaaatgcagtgtgctatgttgtgaagagtgaaatgaagaaatggcaaaagggtgagacatgggcttatagttccagtgatatgaaatcgttcatccctgtcttgattcctagaagatgatatttttttccaagtagctttgatgaaatgtagcaatgagtcaatgaccaaatttgtaataatctttgtatggatctgaacaccatcgatatgatttttttaatgaacctcttgtattataaatggttgtttgcggctttttgtggtttactgctattttgatggatgtctttgtctcctatgtcacttgtacttgtgaatttgtggttatccgtagcattagtatggacatgctattattacgttgacatatgtttcatatcaaactgttatttgggtttatattcacgccctcgtgctatgtgctcaaaggatagcggccaacgtgtgccttatctatcccgttaccactcgccgctcatcttcctgcacataaaatttctaatccactttttaagttcaaattatttactccaattatgaaaatttgtacttgaaaattttaaattttcatttcaatttttaaaactttcaaccttttgatttttgtttggcaaatatttaaattagaggcctgaaaatgcatcttttaaataaatattggcgatagtccattctattaaacccgcccagtatattattcttgccaagaatatgtctgacatatgacatatattgaattaagactcaattgcacagatcatacaagaaatagtttttgctaacattatattttaaaattctttaaagagaaataaacttgcaccgtagcgtttagcacgggcatattactagtggtacaataatggaaaaggctctctaccttcttgaggtcatgttaaatggatttaacccaaatatgttttaactttgcagtgactcaattgtgaaaagaaaaattggcacgtcacacagatttatgactgctaaattcttatgaataagtgtaggcgtgtagcaactttttctagattgactgctaaatcaatttaccatcttttattggattgtcaatttttctagattttttttagatcaattcaatttttgtttggattataccatccacacagtgtatctcatatgtttgggaattggttatgcgtgttaataaaaaaaattaaggaactattttttaggggcttccactatatattgggctctttggcttagtagaaatgatatgatttttttgataaaaacactctcaaaaacttatttgtaggtacttttcaagacaacatattggctccagggttgggctcaactacaaagacatgatgatgatataaagctaataaatgatgcatgtcgtaaacttgaatcgacgattatgcacctttttaccaacttcggagggagattctcaaatactataattcagtaattgtggattcttttatcttgtgttggtgtttattagtttgtgtttattttatgttatgtcagtgcgtgctatgtgtgtttatctgtggattttgtaataattgattatagcttattgagcaaaggtcggattgtttattctattattttaaaaaaaagtatagcaaattggctagaaaataagatgcatgtgatggacaaaccagctagtaaaacgtgctttgtctcagtcgtaggcttgtagccttacgtaacaaactctaatgattggattttggatcctcttacttgcatggtaaagtcaaatgagcacagtatctatgactctggggattttgtagctgtccaattgtgcaacgaatggacaaaatatgtgctatattatccgatagaaaatttgagccgctacaggatatgtatacttctctgcaccataactacagtgaatcactttagataattgtagcaacatactcgtgctaccattcctctgccttaatttgtacctgcaaggctagtactccctccgtcccacaatataagggattttaagtttttacatgtaacgtttaatcactcgttttattcaattttttttgcaaatataaaaaacaaaaagttgtgcttaaaatactgtggataataaagtaagtcacaaataaaataaataatattttttaaaaaaattaaataaaacgagtgatcaaacgttgtaagcaaaaactcaaaatcccttatattatgggatgtgatggagggagtacaagttacgggatccttttcttgagctatattgtttaaattatgaaattctagattttgactttaacgaccaaaaccaaactgacgatagccttccagaaggcgacatttagtgttggggttgtcaacgatgggagcaccgatatcagtgatgcttatgggcgtcacacatctttttggagacgatgttagctgatgccttcttccccaacttcgtatctcggggttgactctctaagtgaaaatctagttataaatgttcagaacaatgatggcaatatctacaatgtcgtgatcttcttggaaacatacattggagatagtgtgctggtgaggcattattggcatcggattggctttgatggctatgacgttgggtaaatgactgatttacttagttaccttcaatgttattttctgctttggtttaacgttagtcactcatggtgatgtatgccaaattcgattatagaaataattgacgttgggaaaaactaaggactacatataacttgtacactgttgggcaaaacaatggttatgcagatagaagtattctttaatctttaaagtgatattcattttttaatcaaactgtgaatttttttttcatttgtagtcatttgccctgtaatttttatgacaattgattgtagtttctttaaagaaaaaccgaaataaattatattgtgttaaaaatgaaagaaacagatggcagcgttaaactccaccggggcttgcaaaaacagacggatcttgtgcaggagcatgaatccggtgcaaatctaatggtgaaagttcaaatgattcacaagaaaaaaaaatgggttgagtattgcactttcaggaaaagaaagatggcacacagcgtctctcctcaagcaagaaatggacttatttagtgatttgcaattgcacacgagatgcagtgaaaagagatgtgtaattttaacatcgagcccgtgtttaatctctgtctggaggacgtctttccctccgaatctccctttttttatttacaattgcacaccctaaagttatcgatcggagcacacgcgtgacgacgtgagcagcctctgctttctctaccggttgtatacatacatgctcaacgagctatatgtatataattggatggttagtacttcatatatactaacgtggaggatctcatcctggccggcgtcgtggcttcttggccggtgaagggctctccgcctcatcgtcgtcgtcggcctcctcgccgcaccgtcgttgctcgccggcgatctccttgatgggcgccacgtttaggtcgaaagcggcgcccacgctcgccgccgtcgctgcactggagaccgtcgccgacaccgatgggccatgcaagtagtggaacctcttgtgcccgcccagcgcctgcccggtggcgaatcctcgccggcacagcgagcagacgtgccgccgccgccgcccgtccgcctccgaggcggcgtcggcgtcggcggcgacgcggcctgatgatgccggaccagcagcaacgacgacgtctctgtgcgcgggcggcgccgccgccgccgccgatggcttgcggtggctcgccttgtgtccgccgagcgcctggtacgacgctaacgccttgccgcagagcgagcaccggaagtggagctccggcggcggcggcgccancgccagcgccagcgcggtgctctccccgcgcgccgcggcggcgagcgccatgaggcacagggagatgaggtctccgacgtcggcggcgccgctcccttgctacatcacgtcacgctatccaacacacacagctcgtgtcgtgaaaattgaaggcgatacgtttgcatgcgattgcgtctgtccgtggtgtgtgctcttatttatgcgtgtaaaaaaacacgaattggaaaactctatttatactctcgttttgcatgtaaattaaaacgttatcaacttttttaaaaaaaatagtatgatagatcaatatgttatactccctccgtcccataatagaagagattttgactttttttttcactatttaaccattcgtcttattaaaaaaaatttagaattattatttattttatttgtgacttactttattatccaaagtattttaatcacaacttttcttgtttatatttgcacaaatttttttaataagacgagtaatcaaacagtgcaagcaaaagtcaaaatcataagatggagggagtatgtcacttcatgcctattcaaattcaacttatacatgtaaaaattctttttatagtcaaatttattatttttttcgaattatataagtcaaagttcaatttgtatgtttgtgaaaagatatatcatatattaatctatcttgatattttttttaaaaaattataactttttaaacgctacgtacaaaacgaggacaaaaatctacttgcgaatcatagtcgtcgcaaatggcacgaagaaatcgcgcgcgtcaaatcaaagcagcgcacaatggctgacgacgcgaacaaactcccgaggtaagaagcttggaatttgatctgaaccataaaaaaaaaaagatacatggcgatcgatatgtcgtaatttccagttttccaccaacccacacgtgcacttttctgtatataattctcgacgtcattttcatctcattatgagtttacaaattacaaccggtccaagttcgatctcaacttgcgaattttacatatgcaacttgtggatttatgcataccctgaatagtgaatactctgaaaccggtgccttttctacggaagagggatgggccactgtctcctgaagcaatgcatatgattctcgacgtcattttcatctcatgatgagtttacacccggtccaaattcgatctcaacttgcgaattttatatgtgcaacttgcggatttatgcataccctgaatactctgaaaccggtgtcttttctacggaagaaggatggaccactgtctcctgaagcaacaaacacagctgcgtgctctttgactagttcaaaatttgtccaaaggaaaactcgattctgaaaccagcagggataaagttctagaacgatcattttatcagtccccttgtgcggcatgacctgcttttgttttaccttcaccaggtagaataaacatgcatatgacgagtgcaatgaagagcacacggagcgccaatcttgaaagatgaaaatcatagcctcataggcgagtaattgtatatgtactactctataagctctttaaaaaatattttgtaacgaataaattcatttcatcattattaaaaaatataggaatgagtgtattttgcacacatctacacactatcgcaaaggtcaaaataacaccatcaacaccgagaaattggacattctaccacttctaagattgggttttgccacaatgccattccgcggaatggcgtcgttaaaatgccactttcaacctatgccaaaccgttgctttgccatattcgccatttcacaagatttttaccattttttgcacttcaactgaccaaaatgcccctctctcctacagtttctttctcttctccggtgaacatgtgggatggggaggagaccaccacggcagggtggcgctaacctcaagctcggtgccaccaccgccggagctctcctcctcgtcgtcctcctcttgctctgcaaattcaagaacacaatctttgagctcaaaccacacacaatctccacaatttcggagagctagcgagggcgagggcgagcgcgagggctgcggctcacctcccgccgccttggtcgctggcgagggtttcggctcacctcctgccgccttggtcgccggctcgtcggtctccatcccncgccgcagttacccgtgccgaccgatgcccgagacgacgatgcaggtcccgtcctaccacgagctcctcctggagctagccttcttgggccatggtggcgtgcagcctccggcgcgcggcggagacgctggcggaggagatggtgacgagcggcgcacggtggtcagcgggaggaagcagcgcgttggccggcgggcgcgacgacggaggagattgtggcgcgtgacgcggtggccggcttaaggtttccttctctttctccgatgtgcgggcggcgggcttcggccatgggggcgggacgtcgccggcggtgagcttgggcagtgcgggcgtcggcagcacgaacgactcacttgtgacagccggaggggtattttagtcagctcgggtggaaaattaggtggaaatagagagaattggcccaaatggcaaaacaaatgtttggcatctcttgtgagtggcattttaacgacgccattccgcggaatggcattgtggcgaaacccactattggcagtggcctaatgtccaatttctcatcaacaccagtacaccacaccatgacacaaaactgtctcaaattccaaaaagattaatgcatagaatttggagagaaaccggatttggtgataatgggacctcctggatgacatcttcaaggagaaacgcaacacacggagcgatgctgatgtctgtccagatctcaaggggatactatacaaggttttcacccgatggtctcatcaaagagggaaagagacacttccaagagggaaaacgagcccaaaggcatcgccattgtctgccacaagactgggctagacttttgccttccacccaccccggttgttctacagctactgctccaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagggaaaaacagaactcgatgataccgacgagatcgtaatcaaacaggttcgattagatctctcgtcgacttggctcctgtaggcttcaactccgtaggctgtggtggatgtgctgactatgagatttgatgccttaggtcctcccggggggtcccttttatatcgcaggtcaactggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaatagacctcgacaagtctacctccaccagcgcgtcgctgaagaaactacaggaggatggcacccttcccggtcgcgggaccatggagagagaagcaggaggtattgaaccccagcctgtcctgggtcgcatggttgcgatcgaggactatattctctgtggttttcttctcttggtcttgaacttctacggcctttctttgctccatttgaaccccaattccatcgccttcctcagtattttttcgcatctttgtgaggcctacattggggtagagccgtttcttgacctctttcgtttctactacgagttgcgttggatggaatccaacaaggtatctggatgcgtcggtttccgactccgggatggcctgaagtcgcgctatatccttttccagtgcccttcttctcgtagcaaatggcgggcgaggtggttctatcttcagatagaaaattcggattcagtcttcgttgttcctgaggaacaaccagacaagatttcgtctcggaccgcaaaacccgccttaaccccttctcttcagtccttcatcaatgccatcgatgacctccgagtacgaggtttgtcagggtatgaagtcgctgtcgacttcattggtaggcggatcaagccgctccaggctcgagcccacccagcctttgactattctgggccggaggacgcaacccgggtttctcctcggggtatttttcttgtatttaaattgacttccttatgtgcgtgttcctcctgacttatcgaattctggttctcgatctacatgtttgaacagcgaaaccgtggagcgccgcgtcggccaattgatgatcagcggcccgacaacggcgagcaaagtccccgtccccctttgcgagaagggggcagccgaacacgaagctgccatcaatgtaagtgtactcggcggccctttcgcatttttcttcggggatcgcattgtgacttcatgaagtgtaggctctccctctgactgatatcatcgggccgctcgtggatcatcaagcagcggcgtcgctgaaggaggacgtcaccaaggaggcgcccgatgttgctgtcgccgctgccacaacgagtggcggcaacgttccgaaaagggggaggaaattctcctccgtgatcagaaattgtcggaagacacccaccccctcggtaagctctcttggtccttcatcgcgtagtcggaaaacttccacctcacatcatgcccgttatactccagggctcggatgcgtctcccccgcctccacgacggcagcggcttgtgacgcttggcgagaagtaagtggatgaatttgaggttttgtcgcttcgtcaaactcttgtagcctttcacagggtagcacgggcgaaggcggcgcaagacggatctggagggacttccagcgcgtctcctgccgtggcctcgacggatgttgtggtcgtgcccaggagccgcgaggcaatgcctagcggcccagccagcgatctcgtggctggtcggggtctgccggctgtcgtcctcacctgggaggagctctaggtcgagatggggcgcctccttgaggctggtgctcgcagcattagccgcgagatcgcggaggcgagggcggcgtcagcgtcgtcgacgaatgagtgcgccgaccggctgacacgcgatttggcagaggttcgcgaggacctccagaagatgagggagctggtggccggcaatgagcgacaacgacaagggctcgagcatcgtatgtcggagcttgagaacaacttgtcggaaaactgtggctcgctgcgggtcacctacactggtctgcaccagctcgccggggagtgtggcgttaagactaccatcccggcgaatcccaacgagttctcgctgacgtcttcgcttgcagaactggcgacagcgatggaggcgatcccctccaagcacgcggccaggatcggagaggagacgtccaacgggacttataccggggcgtgccatgtcctcgcgtgtgtgaggctggcgcaccctgaactcgatctccagaagatcttggatcaaggggcggctagcgacgcgcgcaaggatgtgatggaagaagtgggcgatctgggggagtccgtccccccgctttttgaagaatagaatttcggctcccttgtactccttagtcatgctttgtaaaactctaattggttccaaccgcctttgtgcgtgcagtcatcaccttagttttctttagcattttgatctcgagtactttgttgtcatttgtagagacgttgatgtcgagaatgtccagcagcgcgggcaacctgagttgccagtgttatttttgttggcgacgacttccttaggttggttatttttgttttcatctcatttactctttcgtctggatcgacttgctttgctgtgttctcgggagaaaagagcagtttgccttagtcgtttccatgctaagcagacctcgagagtgcgcttgctgaccaagatcgccgcatccagtattggaggacgaaatttgaggtcgcggaactcgagaggactatgctggaggtgaagaaggaccaggccgtgcaaacactccgaggtcgcaaggtgtggttcagctcatatctgaagagttgctgcacgtccatgactagggtctgtagagagctccgagtaccccgtggagatcccgaggaatcagcggccggatacatctcgtggctgaatggggcctacgcccagctcaaaggcatcggccagcgtatcgatgaggccctgaagcaggagtgccgtcgatcgagccgatatgccggggggcatgtactggcttgcatacgagatcttcgtccgcagctgcacctcgagttcctccacgaagggttttctcgttctcggagaactcctacggagatagatggcctggcgaagtcgatggcgccgctggcggagaaggtcttccaatccatgaactggcgttggccttcctggtagtctccgtgtcctgtgacaaatgtcttagggaaaagtgtaatataattttggatttttatggaattgtaagaagtacttgtgaaatagaaaagaaatatatctaactaagctttcttactctagacgtagtgtgtaagagtgtcttctcacttcgcgacttcgatcagttgtttgagctatacactctccctagcccccagccttgccatcggaaaattcttctcgaaagataaagctcttggacctttgacctgcctcggttgaacaagcactgatcctagcccccagccgtgaagttggaaaattaatttccgattacatggcttggttaatacacacggcgagaactcttacacgaccagatcttacatggtctttcgtctctacaggatccgacaaggccttatcggctctgggcgtccccagccgaagttcccttaggttcctcggaggccttgtcaagacggcgtaaagggatatgaggataggtttcaacgctaggtgtcatctgggtaagggatcatcgggaaggaacactttgattgtaatttgtacctgaaaataggctttattgaagctgtaagatatcttacaagtatggatactattgtcttatacatagaatttacataattgatcaatgttccaggaatttgccaactcgcgaccatcgccgtctgcaatcttgaatgcgcctggcctcaagacttgtgtgatcgtgtacggtccttcccatttgggtgagagcttgtttcgccctgcttggctttgaacctgtcggaggacatagtcgccgatcgacaacgtgcgtgctcggatgcgcttcttgtggtaacagcgaagggcctgttggtagcttggctgctcgaacggcaactcgttcgtgatgttcctcgagtagattcacatcgtcgtttcgctgctcctcctgatcctcatcggagtacttctgtactcgtgtactttgatgtcgtagctcggtggggagcatggcctctgagccgtacacgaggaagaatggtgtctccttgttagacgttgtcggtgtggtacgcacggcccatagtactgatgggagttcttcgacccacttcttgtcgtgtgacatgagcctgtcgtagacgcgggtcttgattccttgtagtactatgctgtttgccctctcgacctgtccattgctctgagggtgagaaaccgaggcgaagcagatcttgactcccagcctaatgcagtgatcctggaaatcggcactgataaactgggagccgttgtccgttatgatacggtgaggcaatccgaatctgcaaaatatgcctttgatgaatttgattgcgtcgtcggccttgatttcccccgtgggtgtcgcttcaatccacttagtgaatttgtcgatcgccacgaataggaacctgtagccgccctatcctcgtgggaatggcccgagtatatctagcccccagcacgagaacggccaagtaagagggatagtttggagtgcttgcactggtagctttgtgtgtttacctgtggaattgacaggcttcacaccgctgaaccatgtcgcatgcatctttgagggcggttggccagaaaaacccttgtcgaaaagcttttccgactaatgtccgaccggcggcatgtgacccacagatctcttcatgtatgtcgaggaggagatgtctgccgtcgtcggacgagacgcattttaggagtaccccgtttagcgccttcttgtatagatcgtagccgatcatacagtagatttttgctttatgggttattttctcggcttctgcgtcgtcctcgggcaactcttcgctgcctatgaatttaatgagtggggtgcgccagtcgtctgtggtctcgatatcggcaatgacgcgctctgcctctgtagcccccgagctgttgctgagggcgaccgggctatcttcgccgcttgcctctttcactgatgtccttgtcaggacgtccagaaaggtgccaagttcgagtggctctcgtctggacgcacaccgtgctagatcatctggctcgatgttgtccttgcaatatacgtgtcgaacctcgatcccattgaaccttttttccagcttcctgacttctgcgagatacttggataactcgggcctagagcacttgtaatctttatgcacctggttcgcgactagttcggaatcccctttcacgaccagtcgcctaactccgagtgcagctgcagctcttatcccggcgagtattccttcgtactcggctgtgttattggtcgccctgaagttgaggtgaattgcatgcttgaattgatctcccgaagatgatgtcaagatgaatcctgtccctgctccttggctgttgagtgcgccgtcgaacgccattgtccacgtttcgttgtcgatttggttgtctgacctgttattaggcatggtccaatcggctacgaagtcggcgagtacctgggacttgatggatgttcgtggcacaaagtggacatcaaattggcttagctcgactacccattttgcaatgcggccgacaacgtctttgtttctcacgacttcaccgagagggaaggaggatacaactgtgaccctatgggcttggaagtagtggcgtagctttcttgatgtcatgattaccgcgtagagcagtttttgaatctgtggatatcttgtctttgcgtcgtggagagcttcgctgacgtagtagactggttgttgcaccttctctctctcaacaacaatgataatgctaacggaatatggcgtggcggcgatatagagaaataattcttcattaggttggggggcaacaagtacagggggatttgataggtagcgcttgagtgcaatgaatgcctcttcggcttcctgtgtccatacaaatttgtcttgcttcttcagcggagcgaagaaaggttgtcctcgctctcccatcctagcgacgaacctgcttagtgccgccatgcattcggttagcttttgtacttccttgagtcttgtaggtgacttcatgttctcgattgccttgatcttctcgggatttgcttctattcctctgccagagatgaggaaaccgagcagcttgcccgatggtactccgaacgtgcacttctctggattgagcatgaggcgatatcgtcagaggttgtcgaacgtttctcgcagatcgtcaatcaatgagtcgcttgtcttggtcttgacaacaatttcatcgacgtaggcctcgacattgtttccaagttggtcgctaagtgcgccctgaaccgtgcgctggaaagtgtttcctgcggttattagtccaaacggcatcttcacgtagcagaataccctaaacggtatgatgaatgctgtcttctcctcgtcctctttcaccatgctgatttggtggtagccagagtaagcgtcgaggaagctcaacaactcacaaccggttgttgagtccaccagttggtctattcgaggaagaggaaagtgatccttgggacacgccttgttgaggtcggtgaaatcgacacacattctccatttcccgttggccttccgcaccatgactgggttggctagccactctggatggaatacctctttgatgaaaccagctttgagaagcttgtcgagctcttctcgtatggcttgttttcgatctggtgcaaatctccgcagtttttgctttactggtttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacagtcttgtcggggttggcactggagagtggaacgatgttgattgcatcgtccggtttcggcgtcttgtttgtcttgctcactttattgggtggctcagctgtggcaagtggactgggcgtgtgctcgaccatgtcgaggctccgcttgtcgcattgcactgctagcttagcattcccttgaatagtgattgttcctttcggtcccgacatcttgagcacttgatacgcgtagtgagatgcggtcatgaacttcgcgagtgcagttctcccaatgatggcattgtatgttgtattgaattcagcgacatcaaaggtgatctgcttcattcggaagttatttgcttggccgaaagttacaggcaacgtaattttacccaatggtttggacgatgactgaggagtgattccatggaagggttgatcggtgggtgtcaactcgcttcgtgggatccccatcgcgtccaaggtgctgccgaagaggaggttaattgagctgccgccgtcgatcagaactcgcgcgaccttgatattctgaatagtgggttcgaccacgatcggatatcgccctgggatgacagcagtcttggggtggtcctcttctgagaattctatcttctgttcagaccacttcatcttgggtgcagctccctgccacgtcgaacagacttcanttccactttcttgtattctcgctttgaggagtatgtcgtggaacctccgaagatgtgcaagacatggagatcagagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtttgtccgacttgtgtatagggcaccatgttttcttcatgtcgctgccttgtgggtctgggcgcttgggagggtctgcgtattcagttgtgagaacttccgcttgagctttccttttcccactcttgcgatttttcttcttgcttgactcaggtgcgtccttggctagtttcttctctcctccggtcttcagtttgtcgttcttgcgtctcagtgcgtcgtccgcgtgagcgcattgattgacaattttgaataatcttcgagtagtcgtgacacacctcgttgccaactcctaggtagtatagcgatctctgacaccggacttgaaggcgcggattacagaagcgtcggtgatttcggggattgtatttctgcactcactaaagcgccgaacataatccctcaaggattcacccgggttctgtgtcaacgcatgtaggtcgtcttcgatcgcgtgacgcttgtaagctccttggaagttggcgacgaactgctgccacaggtctgcccacgaagaaatcgagtagggcgggagatgcatcagccatgaacgtgcagagcctttcaatgcagttggcaaataattcgccaatgcgttgttgtctgctccagcagcgtagagtactgtggagtaaacctgaaggaattcttctgggtcggtactcccatcgtacttctctattgctcctggtcggaatctctcaggccatcggacatcacgcagcgaacgactgaaagctctacacccagcactgggggcagtgggttgtcggcgatcgtacgtccttcgtggatgtctatctgatgatgaggatgaggaagatgacgacgatgacgatgggtcacttggtttcggtgtacgattacgagggcgtcggccaggttctcgagaatcctgtcgtcgtctcctgttgctgtcccggcgccgatctccatcgtcgtcgtcattatggcggcatcctcgactagtatcgcccagcacccgtcgttcgcgatcatcgtgatcgtggcggttatcatggtctcggtcttcgctcgaacggcctcctcgttcttcgttatcgtgacgtcgtgaagagacgcgatgtcgggaatggttctcgttgtctcgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcagctcgagaggtcgtgattctttgtcttgtgaataggacaatagacatcacgagttggagaagtacgctgaattccacgctctttgcaggcatgaatttcagcgtggacgttgagaaaaacccagcaggcttgcaaggtgtgttttctggttttgtggataggacaccaggaccttgtcacctcggaagtcatcctcgccggctcgtgattcttgtcggaaagacaaggtttggccgcactaggatccttctcgggctcggatgtcgtcgacgttccgttctccgcttcggcgggaggatccttcgacatggagtcgtcttgggttctagccactgcgttcttgcttccggtcattgatggaccagacgagatcggcaccgtggtgtaaaccgggaagacgatttcgccgacttgagtccacaccagcattgttgaagcaggaactcctttgttgaggttggtgttgacgctgttgtcgacgaagctggatgacatagtagtagaaccttgagcaccaagtccccctacctggcgtgccactatcgacgggggatacccgtagaccggatatagagggtactggggtacgctggtacgaggatctacgtaatacgacatcaagcagacaaaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccgaggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataattgatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctaatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcggccaccttgcgccacctccgccccagccatcgacccagtacacctcagctctcaaaaagcaccagatctagtcgtcgagttcaatagtgaagccaccacgccgcttgtcatcgtcactgccacctaatctccatggcggagctaggaggcaaacgggatatgttgccaccgtatcgttccgtgcgtggtttctggtggcatcgagacggaggagggagggtggtggtgatgacgactagggttgaagcccccccccccccttccccggtgcggttgtctacacggggggcgatgtgagaggccaagtcagtataaaataaagtctttgtaggatagaggttgtactgatatgtgttcttgcttgcgggtgtttggattatcacagagaaaactcaccatgtgcagtagaacttattggtaagtattgaagcggctccgatttaaagctaatggaggtatatgcggtaagcgggacacatgcaccgtatgtctatgtcatgaggactcacgtagaccaacaatttcaagcaccaactttggatgattggatccatatatatgactatatgagtcatgacatatttctaaaatgctttgtccaaaccagtcaaaccttgaaagtttttaccagaagaaattagcgacgtcgagactaagcacattcgccattgatgaaacgtttcgtccttgagttctcgttaattttttacccaatgtttaaccattcgtcttattcaaaaaatttatgtaattattatttattttattgtgacttgattcatcatcaaatgttctttaagcatgacataaatattttcatatttacacaaaatttttaaataaaacgaatgatcaaacgttggtcgaaaagtcaacggtgtcatacattaaaatacggagggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattctttcttcgctgtttcgcacggacaggtgcaagaactacagtaggcaagccggcgcaggtccgctcaacactgcttcccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggtacagtacagccgcctgcaactgcaatgcaatgaactgagcttgtgaaacagtgaaactgcacactttttgcactgcatctcaccagtcaccagaccaggtaactgctattgcagcagctgcaacaagagcagtcaaaggacgacatgaatacagctaaagagccgagctctcgattatgaggtcacgggcgcaaaggagcttgagctgaaactgcagctgctggatgcccaattaatgaagtgatttgcaactcctaaccatcaactaatccgcaacgatcgtgatttgctaggattaatccctttcctgcaggtctcttcgcggcataattaggtgacgttaacgctgaccggcttccccctttttcctgggacagttgcagaggtgccgttcagacgacggtaaaaatatactaaaacgacagattttccctgatttcgtcaccgcgaatcgcgtcaccgtgatgtcgatgcgtttgattcggcgcagttatgcaacagatttgaggttttgtacgtaatcatggctcatttactcgagtaaattacgccgatacagggcgcaattggtaagctctggtcgtgaaatttttactgagttctgacgcaatgggcttggactgggacggtgaaacgtattcgttgttgtgccaggacaaagagatgcgagatgcgtcatgggttattctgaattgttgctgttgttgattcggaggaaacgaagatggaattgcgtgttgaggccagatggaagggtcagagcaagcaggacaacattttcatttttgggctgattggtttaggtatggaggaaaggacttgttctgttgttggattgcaggagcattttaatatgaccagtggacgaatcttctgaattttaaatggggatgggtgtaatcaggcaggatcatggtagttatggtagtgaagagtgaaatgccatctctacaataaatgttgtttctagcgaaatgtacgttctcttggaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaagaatcggtttgctatgtaagttaatgaatttcatgcaaactctactagcatgattctaaacttggataggcggttaccgttatcgcacctcattgataagcctggttaccgcggtaactgatgttaagggagaccttgatttagactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgtctctgccggcgccggcgccgcggcggccgacatgtgcgtggccgacgaggtgttctcccaggggaagctgctgcctctaaggctctcgtcggcggcggctggcgatgcggccgggcttggtgttctgccgcggtcggagtcggtggcgtccaccgtggggttcggctcgcggtccgacagccggagcgcgagctccagcggcagcagcagcggctgcgtcagccggagcgagtcgtccaagagcgcctcctccgaccactccgccgcgcatccgccgccgcagcagcagcagcagccgcggcggtctctgtcgagcagcctgttctacgcgcacccgagcccgtcgccgcagctgcgcacccggccgccgcgccgcagcaccgggtcggctcccccgccgccgccggccaccgcgtggggcatcttccgcctcggcgtcgtcggcgccccggacgtgtaccctccacgctccacagattccaagaacgccgccgccgcagcaaaagtcggcagcagcaggagcgcacggttcgagccggcgagcaccgccgccgacaagaagcatccggtggtgggtctcttcggcgacagcttcgggtgcaagtgctcccccgacgtggtggagccagtcaccttgccggcggcggcgaagagggccaaggccaagaacaagaacaaggccggcgacaagaaagctcagagtgttcgtcgcagcaggatcctggactggttcgaggaactaaccatcaccaagaagtagtaaatctttcgcgtaaaagatcgtgtaatttttttttctccgagttactctgtgatcaaggtaacatcatcattttagttcttaaatttcgatcattagaatttcattcctctgattaaccggccgcagtccttaagacataagttttctttcaacttgttttgtacagattacccttaatccgtatattaattaccttcggaattgtcgcgatgacacctgcagaggtcgcagtatatattcttgtttcagatgtcgtttacttttcttttttgtttctagaaccttacacattatctcatcagtcatcaccgttcgcgtgttgacgcttgtcgaattgtctatacggcgcgagataccactggtgtcacgtcgaagcgaaataaccgcgtcgggttcgggttcgggttcttgtcctcctcaaataaccaatttacgaacccactacttatatcaagtaataactcataataattttttatgttatggttagatttatcgtatctatagatacatgtgagacgattcataaacctatttacagattaaattgataggtaacttatgaatcaatctgctaattacctatttattttacatgtaagcgagttctcataggttgatccgcttgcattcctatcgcgagtggagacggggacagccacgcgtgcacagcgtaacgtacaattacgtggtgttgccgcctaccaccgagcacacggcagcagcgagcagccgaaccgaacgcgtggttccaccgcgcgtcgccggaatttgcgtgccgacggcgaccgcccgcgggtcggtgcggtgcagcagaatccgctctcccgacggcgacgtacacacggcgtccatccctttcccaaaatctcacctggaacgcgaaaaaacaaaacgagaaaaaggccactgtagctggctggctggagctcatgtgcaacgcatgcattgtctcgccggttggttcgtgctgcactgcgtattcactcttcagatacttgtggttttttttgttcctttttcctgcgtagatcgagattaggtgaggtgagcgtgagcgattcttggagcggttcgtgagcttttctttcgacgattaggattagctcatccaacctcacctaatctcatatccttttgcacggcattttgggtcgctactttctgaaaaaaaaaggttgttgttgccacatactacagcttggtggtcgatctcatggcttgcttgccggatccaaactttagtggaaagagagatgcccaaatgtgcacgtcgtttctcacctgatgccttttcgtttgccactttgccgggccagtgaaaaggcatactccctccgtcccaatatattaagacctaggatcggatgagatattttctaatactacaaatctggacaggcttcctaatatattaaaacctaggatcggatgagacatttcctagtactacggactgtctagattcgtagtactaggaaatgtcccatccgattctatgttttaatatattggaacggagggagtacattatgggatagagcaatcgagtgaaatgcacggtaatcaaatcagtagagcgtgaggtgagtgaggtcagtgtacatagaggttaaagagaaaaaattaaagtaagaaagctacgcctacactagattactagttgctgtaaaagaatttttgtgtaggagaa

SEQ ID NO: 37576 - DNA, 1797 bp, Oryza sativa
aattcccgaggccactaaaagtgttactactccactactacacaaaactaatcaatccaatctatactagcctaatccaattgtgcaggattacgtacaagtaggaccggccgacaggcattgcttccagggttacattgcatgcctctcaactgcacacaaggttatgtactgtcacgaaatgtttggatctcgtcgtccccatagccaacctggtagtactttcagtatcagtacatgacacagcaacagaaaatgaaaaaaaagggtcaaaaactgttgctggcagctgcgtcctgaaaacaacattcactaacagaggatctgagggttgccttgacggtgaaatggtagacactctagacttaaaatctcgtgctaattaaagagcgtggatgttttactgcaaacagaactgaatgtttgctgtacgattcaccagtagtcaccacgcttcatcgctgtggctgtgcagtgtaggacgtgcccgtcttttcgctggcataatcgatagcctgtgttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctacgggaaaattatctcttaaaaaccctaattgcgaaatttatttctttgcttgttgtctagtgtccatgccatctcaagatctcaaatccccgatctatcgtcgagttcaattccgaatccaaaaccttccaaatcaaatccctccgcaaaagtctattttgcctcccccggggtcgatgggctgaattttctctcggcccat

SEQ ID NO: 37577 - DNA, 3824 bp, Oryza sativa
tccccatccctggcgagctccccgcccgcgaagccggcccccgcgcgccgtagttcgcgcgcgcgcccgcggggttgccgcccgtgccgcgccgtctgcgccgtccgcgtcacccggtcccgctgccctgccgcctgcagccgcgcagccgctcggccccgcagccagcgcgcgtgcccgagccgcgccactcaaaccgccgcgcctcccgttgcatcccgcgcgcgcgtgccgtggtggccgaccgcctggtcgccgccgtcgtcagcgcctgcccacgcctgtcgcccgtgtcgccgctccgctccaaaccgccccaccgtcatcgccgtcgtcatcgcctcggccccgccactccgagcgcaagccgccaagggacggaggcagagcccctcctccctctgccgcgacgcccccgctcccctcctccttttccccaaagcggcaaggaggcgagccccctttctctccctctttttccctttcctcttccccgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctgtttttcgcctccacgccattgccgccgccccccgtgctctgttcgccgtcgccgttcgtcgttgcgcgtgtcggacgagccggcacgagcaaggacgcggaaggggactccgggcgcgccctctccttcctcttccccggcccgaggccggagagattactcccgcgccgtcggcctctcgtcacagcgccccacctcatctcggtagtgcctccctccgttcttcctcctcgttccatctcctccccttagactcgggtagtagcacaagtagcctccccgtagctagccggcgccgccccgactgctgccgtcgctcgccgtgtgctcgccgccgtcgccgcccgagctcggaagcgcctctcgtcgccggcctccctcgatgcgttttcgcccaatccaacgctagcatcgaattcccgtagccgcgtagatgctctcgccgccgggaatcggcccctcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcggccaagaccgggtcgagccgaccccggtcagtccctccccgtgcgcgtgttccaccgcgagccgtgaggctgcgcgtgggcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggactgcacttactctgcttgtcccgtctgcaaggctcgcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccgttccggccggcgtcgtcgtctacctcccgccggcccgcgtggcagctacgtaggcgccacgtcggcgccagctcggccaagaccgggtcgagccgaccccggtcagtccctccccgtgcgcgtgttccaccgcgagccgtgaggctgcgcgtggtcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcacttactctgcttgtcccgtctgcaaggcagattggcggacctacctaatttgttgcatttgatccttcctttgttaattgtgataccatgtccccttgtaaccatctagttgcgtctcgatattcgtgcaccctgcgcgagtatcgacggacgccttcaaacttaaaattttgagtaacaacttgggtaaaacttgggttttacaaaagacttggaaaacccgacacctgggtcggtgcttgcgaactaaatgaatttccaaaaccgcggaccggggaacgtaccgggtgtacgatttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttcaaaatgccttgtcatgaaagcttggaggtctcctgacgtggctgatccccacgggctgggtgatccgagttagtaatgtcgtgtgggtaaagtgtaccccctctacagaggttaacaaactgttcgaacagccgtgcccacggtcatgggtggatgtgaggtgattcctagcgtagttttgtttgactactgcttgtgaaattgctgttgtggaaaggggttcgatgtttgaaaaatccgtagctgatggaatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagtcgtttttagaaaagagttcaaataaaatcaattgcaaaaacaacagcctccccttgaagcctgcattaaacacttatttcccatggcttgctgagtactcccgtactcacccttgctctatataaataatcccccccccagttgctgaagaagatgaagcggatcctgctgatgaggaatt

SEQ ID NO: 37578 - DNA, 3804 bp, Oryza sativa
agaaaatacagataatttcaccaaattatcataaaactatacatttaaggtgatgtatcacaaagctatagatttaaaactaagtatcataaatctacatatttaaacaataaaattaccccgaaactatccttttggccttttggggtttaatctttaccaataatattaatattatgtttgagttatatacgtttaagatttgtgattaaattaatgttaaatctatagttttgtaataactttgttactaaatatgtagttttgcaatactctatccaaaatttataattttgtaacaaatttgatattaaatctgtagttttgggatatatctataattgtgtgaaattcattcttttttgagaaattatatttttaaaagcgtggcacgaataatccacttctcttttgtttaaaaaacaaaagccttgtgaagtgagtataacttaaccgataaggtttcttatgttgtaacaagctcactcgagttcaagtttcaagtttgacatggacgctctgtattatggctaattattttttcagtggcacggaacatattcgtcgatagtgaggtgtcctcggtgattttgtcaattttatggtagcctacactatcgaagtttgatacttttaaaatcttccacccatgaaaaattaggaacggtaacaaaccaaaatttggtcgaatggattagtgggcggggtggctaggtggctcaccaacgcaggcccgtctatactgcgtaggccacgggtgacaggttgaggtttgttctggctgtggacgtactagcgacagagctagggttggtgcaataagggcagtagcaacgcaagctgcacgtacgaggaacctaaaaaagccacataggctttagacatgggtccaaaattagtttccacacagtgcaaatggcctcatgagtgaatttaatttttcgctttaggccctaccacttttgatttcaaccctcatatttttctcaatttacaaagaagtgtaaattttacactaacccccctaaaattgagaaaagaatataaatcaccactatcaccgggtccacccccacaaccctctccccttctcacgcacaccatctcgacaagttcattggcaacaaactccgccgccaacgcgctctccccagttaccctacctgggcaacgaactttgcaccggcgacctctccaccctagcgatgagctctgccaccgctagcacctctctcatccccggtgacaagaacaatatcgcgacggccactacctccggtgtctcccaacttccccacctcagcaacgaactatgtccgcggcggcctctccccatcatgcccctccactttcggacgccgctcgagaccacaaggaaaccgtatccagcaccgccgcctgatgtcatggcctgatctggcctcaagctcaatagccatggtcggatttggcctctcttatcccttgccaacaagtgccgatcgagcatagtgcatcgttgtcggccatcgccttcgtcgacaacctcactcctgtcacctctctactgctgccgccatgcctccatcgttgttggcttgttgctgccaagctcgggtggagagagagagagaagggcttttgagctcgagtgggaccgctactaagctcaggtgaagagagagaagggtttttgaacttgtaactcacaagtaagaccgatcttccaagtgaagacatggtccccacccaactctctcttccacggcaagaggcgtcctatgtggcgggctagagccacacaccacgtagacgcactgtgaacggcctaacataacagggatatagctcattccctcctcggccttgccaacccgtgatcacccaacgacacgacaactatgggcttttttcgtttattgccaaaaaaacccttaccatttgtaggtaaagccaaaatttggcaagatcaagatatgcagatggcccggactaggttgacccgaggcttgacccactgcagctcagatttttacctaacattgtcattttgcaaacagctagaacaaaggcctgagcatacacaaacaacaactcgtaccattcgaattacttactaacagtaaaggatcccagcttagatagatcagggacccaacaagacagttccgaagatgcagtcaagaacatcaaagatcctggagcccatctaattagcggtggctcactatctgtgcttccccagcgagcaacctgcatgtccgaccatattatcatctctttcaaacaactacgatctccgtcctaaaatatagctacttccggttatacatggagaagtgcagtagctatattttgggacaaagggagtacaaaaactatatttgacatacctttccactcctaacattccaagcatatacactgccatcaccagagcctgcatgaaaaataaatattaggtaatgaaagaggatgtgccaaataatcacaaaggatgttagagaaaagtgggtcaccagatattatatggtttccatcagggctgaatgatgcttccagcgtcgaattgcttaccactggcttcacgttgtatgttgctatctgaaaaaggaaaaggtcaaagtctccacataacaagtctgcaaaatataaattaccaaagatagtttgcatgcttacattattgccatgaaatgaatctagcacatgaacacgcccagctttggtggttaaaagaagccgcctgccatcactgctgaactttatgacattggcttctgaatcatcattaccgacagagaaaatatcaaaaggcccctgtggatgtaagaagttaaatgggttgggtaattaagatcaaacaacatactcattcccattaccttctcaaaatttcgagcatcaaacatccttatgtagccaccatatgcaattgcaaaaaccaaaccctgatcatcataagaaactgcaggcctcccctgaacacgcagcaaaccctacaaaatccaagagatgcttttgctagtaaacactccccaaccataccatcaacatttctactgtaacatgcccaatgctcaataaaggtacagaacctcagagaaataaaatggatgcatacatatatgacttgtttaggattgtgaggaacccaatttccgttttcagaaaaaaagatgatgtacgtaattaaaggggcttgtaagtatttagttgcaaaaatcatacatctgggcttcagaatgatatttcaccatcagatggactgatggaggacaataagaagtctttttaaccgataatcagaaataagataaactaaatctgtaaaagccttaattgactgtaaactgcaggttgccaaattgacgggaaagtagtcaagcagtcaaacagtaaacttattgaggagaaatgtacctgtgctttttcaacccttgaatcccataggagaactgttcgatcaagtgaaccagagagaatgttcccgttctcagagcacaatgagatagaaacaaccctgattaagacagatagtatcctctgttggtattggctaaccgacatattttattggaatttatatttattataaagtttggcaaacctgtctagatggcctttgaaatatctcaaaaaacagttattgaccagtgagagtagacggagagaatctgcacagttaattattttaagtatttgtatacatgacttatatcactctgaagctatgacaatataggacttaccatcccatccattttttgaagaatgcaagacataagttgggttttcagtgaagcacacaagctcaaccccata

SEQ ID NO: 37579 - DNA, 1711 bp, Oryza sativa
ttcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacaattggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcagagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatttgaaagatgcgatggtggttgtggcaatgaatctgccaccacacctcttcatattgcagcaatgttattgggttgccacataaataatcaaggcgagcactacatatagtaaaaaacaaattaatgttgtttatttcaggaaataatattatgtaacattttgttttatccctaaaaagctaggatttagctagtaagttgtaatcaaattctaaagctgctatatcagagagaaaaggggtgaatagaaaagtaggaaagagaaggcaaatgaaagaaaaaaaaaagagagaattgtttcagttccgtggtgttccacgtaagcaccttagggggttatttagtttttttttctaattcaggatttcaggggt

SEQ ID NO: 37580 - DNA, 4085 bp, Oryza sativa
tcagcttaagaagtttcactcaggtttctacttgatcatgacatacacattgcttcatcgcagcatgtgtggtcatttataaccaatctagaagcttaaagcaagtatatatattttttgacttcgcatattgaaaaaaatgctgaattacacgtataagtactaaatcagccaatacaacaattctcatgtgctgctcccgtcagctgtcgcccatcgtcgacctcgaatggtgcaaagttgtcaagagcatcttttttggaccagctgtcgagaaaaataagggaaacagtttgctctttagtttgtgtgttatgtcactatctctcgaaagattatattcataaaatacttcaaaaggaaactataattcagaaagtactgctgaaatgtgggagtgactaatgaggtgcctaaatgcattcggtatgtttccagattgataatcctttggttttctacaggagaaaattgtatgtaacaattttcaagagttgttcctttattcgtctccaaatataataaattttgtttcaaaatacatttacttctaagtaccaagagcatttgtggtgataaaatatctaaattactccttaccttcacaaccccttccaccaattaactaggagcagaggtggaggcaaaaaaacttatatgccaagactgagctaataaagtctcaacatatttcagaatttatatggtgcttctatagaatttaaatggggattaaggagctaagcctagatctcaagccctagctatcctaagcctagccccgcgcctgactaggagtctatgacaattaacgagggacaatattgtgtttttacatatatcttcataatctcaaaaagaaaccctcggatattttaggacaggggactatataatttcctttataaaaaaaatgtcaagtagatttgatgccacgaggatatctcatgtacaaaaatgttattgcaagcatgaaattctaagaaattccaataccctcaaattgtccaccacatcaaaatgagcatcatatggaattttttttccctaggataccgcgatttgaagacgggaaaatggacatcgaacttaaaaaggaacccaaggaattttacaagaaattggattggttaattttctttaagttttcctcaaaattcaggccctgagttttctagctttctaaattctaatcataccctcagattacactcattgtctacgtgactcctatgtgaccctggcaagccaaaagggagcagcaaatttgcgagaaattcaccgatccgggcaaaagttggcgagacaaggcagcatcatcataccagtcaccaacagggcagcgtgctcttctaccgaggccacaataatgtgcttgctcaaaccagctcccgtatagctgactttctgtagcatcattcccagctccttctcccctttgcaccttcatttttcaccgtcactcacacaaagctcatacatattgttccacgagctaagcggctgatgaaaatttagactagttaggtttcccaacttttatcttctagtttaattttcaaaacttggatgagaatttgagtcgtttaaaggagtcgggagatttccagggaaactaaatccgcaaaagaccctccaaataaggtatcccagtgagatgcagatgcaatgatgcgcgtaaaacccttttcattttcctgcatcaaccatcggcaagctgctgcagaggccgggtgaaaacggtcacggaaattcccgatcgaccgagcaccgtttttgtataaggggtactgtttccgaccgtacgtaccatttttgttatttttaaaatttatcttttcgtaatttttttcatcgtattaatgtcaatacaaactagtttaaataataaatatgattaattaccgaccgatcgatcatcatttctaaagagatgctaccgattccgaccgttttcaccctgggtggcgaaacaaagccttaccactacttcaccatggtcgtctccctcggtcaacaaaggtgaaaaaagaacaatgggagccctacacgtcacagagtagatgacaccagctaccaccttgacctgaaagtgggccctaccggctctctgttgaccagtcaacgcatgagggcccttgatcgatggatcaactgaaatggaggcagtacgtagtagtaggagtagtacacagtcatcaggtgaccgggctgcctgcctgcctgctggtgaatggtggcgatgcgccactgatccggaagcatccgatgctaggtgcactgcagaagtacagcgagcagtggctgccaagatacaacttggttaacttgcaagcgagaccagcattaacatgtactcctacactaatagagcagctcgtggacggtgacttgagctaaacacgcatgctagatctgggaaggattcagcatgaagacaagaaaaacagtggagttttcagctaagcaagcagcaaaacacacatcagcattagtggtagtagcagcatgcagtactaggaatcaggcatcatctttcaagtgccaccacaaccaagaaaatttgcagtaacatgaaaggtcaggtgatctcaaattagtacagctctgatttttctgaaggcctacaagaggagtagtaggggttcagtaaaaaaggttacactaaaaacttctgcattcagaggataaaagatccatctcagaggccataaaagtgaggaaacacgagtggcctgatgagagtgaagaacatttatgctcctatttacagatttcacggtggaaaattgaagtagaggcagctaggagtagctaatatttgctgaatatacttgctcatttggaaatgaggaggattaaactctactggtatgaacaattttttgggctttggtttaatttcactccaagaaatgcagctactagctatagtaaacaacaacactaacagcctcgccgtcacacttccactctccacatgatcttgtcgccgcggcggccgacgttggcgccgccggcattgtggtggggaggcgcgcggtccacggcggcgacgcgcgccgggtgcctggcgcgctcgccgtgcggcgccgcggccggcggcggcagctcgcaggactcgccgacggggccggagcggatgtcggcggcgggatgtagcagtcgacggacaggccggggacgttgaacgccacctcctcgatgctccaggcctcctccatccgcgtcttggtgtggctcatggcggcctcgccgaagcggaacagcgtgacggcggagcgccccgcgtgcgcgatcatgatgccctcgacggggcggtagtcctccagcgcggagctgatggtggtctcccagtagacggcgtcgccgccggagtgcggctggatgcgggtgaggtgggagtcctcgatgtgcacgatcaggccggtgcgctggctgaagtagccgaacaggacgtgccggatgatctccgccggcccctcgctccgctgcttcagcgtctgcgggtcggccgacagcttgaggatgaagcagtcctcgccgttcaccttcttctcgccgacgcaccgcgcctccgcgaacagccccgccgtcgtcagcggatcgagcccctgcatcgtcgcaagcaatggcgagaacacgccggtgagggtgattgagatgggtgggtcggctaggccagatctagcggcggtgaggtgtccggacctggaggacgcggcggagcgggcgcacggggcccttggcggcgtgggcgccgagccacggcgtgtggcgccagacgaggcggccgttggatcccgcgtgcaccttgctgccgccgacggcgagctcgacgtaccacatgtcgggcgccatctgccagaggacgaagcccccctgctcgacggaggcggcgccgcggccgctgggcccgcggttcttgacgacgcgcgtcgcggtctcgaactcggacgccaccatccgcaccttgcccatggcgtacgcgttccgcaccgactgcagcagccggtagccgcccgacgccgccatgtactgctgcaggatgtactgcgccgtcgacgactcctgcatttttcaca

SEQ ID NO: 37581 - DNA, 5027 bp, Oryza sativa
tcctacctagaagcgaagcaaacaaacaagcaggtgaagcaagaactgcgccgtacaatgggggtccccttgatggagaggagaggcaggggatctgctagcttcgaagggatgggggccagcggcgcgcccatgacgccgaggaggaggcggaggtcggagcggcggaacgagtcgcccgaacccccgggactggcggcggcggcggcggcggcggacgacgccacggacggcgtgcgcgccagctggccgcggacccatcggccgaacccctcccgccgcgccgactcctccccgccggcgaagtcccccccggcggcgaggcgctccgggtcgggcccctcaatgaggggcgcgagggcctcccctccgggccgcaggctccccgaccgcgagatgagcggctccgcgaagtactgctgcagcagcttctccggcggcggctgctgctgcttctccttgcggcggcgcgggatcagcatcctccccggcgacgcgctcctcgccggcgacttcccccgcgacctcgccggcgacagcccgcgcaccacctcctccttcagcgccgcgaagaacccctgcttcctctccttctccatcgcccaagaatcacaaacaatgcagccgcctcaaagaaaaacccaagaaagcttccgcctccccggacaaagactgccactgccgaccttgcttcaagacgagggcatggagagtacggcgcgaggagtggagtagaaggtgagctcgctcgctcgctcgctggctagctggagtggaagcaagcgagcttagctagcggagtgcgagaggtagaaggcgatgtgggcggaaatggaaaagcagccgcacaaaagaacaaaagataaagaggagatgagagggggaggaaaccgtttgacgtgagagcgcaggggagaaagggaaagcggcgaggtggtatgtcggaaagagagaaaaataaatcaaaatacgggtacttttgacaaaataataatcaaagcatgttcacttgcttcatgttactgtagatgtttgggtctgaatttttggtcaggttcatgggacgaggatgatccgtagagaacacagcacgttttcgaccaggatttgatcatttgatgtgtggggggaaacatgtggggttttgtagcgtcagttgttgatttttgcctcgttggaattcccatggttgattgattgccggactgcgtgatttcgggctccaaataggtacatgcatatgccgccaagtcgccaaggcgagaggtagtaggtaaaacacgaagtttcaaaatcagtttgtaaacctcgttggtttaagccccaattgtgtgctagtactagctttatcgagactagcacgctttggaggcggagagaacgctgtcaaaaagcttctccactgtcttcagtgcttgtaaccgctctacctgacccgatgccgtactcaacccacatcctataggtgctctgtattccttctcagttccataatgtaatgcgttattctatcggttccatgggccatgattttccatcagcatctttggtatctcactcaactcataatgacaccgggcaatcatgtaatgttcgtgataatgaaggttgcttttccccgtgttgtaaacagtgtggctgatggccactcagccagccagccttgccccagcggaaacggagccacccggtgagggaaggaaggtcccgggccccgcctcacgcctgctccaacgtgcaactatcgctttccgctggtcccagcaccgtgccgccgaatcatggaggagtagtaggagtagtgtgtgtggctaccgggcgcgatgcgtgcgagtgtggcgggaacgccgggaacccgtcccgtgcagcggcgcgcggcaaccaacgggcagaagggcagaaacgcgcgaccgctcgctgctggtgccgcattgcaacgggcgcgcggacacgtgacgcgcgcggctcgcgcgaggggacgagcagccgttgggttgggttgggccgtgcggcgcgctgctcgctgcgggcgggcgcggcttgaccgagtcggggtcggcgggagcggcgggcggggggcgggggcacgtgagcgggggggcatcagatcggagccccgccgatcacgggaggcgatggcagtaatcgctgcctgctagtgctagtgcatcaggccgtactgtggtagatagaggcggaggcgacgtgcatcaaggggtgtttacatggagctaacttttttttagtccatgtcacgtcgaatgtttgacgctaatttggagtattaaatatagactaataaaaaaactaatttcataaataagagctaatcatctgcgagacgaattttttaagcctaattaattcataattatgaaaagtttactgtagcatcacattgttaaatcatggcgtaattagacttaaaagattcgtctcgcgaattagtctaaggttatagaatgggttttgtaattactgtatgtttaatactctaaattagtgtccaaacattcgatgtgacagggacttggaataagtctatgtttcccaaacactttctcaggcactcagagccagactaataatacaaccgaccggttagctataaggttatttgtagttttctctcggcctatccatataataggttagtctttacaattaatataggacccacttatctctctcacagagtttcttgattcttgtgtttaagccgactgtaagtttacaaactgcttcttctctctcctctcttctcttctctccttcatcttaacatttagccggcttatagtctactattatacttgctcttacagggtgagtaggttggctaatactgctttttttttaccttgcaatcgttttttcccctcttctgtgtggatatcacagggcatgcggtggttgtatgccacggatattgcaggggcgattttttttttccctatcatgcaggacatgacatgttgtcaaccgattgtgcaacagaaacccagctcagagctataaactgtagtacagtacgagggtgacagtttggtctttggtgcagtgactagtgagtactcgtaactctttactaattgcatttccattatatattcatgtgcttaggcattgatcgtaattgtgtacagtttactcatctgtcagtcactgctactacaaattgcagtaccgcataagatatgtatacttttggcattgcttagggctcattcggttcataggatttttaaaacataggaatactagaggaatacaatggcaaacctatggattgaaaaacacatgaagttttcctatgttgttgagcaagccaaccaaagaaatgcaaacattaggttggagtagatattttttcctatgtttttccttcaaaagtagaggaatggaaaactttcctatagttttcctatggtgcattcctatgaaacgaatggtagtttaaaacacattcctcttcttatgcttttcctttacagttccttcgaaaggaattagccttttgcccttcgctccaagcttactaaaggataaaggtatataaactctaatatgagatagtgatttgtaatgctattatagtacatgatactcatagttgtgccacaacaggttgcgctatgacaagattgctataaggacactagttacaactattacttctttttatttcagccctttatttcctgcatggtagcccttctcacctttttattaacaaataagctaaaaattttatggtttagaccttataacataaaaaaaaaagttacgtacatgcccctaacctaccgatggatctacttgttagccagcctatcatttttttccttcctcatcaccctctctccctccataaaattttggctacaaagaggcggaaatagagttcgatccatcttgtcaaaattttagtattaccaaaacttgataagatttattttggctacaatatgaacaggctctacgaatgttgatattttcctgcacatgcatcaatgcatcatcagcgctcgtcccaattcgttctacttatccagcccaatgtaaaaaaggcccattaattcaggtaaaccgtgggccgtctcactcgagccgcaccccgtttgcaaccgagaatgctgtttggcgatcgattgccccgggatgggggcagcgatcgatcctctcccccctccctcactccacccctccaccggtttccttttctggcaccgcattacttttctattttcgtaaatttatacacctaaagtttatacacctcaagtttacacttctatagtttagagaccaaaagtttataagtcaaaagtttatatatccgattcaaatttgaatttgaattaaaatatttttttatatatggtatttctatacatctaaagtttatacacctaaagtttatggacctaaagtttataagtcaaaagtttatatacctgtttcaaatttgaatttgaattatatctgattcaaatttgaatttaaattcaaatattttctatatatagtatttctatacatctaaagtttatacacctaaagtttatagatccaaagtttataagtcaaaagtttatatacccgatttaaatttgaatttgaattatatctaattcaaatttgaatttgaattcaaatattttctatatataatatttctatacatctaaagtttatacacctaaaatttatagacccaaagtttataagtcaaaagtttacatacccgattcaaatttgaatttgaattcaaattttttatatatagtatttctatacataaatttttctaaattttgttttttttaaaaaattgtgtggtgtactgtagtagaaagagaagaaggggaggaggaagggggagaacaggaggagaggcaaaccgatcgctgcacgatcgccctgagaacgatcgcccattagcctcccccgttggcaactccgtgtcgcttccaccatggcgaattggcgattcgctccacccgtcacggcacggtagcagtgta

SEQ ID NO: 37582 - DNA, 2283 bp, Oryza sativa
cacaggcacactgctagtactgcgactgagccacctccgtactccgtcgtacatacactacactactccctccgtctaaaaaaaagacaaactctgagttttcgtgtgcaattttgaccgtccgtcttatataattttttttataattcgtattttcattgttgttagatgataaaacatgattaatattttatgcgtgacttgtctttttaatttttttcataattttttcaaataagacggacggtcgttgggcatggaaagcagagtttgtcttttttttttggacggagggagtgagtttgtcttttttttttttttgacggagggagtagtttctggagaccgtagagcggagagtattcgtctgcataaaccgtagtagtttcatggagtacttgagggtgtgtttagttggggaaaaggaaatttttggtgtcacatcgaacgtttgaccggatgtcagaaggggttttcggacacgaatgaaaaaactaatttcagaactcacctggaaaccgcgagacgaattttttgagactaattaagccggtattagcacatgtgggttactgtagcacttatggctaatcacggactaattagacttaaaagattcgtctcacgatttcccccataactgtgtaattagtttttctttttatctatatttaatgcttcatgcatgtgtccaaagattcgatgtgatgtttttgaaaaaaaaattttgggaactaaacgggccctaaattgaacagcgcggtaggcagcccatttgtcccgtaaactcggcgatgtaacaaaaatgaggctctcatagggaatacatccaatcacacaacctttccatgtacaccaactagcaaatgtcacaaaaaattctataaaaaattatacatttacacctaatagaattactccaaagtcttatatttaaattcattatattttagctatataaaaaacgaaaatctgacaattttatcttttttcaggctaaaatataatgaatttaaaaacaagatttcacacgtaggtgtaatattattggaaatatgtgcctaatttttctaaaatttaatatgatatttgttagttggtgtataggatatattcctctgatatattgccataactagctagatatagatcaaggagcaagtctagggcacgcttttggataaaattgagtagcagatgcacggtaagcggccaaggaggctgttgcctgttgagacatgacaaattagtgaaaactcaaggctatctaagctgttgcctacttgcctgtaaaattagtgacgtgaatgaaaactcaaggctggttcaaattacagggaaaattagcaaatttcacgaaccaaaggaaaacgtcgaaataggtgaaacagtggaacttcatcttcgtaataagtagctcttcacggttttcctgcagagaagatatggttcaaatgaatccagtgacagtaagttataaaaacacctgaaatgagaccttcagaacacctaaacagtatcattcgtaatgtcgtgtttaccatctctgacacgtctcagtgacacaaaataagagaggcctacagtttttatgtttactataggtttcaagcgatcaaagaaagcacatgagaatatagagttggtgattcttgatgttttatattgtttttttttacgtaatgttttatattgtctaaaacagattgcaagtgagagtgtaacatactactaacatgctactccatccttcccctaaaataagggattttgacattttacttgcattgtttgacaattcatctgcaaatataaaaaacgaaaagttgtgcttaaagtactttggataataaagtaagtcacaaataaaataaataataattctaatttttttttaataagacgaatggtcaaacagtgcaagcaaaatgtcaaaatcccttatattaggggacgaagggagtaacatattaaggatgaaagcaagtacttgcatgtttggaagatcagggaaagaaatagcatgaggactatactattgggtgaaggatattaagaaatcatacatggataacaataatggaattgtcgcaagttcagacaaaagaataaagaacactgtcctggagagtgcatccactctacaaaaaatgcataactatacgcacaaaaaaaggtggccaaatggttttattgaattgtaaatgttcaactctgttatctgttattgaaatgtcatatacatcctttttttccttttgaaaggagtaatggtcctaacaa

SEQ ID NO: 37583 - DNA, 10750 bp, Oryza sativa
ttgatgtgcccctccaggccatggtgttggactgctggtcctgcaaagcacctctactcttcgcatgttgctggtggatccgtgaccatcatctgaaatgttgagcagtaatttcttcagtacaacaagcctctcccttagcttccacctgtgatgcgtggaatcctcagttcagaatcctgtgttctattttcttcagcagatcatcgaaacactcaagtatacagttgtactcatgaaacatgagacctctcgccctacagttagatggagaacataattagatcaccagagctatttattcagtgtatgcagtgctagtgaagcgacaggaatatgagaaacataccattcacgatgattgcaatatgtgagaagatgatcagcaagggtgaatggtcgcacagatgggcgaatcctcttcgttgtgtcatggacttggcacaatgttgttggtcgctcgaacgatttgttgcttggagagtgtaaaacgacaggatttggcagcagcacatagtaatagtagtaaactgaatttctgctgattgaagggaggtgtttggctgagactgacaagcacctatccctacaaaggaacagcacgaggttgccaatgctgctaagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtaggaaaatatgctgacatggatctcttgtagagagcctatagataaccattgtgggtgccctaactggaagcagttcccagctgctgacatccacctcgaagattgtgaatgcgcaacgttgccatgactccttggcctcccttgtcgcactcccatggcggacaacgaggagcatatgcccacaagagtcgactaggttgtaggagcaggagactggatgtctggatcgccgaacttggcagggacatgagcaacaacggggccaagcgggtttggagggtagacttgcacaatctgccttgtcaatcgccggaagccgtagagtcgaccttggaagggcaatgtgttcaagagctccatgtctttgtggatgacctcccagcttgggtggctagcctcacagccgagcactccagccgtgtaagggaaccagacgatgacggcaatgggggtcatcggagacgtggcgctggtgcagcatgtagagcagggagttgcggttcttgaccacctggtggaacacgggggcgaggggcgggaggtcgacggcgacgccggtgaaggggttgagcacgcggacggcggtggtgcgcttgtggaggaggatgatgaggccgtcggtgaagcccacgatcctgtggcaacggagctccgggaggcggacacggaggctcctggccgtgcgggtgtggaagaaggtgatctcgcaggcgtcgtcggggcgggcggcgtcgccgtcgcacagcgcgacccacgcgcgcgggcggagcaggtgcttccgcagggtggggtcgcgcggcgagggcgcgcacgcgcgccagccggagcagacggctcggaatgcaatgtagtccaccacgtcgccggcgagcacccggccggcgacgaggcgggttaggtcggtggggagagacgcccagccgcctacctgcgccgccggagaagtggtcaccaggtggcgcttgcgcttccgtccgcctctcgccggcgccgccgcggcagccggagctgaagggggagcacttctccccattccacagaagtgattcaaaccacaacgcgggcaccacgaaatcgtcggatgctatataggctaggctggcctcctcgccatctccgaatccgactccgactccgactccgacaacgcaggcacagcaatccgaggagttcacggaaacccgagcgcgcacctggattggatggacgacggagaaacccttggaccttgcgaatccgaagaagaagaggaagatccggaggaattacctagcaccgcaagatcgccgccggaggcccggagatggggagacggccgccggagagggggatggtaacgagtgctccgctccggcggacggcacggggaatagttggatacacgagtacaaacactagccattaagccaggcctaacgggccggaatgtgttgatgggccctcccacgattatcttccccaagagtaagttaacttgaggtccctcaatttatcatcgattctgaaattgatccctaacaccgaattaccagatagaacaggttgctgaatttacaaaaccaaatcacctgaaattctaggcagtattaagcttggttttagcttacgtgcttttagatgcaatatcaagttctgaacacatatttactttgaatcagtgacaattatcgaactatagggtgaaataaacagtcaacttttttttctcaacaatccaagttggcatgcaaatcattgctgctatgaagttaccttctgcactctgcactaattaaactctagaaattttcttaattttccaacaaagagaagatgatggtgttactttgttacggttattttcagtttgcgtgagcacttttattatggatgtttgcatctcacggtgcagagtctgagatatttattacatcatcaaaacaaatgtgaacacttatctttgtttttgcttattaggacaaggcattaaggatttctagcaacatgataatattatcgtcacatttgggctgtgatttgtgattataataccacgtaaacgtcaagtcggatgaaaacagcggcactatgccgcataggatcaaacaaccctcatcgatactacccgggtgtacaatataagagaggctttttgtacccgatgttgtggttgagcgacaaaatcagacttggtccatagctgagggatgttaaatgaaccttttccccatcaagctcatcccaattgatctactaatccaacccagtttacagcccattaattcagtttggaataagttcacctgaggtcccttaacttgccaacgaatctgattttcgcccttcatccagaaaactatatacaacgggtccctcaactatcaaaatcagtgcagatgaggtccctcgacggttttgacggtggttttggctgacgtggcgcctacgtggaaaattttacttggtcttcatctgatgtggcattgacgtggcgcatacgtggcaatttgatcgaaaaaataataaacttagtaggacccgcatgtcagtctcacacacaaatcaataaaagaataatggggcccacgtgggcccacatgtcagctaaaaaataaagatggttgggcctacgtgggcccccacaagtccctctcggctctcctttctcttcctctttggtctccctcgtcctcgcggggagcggcggcaggagcatgccggcggacggagtggcggcggggcgggcggagcgacagcaggccggggggcgtcgggccgcgtccaggagcaaggaccgacacaacaaggtgtgcacgaacgtctccgaggtcgcctgtgccgtacgccgcgctcacccgccagccgctgctccgctgctatgctcccccatcgccacttcgcccgccgctgccttggagaagagaagagagaagagagaaaaaagaagagaaggagaagaaaagaaaagatttgcagctgacatgtgggccccacatactttttaaatttttttttgctgactaggatgccacgtcagtgaaaccacccatgtttactgccataggaccttgtgtgtacggtttatatgagtttaggggtatacatttctgattttatagttaagggacattaaaaaatctcgctgttaagttgagagacctccggtgaacttattcgtctctctcgtactgcactcgtttgtcacttcattgcgcttccacgtctcacgacggaatcaatcgatcgagccgttgccgactatacacggttgcattgcaccgctgctgtccgctttgcgtgttcgttcaaaaccagtccagcgtcgtggcagaggcgaacgaaccatccgtcgatggcgctgctgcactgccaaagtaccaagcgtatcgtttgccgctgctgctcgtgctctcgctactggaaatcagaaatcaaccagcgtatcgtttccctgacacgggccagcgaccaggtcaaaagtgagtgaaagaaagaattcaatgttgggtgtacagtgtagtagaatgtagtacgcctgtatgatcgcttcatgaacatagcacccatatatataagcagccaagcaagcattgcatccccatgaccccatatcaagaaccactccatacttacaattggtaggcgacacagctcacataggtcacaaggccatggctaacactaccatggcgagcggtatcaacgaggtaaaaaaaaaaaaaaaactccttcccgtgagatttcttttcatgacttcaccccctgcttgcgttcctggttttgtacatctctcaggggaggttgctcgcctttctcatcgtcctgtacgcttccacgatcgccgcatccatcgggcgcaggatattgggggcgcgcctcgccgcgtggcgctccgacggcctgggcgccacctgcatgtccttcgcggcgctcacgctcgcgatgcaggccatgctcgcgtgcgtccttgaggagaagcccgccgcggccgcggcggcggtggcgaggcgcccggccagcggcggccggctcccgtggctggtcgccgccgtgagctggatgtgcgtcaccaactacttcgtcgcctacatcgccctcggcggcaacgtggcgcccacctcgctggagtggacggccgccggcgtcgcctccgccgccaacctcgccatcgccacgcgtaccgtccgggtaaaatcttcttcttcttctttttcgatcttatactagctgttcttcgcttctttgttgtgttcttgctaactttctttctcgttgtcttcagcgtcacttgggtgtgagcaacccggccaagaacgagtcgtagatctgccaggagccaaggaagctggagtttttttggagatgactgctcgatccggcgtgtttaccagtagtttatcaatcaatagtaccttgttatttcattgccctagctttgttcgtgaactttgctgtagtttctgtatgatctccatggatccagtacttgctagaccttaattatgaaatggaaacttgcagactactactccctccattccataatataagtcacaaccactttttttagatgttacataatataatataaggtatacatgcaagcatgcaataaactatgacatcttctccattaaattataacttttttaaatcctccactctcatgttatctaatcctattagatgcatacattgtatacattgtatttattaggatgatctaaactacaagatgataataattatttcttggtctttaggttaagggtagttgtgccttatattttgaaacggatggagtatgttttttcaccttctatttcttaaaactgttcttttctatgtgctggaggggaatatgttttctgtgtattgggtttcattcaccaggcgcgttggtgaccgtgtgcccgtgaaatgatatcacagactttttttttccaaaaaaagaacacgtccgaatggttatattgtgtagccaaaccaactagttgtgcaacagaaaacacaaaacgcagtgctataaagtgcaacaaaacaccatagttttggcaccttattggtatctcgagatattttttttgttagaccaaagcaaatcttgatgagtataataaccttttgtgattccgttttcatcataattcataaattcacaagcttgggccttgggcatttgcttgcgcctgtgtgtgcagcaccgctggtacagtgaagctgacactcggaaccagtctacggagtactccctcttttcctaaataaagcaaacctaacttgccaaggagcttttaaagagagaaacaaaagaccacaatgtccttaattaatatgaatgttgtattgaataatgggtaggtgaggggtattgaagtaataaaatttctcgttttgcggattggtgatagtaatatggtagaagttagtttattttggaattaatttgaaatctaaaaattgatttattttaggacggagggattagtaagtagtagctgcagtatcatgccccacgcagagcatgcgtggtttggtttgtcgttgctcgctagtgaaatcaataagcgcgagttcgagctcgagcagctgaaaaaccactgaaaagtgaaaaagcaagaaaggagtactgcgtccagtctgtactcctgcaggctcgcctctttccaaaatttgccaaagctggaattaatactgccaatattgaccagttcaattgggagtttgagacctctaggatgatcactggatcatgaacactaagcctatatatcagcaggcataagcaacaagttccagtccaccaaacacacgacataagcagtcaagaagaagagtagcatagcatggctgcgagtgatctcaccaaaggtgaaaccctagacgactcctctcttcctcctctgaattttctgcacttcttgtcacgatgtgtacgtgttcttgtgctcgatttctctgatccgatccgttccatcaatcccagggcgagttcatgtccttcctggtcgtcgtgtacgtcgcgacgtcggccggctcgctgttctgcaggctgatgtcgtcgatcgcctccccggaggccgccgccgcccgtcggcgatccggcggcctgaacgacgccgtcacctgcgcggtcttcgcggtgctcacggcggcgtcgcacgccttcatcgcgtgcttcgtggaggaggccgtcgggcccgcgccgccggcgacgacgacgagggaggagaggtgcgccgcgtgggcggtcggcgtcttgaccggcgtcgtcacctcgctgtgcatctccagctacttcttcacctacatcgccgccggtggagtggcgccgacgtcgctgcagtggacgatcgccgccgtcttctccgacgccaacttcgtcttcgtcacgcccaccatcatggtaattaattaaagattggatctttgcatgcctacccgtctaattactgttaattagctttcttgtgtgtagcactaattctaaactagttcgatctcgttgtctcttcagcgtttcattggcaggttcaacagtgccagggatgactagatgttccaggaagatggatgagtagttttttggagttgtctgattcaggagatggatgcttgagtcgtcgtcatgcatgttgtttggctgctgcctacctatgcatgttttaccggttttgattaccttgatgttgtttttgtttctcttatgcccgtgatcttgctgtgttcttgatcttgccgggtaattaaacttctaagatgtggccttggaatgttgtatgccgtatgcggctccatttgatgatctaatctaccagtttgtttattttggtatttctgctaatacttgttcaaggagaatctgttttctggttgtgaaactgttcttttccatgggattgtaggcaggatatgtaggtagtgcgttgtatcatgtactacgtgcgaaattgcagcatcttcaggggtagcaatagcatagcccagtttgaattcgagctgctgtctgtcactctgtgtgtatgtatagcacagcgaaacttgcgtgtagtttgtcacgttgcattcctagacatgggccctgtttggatcaggagggctattaaataatcctctagaatcttgctatttaaaagtattaaacatagattactgacaaaacccatttcataacccctaagctattttgcgagacgaatctaacgaggtatattaatccatgatttgctacggtgatgctacagtaatcagccgctaattatggattaatatacatcattagattcgtctcgcaaaatagcctaggggttatggaatcggttttgtcggtaatctacgtttaataatcctaaatagcaagattccagagggctatttaattttttttttgagcaaagggcgatgccctccatttccattaaagaaatgtaaatattcttacaagaaacagagtctgaaagaccaaaatgacatcatgcctaaagcacaagctaaagttttcctaaagaaagaactccaattctgccacacagagccaaacagaagatcaaactacctagtaagacaaaagcccataatcgactatctccagtaaacgccatcagccattgagcagtcttctctgtccaagacgccacccaaattgtgatttaaaaacttcatttgctatttgctttagcagttgtactccccattgcaactttccttgcctttcctccgaactctgcaaaatggcccaatccaacattagagagcaggaattatacaagatatcaacagggctatttggtaaaatatgatcaaagcaggctttatttcttgctttccaaatagcccagataacagctgccacacccactaacatcaattgttttgttattttatcacaagtttgaatccaagagcttagcaagtgcttcaggtctttaatctatttcaagttaaaagcacatatcacaatgttccaagtaaatctaactgacacagatcattccccttcttccacccccttttgattagattgtctttggttaaaacatttcctttagtcagtaaccacagaaaaatcctaactttcagaggaaccttaattttccagatttttttgtatgattccctcaccccagttgatgtttcctgaaatttcaaagccttatagaaagatttaacactgaacatcccattttttgtcagattccaaacagtgacatctttttggtcactcaagaccagctcatcacaggaagttttgatcctattccagtcaactaatctatcacccatcaaattccttcgaaaggtcatgctagcccaacctatctccttcacctttgccaaagtcacaaactgattgtttgttattctatacaagagaggaaattgatctgccaaaggtctaccacccaaccagttatcctcccagaataagatgtttttaccatttccaggtttctttgtgcagaatttgaaaaagatgtttttgacttccattatcccttgccaaaagtgagaggctcctgcttttaatttagtggcagacagaatgtgtttggataaatatttttctctgatcatctgttgccacaaaccatcagtattctcaagattccaaatccatttccccaacagagcaatattcatgaattccatgtcaaggatccccaacccaccaatctctctgggagagcaaactgtgtgccaattaaccaggtgatattttctaatcccctgatcttcctgccataaaaatcttcttctaaaaaaatccattttttctctaaccccaataggaactctaaaaaaagacagcatgtaaagtggggtgctactgaggcaggcattaatcagagtcaccctccccccaatcgattggaaattaccctgccaacatccaacttttttctcaattttcccttctgcctgtttccaatctttattcagaagtcttttttgatcaattgggaagcccaagtatctcatagggaagcttccaatattgcaagtaaaaatctgactatatacagcttggttttgtgctgcttctcccaaacagtaaacctcacttttgttaaaattaattttaagacctgaaagttgctcaaaaatgcagagcactttttttaaatttcttgcatattctgggttatcttggatcaaaaaaatcgtgtcatcagcatattggaggattgcaattctgctatcaacaccagtccccaacccctgaattaactgttctctctcagccctttgtatcataattgttaaagcttcaacagctaggttaaagagaagtggggacaaagggtctccttgccttacccctttgtgagtctgaaagtagggcccaatttgatcattgacttttactgcaactttacctccccttactgttttcataatccaatcacaccaaatctcagggaaaagttttgcttgaagaatatgaaaaatgaaatcccagtttattttatcgtaggctttctcaaaatctactttgaataagatccctttttgttttttcctgtgcattgtattcaaaatttcatgcattattagtactccttccataatattcctattttttatgaaggcagtctggttctgtgaaatcaagtactcaattacttttcttaatcttagcatgagaatttttgttataattttgaaactgacatttaatagacatattggtctaaatttttgtttttgcattgcatcctttgtttttggcaccaaagtgattactccataatttagtctttcaatgtcaatgttccctctttgaaaatcctcaattaccctcattaagtcaggagaaatcaggtgtcacgcccagaaattcccgaatagaattccaagcagaatgtgcattaaaatccccgtccaggaccggccggggtacacaaatgacaatattgacattcagatccacgtcttacaaacatc

SEQ ID NO: 37584 - DNA, 1744 bp, Oryza sativa
gggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaagcccaaccatccacctatactatccaatttcattagactaaactagggtgagactaatcacggtgaatctggttgactgcccataaccgcgggcacggctattcgaatagttttactctgatcagaggtgtacaactgtacccacaagacacagccccacgacacgtttccgtgcgccgacatgccaccacgacatactggaaagaggccgtgacaggacccttcgcataaccccctctaaccaagcacaccacacctcaggtttcacccccactcttcgcaaggcagcgggcagtcccctctagtgcctaggtgaattcggaagccgcataggccgtcgcaaggcccatccaaactccatcacgcccacccttgcctggatgcgtcggctagagaaaagctacactacaagcccagccgttgcccatgttggcttgtggtaagtacgataagttctttcagggcatcccgcgaaccggtccttaactgccatgggtgcgaccaacaaaaccatgcacccacagcccaccatgtgatttattttaattaagcaacaccgaagcggtgtcactaatccaacattaccattagaacctacagtctaaacattaataggatttttccccaatgtgtgctagttgaactaagcatggctaagcaattcctattccaaagtctattcatgttataacccaagctaacaaaggagcatggtatcaaaatagcatggctgtaacaataggtaaacatcccatagtaacattataaaacaatgcagtatttgaagaaaaacaatagagcatttgcaatataggatcaacatgttcaagtgacaggcatgacttgccttgctctgcaactggaggaacctcgacgactatctcgaagtacaccggagcgtcggaagaaccggaatctaagcgacatacaaagcaaacaatacaaacaggctataagactactgaaacagagaacaaaaccatttttaatggattctacacatttttcttgatttactgagacttgaatgggcttaaacggagcacggatgaattagatatgaattttagaagattcactgtgtttattactataacaaaaagtccttaaataatttattgcgcaattaattcccagggctgacgtcatcaagggggcggtcggcgccgacaggcggggcccgcatgtcagcggctcaaggggagagaggggcgccggcaagtggggcccccgggtcagcagcccaaggctgccggcccaccgtggaccgggaccacgcgggtggtccaccgccggtccacgggaccgacggcccagatcgccccggggccgatcggacgggcggcggtacccggctcagctcggctcaaggccggccgaccggccacggcgatggcgacggcgtgcgcgcgcacgcgttgccggcgtcggcaaccggcggcggaggcgccggcgcaaagtcggcggcgcacgaccggggcgacggctcgacctggcgcggctaggaggcagaggggggctgcaggaat

SEQ ID NO: 37585 - DNA, 2588 bp, Oryza sativa
  unsure (1)..(2588): unsure at all n locations
agggagggagacgaaccacggcgcccggcatccatggcagaaggcggcggtaggggtagacctccccggagtgcgaggggatgcgggttccgccgacgaatctcgacggaggaagggcggacggggtggatctcggccacgcgaacccgacggcggcgacgaagcggcgcggcgacgagtctagcggcggctagagacgaccggagtggcgggaaaggcggcggcgggtggatgcacggtgcgggagcgatggagagctcgggagagttcggccgaatgggaaaaagagagagggggtggcggcggagcttaaatagggagagagggggccggacgtggccgggagaggcgggaatcgccggccgacgtgggggagtgggagaggagagagaggcgggattcgaaaatcgaatcccggccatttcaggcacgggcccgggcccgatcggaagagagggggaagcgggtgcggganacgcggcggcacgaccggggcggccgacgtggcccggagggggcgggacgcgaggcgcggcggcggttgcggcggtggtggcgacgtgaagacgggcggccggaggaaggggacgaccccaacaggtgggggcccacctgtcggcgtcccggggagagaggggaggcgggcggctggcccgcgcggcttagctgggcctcggccttcggccggcccagcgggaggagggggagaaaaaggaggaatgggctggcggcccattcaaaggaaaaaaaaaagaaaagaaaagaaagaaaaagaaaaaagaaggaaaaaggatttttcctgggattaaaattgcatgtgctcaattttaattggttaaaattatttctagagctctgaaaatttcactaaaaatcctgttagcgaatttcgacatgtagaactcaagaaaaattccacatgccaattccgattattatttgcattaatttattaaggtttactcttgcttgacacaggtattttcttgagaccatttaaaactccaatttaggctcgggaaagaacttcggggtgtgacatcaggtcccaaaagtgttcataaaattctatagggaaaccatcaggacctggagccctatttttcttcatatctaccacaacagctttcacttcttcttttgaaattactttaatcaattcatttctatcttcttcccttagtttagagaaatcctccatgttcattgaaatacttgcagattggccaccactcccaaacaaggttttataaaaattggtaataaaagacatgagctgatgttgaccttcaatcacaccttcctcctgaatcaatttatgtatttgtcctttccttctccttccattagcttttgcatggtagtatctagagttattatccccctctaaaatttcctggtctttacacctctgaaaccactttactctctcttctctaatggtatactttaattttagctcccaaacccttctttcctctctatcaagacaagtcatcccattcatctcgatttttttgtctaacaagtcaatttgagttaaaatttcagccttttctcttctatatttgccttcccaatttatgttccagcccttaagcctcttcctaacagccctcagtttcccctgctagacatctaaactggacccattatcattataagaagaccaaacttcactgacaatcttatccaaatcctccctcatgaaccaactaatttcaaatttgaaaggagtattcttgctgcaattattcttcaggaccaccaacagagggttatgatctgagaaaactctttctaggcattggactgtcagcaaaggatatttttgttcaatctcactcgttatcatgattctatctaatttttcaaaagtaggattttcatgacaactgcccaagtaaatgtgcttggtcccatgtcaatctctcttaggttagcttgttcaataatggcattgaaaacaaaactccatctgttgcaaccccctggtttgtttttttcactctcccttctaataatattaaagtcaccccccaaaattagaggttttttctgtaaattcaattcctgtgcaagttttcttaggaattcttctttatgttctttttgtgcagcaccatatacaaccattaaatcccactcctgtttatcttccaaattctccacggtagctttcaagaaaaagtgaccttttctcacagccagcattttaaatttttctccatctagacccaaaagaatccctccagacctcccagaagctgggatccaatcccaaataaactccctcccttgccctaaagtttttagaaaatagacagagaaatcttgtttcattgtttcttgtaatccaataaaaccaaccttgtgttctttcataatatctctcagatgtttcagtttttctagatccttcattcctctaatattccaaataatacctttcattttttcttttttggttttctcccaggtttctgtttagttgtcataggagtgaccttgacaatagcaaggtttcctctatcagctcttctctttcctttatgtgattgagataaaaaggtttcagtgaaatcaaa

SEQ ID NO: 37586 - DNA, 5360 bp, Oryza sativa
gtctgcagcttaccttttcttttaccaatgacatggttcaagatgttgacaatgcgaaggaagcgtccaaagtcaaggtcaggataatcagactttgggatggcataaatcccaacagacgtgatacttattaataaaaggtcggtataaatattccccttgcaaataatgttggtatttatgggtatccccagagagcgctcacatttactataaacgttaactaaaagatctgtagtttattaggtcaatcgtattaccatgaccattgatcaatcaaagaatttgtattaaaaccaagattaattgtgcaacttctgggatgctcgctcattaggcagaaagatcttaccacagttgattaggtggttcgcattcctatgatattcgatatatatacatatgaattcgtgtaaattaaaatatgccacaaaaagtaacatgggcgctttagttttatttttacaaaattaataattctgaaatcagacatcatagtgatcacagagtttttcctttcttgattcccaatttagaaatttgttaatttaatttcattttttaaattcataattagtaagttgaacttatgtgaactccaaaccatacaactaaaatgtattatttactattttcataattattaaatcataaaagttacaattgggacttcaatcatgaacaatcgataaccgtggctctagaccgagtacaatttcatattttatttacaaattttgaaattattaaatcataagattctttacaattgaaagtataaagcatgtataattatgtacttttaaagattccaacttgaaaatgtataactttcaagaaaatttgatgaccaacatattcatcacaggattacatttttaatatttatgttgttaataactatagcccatgcaacacatgggttagcgaccagtattattaagaatgtgactaggtagtgcacggtagtgctttgtagtataaaggtacacgtgtccagattcataatcaggaattcattcattcggagataaagagagttagactgtattagacgatgttgttgaagttgtcaataaaacaaactcgaccaagacaggttgtacacctaaggttaactttgagcttacaactatatatgctcaacctttgagcttgcaggttaacctcaagttgactactccacaccattatcattgaaaaaccctttaatattatgattaaacactatcaaaattttcagtaagagaaaaacactgccaaaatgtggctaaataaaatatttcagtaaagagagaaaaacattgtcaaaggtgtgtaaataagagttcgtacaacagagacatgatagagacactattgccggattctctgatttggtgagtgatttaaatgctgaaatcatacaaattgaaggttggtgaattatttaagagcaataagctagttggctggatttttaaatataaccaaaagggatgtattccctgctgggaatgaatcgatcattttatataggcacactttagggtccatgcaaatcccaaaagtaagaaaatgataagtaaaacagtgcaaattgcagggataggatttttcagtacacacaattgcagcacgcatgcttatgattcttgtacgaaatggtgtcctttatatgctatttactcgttattttttagctgagctggccatagccaaattccattcatattgaaggagaagtggggttcaaaaatccaagttgtggactcatacagaattgtgtaattagtgccattaattctggaacaattatatatatgcatctgtttttctagccgtgcaaaattattttttaggccgggttaatttctcttcagctgcaattcaccttgattaggagcaaaagtacagtgaagattgcttgagttggggactgtcggcttgagcctgccaagaggtagctaggtaatcgtttgttaggtgctctatcaaaatcatgatatgcaattacctctccacaaagcaacttactagtagcatacataggcttctcaagtgacatgcatattgctagataggtggattagggcatgtacaactttcattagtaagggttcttaacctttccaagtagacaaattcgctgacatggaagagatgagagtataaagtgaaatatcgatgttaagcttaacattggtttagcatcaactgtttttaaaagagaaaatatcgactcttaacctatgtaaaaagaaatttggctacataaggatggggaaaggggaaaaaagagattttttttctgatggacgaatagtggatagtctttattgtcttaacttttgtaagggaaacaaccttcaaaaaatttgtattgcctaaaagttcatgctaagctagctacctttgaacttgtacttatgactcaagatccaaaaaaacaatacttagtttcttaacagtgtagttaatgtttgttttgatttctttaggactaacaaaattaaaaaaaatgaaccagctggcttagtttcttgacagtgcagtattctgaatgtgacataacataactaagagtctattttctttcccccttcaaaaatgggcccatatgaaatccgattaggacttaattctccaaattaagtgtaagccagcataactgaattactgattaatcagtcacaattttcgctgtcagctatatatagttgcaggctgtgcaacaaagtacaagaggggtcaagatgagtcagacattgcctctagtcccccacactgatgttgatacactcaaaagtccatctcttgcatcgcatgcatgcatgatcattgatgcatagctgtggctgtccactggttgcagacgatctctatttgatctctcctaagcttaattaattgagcagctaacttttgcagcttctaaacctttatgtgtgttccaacaccaaatgatgcatattcatggtcatgcactaattaacctcagaattgaaggaccgcctatttgtaacttttaagggctataatgctcaaagatggctctgtattactgtatatatgcctccttccacagaagagtgatgtaatttctgtcgcaatattattaataaaattcaataataaaattatagtttgtaaaagaaatttttgaaggaaataataacttatctatatataaaaaatcaccattccaggtgtcaatcaaaatatctacaaagatagttataccaaaagcatattaaactataggtatatcaatttttctgtgaaaaaaaacaaatgcatataaatcacttttcagatgccaatattaatatttacaaagatagttatatccaatgtttacagtttcttttactatagttatctcaatacgtcattgctttctgtgggtgaggtcatatctatcgactttatcagaaggtgaagtatacattaatatatgtgtaatatctccattgatctagtagtacgcatatatatgcatgaaagttaaccaaatctaaaatgtagctagacattaaccttttgggtgatttggatcaattcaagcatgtgtggttaggtgaaactacctagctttgggccttttgcacatttgatatatactccctccatttcaaaatgtttgacaccgttgacttgttagtacgtgtttgaccattcgtcttattcaaaaaatttaagtaattatttattcttttcatatcatttgattcattgttaaatatactttcatgtacacatatagttttacatatttcacaaattattttgaataagacgaacggtcaaacatgtgctaaaaagtcaacggtgtcaaacattttgaaacggagggagtatgtaccctcttgggatctagcagtgcaacgttttgtgagcaaagttaggtttcagctacctagcttattagatgattggcaatggatatggagggagatctcgtcgactaattattgtatggatgatattttggctaacattttcctcgaacttaattactagctcggcctaaaatgtcatggcatgcatgtttgctagcgaattctagagaggaaacaagtcaacaacgttttgcataaggtctactgaattaagataattaagataattaaagacaaacctctactgaatttaggattaattaagaggtactaattcctaagcatgtctgacaaagcaacaaaattcagttaggtactataaattaaaataatcaaatagctagagatgaatatacacttttttttttgcaatggtggtggcaagcatgcatgcttgcttagctatcttaattattagtgccctccaaaagggataaacatgtgtggataattgggcttatggatcttcctttccaacccggctactactgatctcgaccgacctacatgtgtacatatcttgcttaatcaatggagcttttttagcctttagcaactgttgcattatgcatgcttgtgatctccttgattatcttgctgccatccatccatccatccatggccttttgggatatgatgtgcacatgaaaagtttttttgcatcactggctgcatgttcactgttcacatgtgtacacgtacacgcgtgtgtacaaactatatgcgaattgtcaatttgctccttctttattcgtggatccttccatcccattccttcaagagccagtcgctaacgattagcctcatttagagcatgaaattttatcttttattattatagagcaagaatttagtttttttttgtaaaattactgtgaggttctatgttattgtggggtttatgtgaatgagttaagcatttaaaattttttaataataaaaatggttttacatctcctatctctaccaacatgcacaagaaaaaaataaataaaatggttcaaggttatgggatgaattcttatctcccccgataatatccaactgagatatactcgatagaaaacacatttaagcattacattagttataatttatgttagttggtcaatatttatcttcctttttctctacaaataaatttgtagtactgaactcttgatagttgagatatgttgccaagaaagaagaaatggagggagttggaaaagtgaagaaggggagcaagccgccatgatgggggcaagtgtggcgcacaagccggccagaaacaccaacaccacttcagttctcttccctgctttccatgcatggccttgtggcccactcactgacaatgagctcactgcagctagtgacagtccagttgtaacattccggcttagggcttaatagaattaatagaatactcatatcaacaagttacaacttcttttccggaagtcaatcttaaagaactccagggttaagcgtgtttgg

SEQ ID NO: 37587 - DNA, 19545 bp, Oryza sativa
  unsure (1)..(19545): unsure at all n locations
gtatataaagacatgcatggtcagtgctaatctcccacctagcttccacgtacaagcaaagaaacacacgtacacatggccaaaaacgtaatgcgcgtgtcgcaatactagccatgccacaacaactaatagtgctgctgctgctgttccatgctacggcggcgccggcgggtgggcagcgggcggggtgcccgagcaagtgcggcgaggtagacatccccttccctttcggcgtcggcgtcgactgcgccttgccgggcttaaacgtctcatgcaaccatagctttgcccctcccagaccctacatcgccgatgacaatgagttcatcgacgtctcgctggagaccggggagacacgcgtgtacactcccgtgctgcaaaactgcttcgacttgtccaacaccagcagcagctccgacgcaatctggcaggggctcgacctcaccgggacgccgttccttgtgtcgccggagaggaacgagttcaccgccaccggctgcgacgcgctggggctgatatacggcagggaggacgtgagcttcttcaccggctgcgtcacgacgtgcacgagcttgggtaccgccgccaacgacggtgacaactgcacgggactcggttgctgccagctgcagtccatccctggaaaccttaccttactagggatgacgttgacggccaacatcaccgacacgaagatttctgcgtggaacccctgccgttacgcctttataaccgagcgagacaggtacgtatagtaccacctctgttttagaacatattttgtttcgtcagtaaaacatagttttttttatgacgaaaaatgaatatattagattatcaaaagtatttacttattgtatatattataccttattagcacataaatgatatcatcgtagagtaattcttgatcaaagttttgatatatctttaaatgtatttcaatacaatcatatatatttgatatttctatatatatttaatagaaaatctcgtgttcttgtccaaaataataattattttttaatatggagctaggagcttatattttctcatttggtttttacgtctggagacgatcatttggttcctaaaatgatatgcggatatgtttagagaaattctggaaacattaatttgatatgacccttgtaaaatactatcccatattattaaattttgagtttaaaaaactcgacctatatatacattgagggaaaaaaaaaagacaaatctatagcacgaacaacatacaagcaatgttcaacactgtattcgtcttttttaatacattattgtaaaccgagttaatttttttatcatttttttcttattaattactccctccggttctataataattgacgttttggacaaggttgacgtcaaacttttataacttgaccattaataattttaaaaatatttagtttaaagaaactagaacaacatatatagatttgtctttaaaagtactataataaaagtaaacatgcatttatttattgtatatattataatagaaaaataaggtcaaagatatattttgtataccatgtcattgtccaaaacgtcaattaaaatgaaactggagggagtaactaattaacaaaaaatggagttaactaaggttggaacaaatcaacaatgcatgttttccttgatgttctagtattaaaccatatgtagtggattcggtcaacggtgaagttgaggcattcctctattaagggacaaatttttacaatatatcctactacatcatcaaaactcaagcacacacaaaacacaatggtttcagcagcagattcttgagtgcttagggccggatacaatcggtatatagcatcaggaagggagctagctaggaattagcaggaaacatggagaagccgaggttggaggaaaggatgaggaatacagggagggtcaaaggttgaagacgagaggagccagggaggaaaaatatagctactctctttccaatattttgttcgattcctcccattgaagcatctggtggttttatacttttttaccttggactcagtggtgggttcagaaaatttcttgagcataggcaagtctaatgatggatgataaaaggatatataaatccatataactccgtataccatttatcattgatgtaggcaaattgacaatacatagttacttcctccgtttcaggttgtaagacgttttcactttggttaaagtcaaactgttttaagtttgaccaaatttgtaagaaaaaaatatttttaacccaagacaaatttattatgaaaatatatttaattattgattcaatgaaactaatttggtattataaatattactttttccattccaaaatataaggcataaccacccttaatcaaaaaccaaaaaccaattattatcatatcctaattgtatcaccctagtaaatacaatgcatgcacctaataaaattagagatcttaagggtggaggattttaaaaaataataatttattggagaagcagtgctaattaattgcatgcatgcatgtacgccttatattatgggacatctgaaaaaagtagttgtaccttatgttatggaatggatggagtactatatttatctataaacttagtcaagcttgacgcattttgactttgaccaaagtcaaaacgtcttataatatgaaacagggggagtattattttagagaggaaaaccaatgcatatgcagaccataaataatgttctgaaccttaattgctttgctaatttgtttggttaatcttccattcattaggactagcaaaaagtatgtatgtactagtacatgagaggagtgatagagagaaggaagggagagaagaggtgaaagagagagatgatgtggatagtctgacatgtggggcccacgtggggctcacgctgactcagctgccacatcggacaaaaccgggtttaaaacctcctatggacctaaagtgaaccggttttgtgagatgagggatgacatatatctagttttgcggtttggggatgattttgtaatctgatgacaagatgagggaccttctatgtacttttcccttgcagttttggctgcatggatggttgaataggcccatatgtgcagttgtctaggcaggcccatgataggtccatggcgaacaccacctagatcccatgtcccatgtcatcaataatccgctgctatctttgggtcacatacaatacccatcatccactagtatttcccgagaacaagcctgaataaattttacatacgatggctgacaggatgataatttctgaagttttttgtgccattgctgatgttaaaaaccgtgaggaaaaaaaaaatctctttctggtggtgattatacccaagcaatgtgcatggcatccggtagcatgatcataaacttacaaatccaccacgcaccatataaaagtgatttcttgcatatgccacttaacttgatacacccgtattagtaccgcaaaaagtgtcttttttttctgcatttatttcttataagaaatatttagttaattaactaattaacaaatggcccaccaagatatttgttacagaaggcaatcaatatcttcaaaccttaaaaaatatatatccgagtagacatactatttcaatattatgaactagcaatttttgatcatacaattcaggtacaattttaaccggaaggatttcggtcgctcaggcaacaagatatttgcaaaccggggatggcgagatggttgtccctacggtgcttgactgggccatcagggaaatgggtcatgctcggggtcggtagctcctgcctgcgtcagcgagcacagctactgcgccaatgccactaacggagatgggtatctctgtaagtgctccacgggatacgccggcaatccctatctcaaaggcaatggtggatgcacaagttagttcttaaatttcctattttctccatcatggattaatagtgcagttaacgttgtattcattgacaatatggggattattttatttaaatttagtgttttattacaagactgatatatatacacatatgttgcatgcatgtagatattgacgaatgcaaggaaccagatcgttgttctactggcagcagatgccatgacacagagggcggttattactgcaaatgccgttttccacgtagaggggatggtaaaattaatggcaagggatgccaccttcccaaagatatagtcgtgacccttggtaagctagctgatcaagcaagcgttagttaattcctcgtacttactgcatgtagtctgatttgaatcaacggctcgttcgttcaattaattatttgttgtttgatttgatttgtctccaaatatacagcgacggtgtgcattgtgatttttcttgtgttctttgtgtgctggtatgagagacggaagagaagaaggcacttcaacaacaatggtggccggctgctcagtggtatggaaatcaagcacttctcgaagaaagacctagacaagatgacaaagaataggacgacgatgctcggagagggttacttcggcaaggtctacatgggaacccacaagaaccagctggttgccgtcaagtactccaagggaaagcgcaagctggcacagatgacgcatggcaaagacatcaagtgcatgaacaagaaaatgttccaaaacgccttttgttggtccaaagttccatcctcgccggaagaagattcgtcgtcacgagtgtccggcccggagttagtggacgagctaagggtccagtcactgatccagcacgaaaacgtggtcaccctccttgggtgctgcatggagacggaggaacccacgttgatccttgagtttatccctaacgggagcctcgagaaaaagctccacaaagataagcaacaccctctctcgctgtcgcaacgccttgacatcgccatcggctccgcggaggctctctcctacatacattcatcgtctgaccaccaaagcattgttcatggagatgtcaagccagccaacatcctccttgatgacaaactgatccctaaggtctctgactttgggtcagctgagctcacattgaaaatcaagctcgtgtgtggtgacctggactatatcgatcccgtgttcctgcagacccgcaatttcacggtgaagagcgatgtctatagctatggggtagttctcctagagctcatcacccggaaaagggccaagtacgacgatgggagaagcctcccagtagaatttgtgaaacactacaaagacaacaacgaaaggaggaagatgtatgatcaggatatgttgtcgtctatggatgcactactgcagccttactgcacggagtgccttgacaggattgctgccattgcggtccgatgtctcaaaaacaaggtggagaagagaccaaccatggcggaggtggtcgaggagcttaagcagctgagagagcaattaagcacacgtatgtcctagctaaactgctgcaactaatgccgggtgcaggaatccatcagctcgagtgtacgaagatgaatgttcttctttgcctcgtgtcttcagtctctcaattagttggtctctcgtcaatggttttcctttgcctcttgttaatttctccccacccctgcaaatagcagatatagcgtatgctcacattatagtttgagtttgagtacgttgacgcgatatgtactattccaccgtttctcttgttatccgtgtagtgttatgtggtactgtgttgtctcagaaagaaatgttgtggtgctattttttctatctttttactataccttttgtagctgcggtatcttatgtaataatgtaattaacgcaatgttaagctggacatgtatggttgcacccatgttgtgaaataataaatgacctcataggccattctccatgctaatcgaaagcaaacaaatgtattttacaattgtatgtggtctagctcacgaggccacgaacccacatgtaggatagggctactcagccagtagctagggtctcgtaccttacggacacacaaggcatatccagatatattgttttagaataggtctcatttattttatattactatattttaacagagagagtaataaaatggactagtccacgaacccatttatagtatttgatagatcaacctgtttaaatgacttaaatgaccactgacccgccgtaaataagatgtgcacttcactagtcagcccattaattgcatgtgtacaagcaaaccacccttaattactcagctttactggcactccttgctctttgactctcaatctcccagattagatcctatatcattcttcgccaattaaacggaaatcttttcttttgagaggcatttcgcattatgtcaatcttaaaattataaaaggttgaaaagattccggtgtgaaaataaattttagaaggatttatttttaaaattaaaaataaaaatgttttaaaaaaatctgcagactagggggcaaatactgctaaagatgctcggtaccaaactcagttgcataaaactaattttccttataaacatagtacaaacaattaagcgtgggatgggcttttattggttagagactacactcttataacacctaaaacaacaaaggttctaaccattaatataaacaatattcctatatttcttcgtcctattatagtaaaatttcattttatcaaagctatgagtagatttgtacgttaattaagccgatatgttacggcgcttctccatgctatggcggcgggtgggcagcgggcggggtgcccgagcaagtgcggcgaggtggacatccccttccccttcggcgtcggcgtcggctgcgcctgaccgggcttcgacgtcgactgcaaccatagtttagccctcccagaccggagtacgggattaataattagtcaccccatcaacatcaacagcatgcagtagtagtatataaagagatgcatggcaaatgtattcttaaggtagcttttacaatgtatatataaccactactacagaaaacgtcatcgatgtcagttgaaaaaccatcacaggtgccggtttttccaactggcaccatgaaaacgatactttgatctcaggtcaaaggtgccagttcaagaaccggcatctttgaggcgcacacgagcaaaaaaaaaatagcttgaaggattgagccgattccaaataatacccaaatcccaaaatgatgcctcaaatctatgaacacatgaactataataaataatctccagaaaaacaacacatctagatcaaatccaaaacgatcaaacatgaataaatatcaagaataaggaatcacaagagggagggggaagacgcggatccgcaaacaaccgacaccgtcgcacctctagccggcagccccaccgtcggatccgcgctgccgaggggcaaacgccaccaaaccgttggatccggtgctaccgatgagtgggctactgctcgccgccagatctagcgctgtcgaggggagccgccacgctgccgggcacgggccgctgagagcgagagcgagaagataaggccggggagagagagagggtgtggctaaaaatatctctccttccccgtccgactcggcttggtttttgtgataacgatttttttaaagaaaaaacagcacccataatatattaaagtaactatgaagtcacagtattctatagcaaaatttatcttataattttgaatgtgaatgtgtttctgagtgtggatgtggataccagctattaaatgtgtgaacgcattttttatcagttggtgcagtgaagcgcattttgatttctttttctattacacattattcggttgccatttaacagaaaaatctttcataacgattttgctatatatttgtcgacaaatttttccccaaaaatttgacagatgtaattacagtacaatcgtagtgtaattacactgtaacttgtatgtaattacactgtaactatagtgtaacttgtatgtaactttcaaaaatctctccgtaacatgttatttcagtaaaatggaggtcatgagaacaaattctttcatatatgtgtgtgctatgatttgttttcttcctcaccaaaacaaatctagtaatagatctaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggcagtcctttttataaagctacccatttaaaccgaaccgattaaacagtaaaatccatacgcccacccctacttaatactccatccatcctattttaagtgcaaccatgagtttctgtgttcaactttgatcatccgtcttatttgaattttttaaattaatatgtttattgttattagatgataaaacatgaatagtaccttatgtgtgacatgtttttttaatttttttttaaaaaatcaaataagacgaatgtttaaagttagacacgaaaacttatggctgcacttaaaatgggacagagggagtacctaaattttggtttcgccactgttaggagtgatgtccactcaactactccctccgtccctaaatataagggattttagtttaatgtgatacatcctagtacaacgaattcgggcattaaccaaaatcttttatatttagggacggagggagtacacgtaatcaagtgtgtccttgcccatctgttttgtgtaccctcctagccaaggaaatgtacacgtcaactagtcaagtcttgatagacacaggatggccactgtttgtttcgttgcttgatagcgagtgctttgcttgcttttggaaactacctagcaatcactacagtagatttggtcttttatgatggatttcatgtgacgaacagaaaatccgtcattgatctacaacgagttttcaaaaagttatcctaaagtacgttcactctcagccttgtaataacgagttaaaagtcttggtcataaaaattagtgatggcaacaaacggatcgagtcatcacaaacactgcaaaatccatcattatgaagttcggatgaagtatattctgtcatgaatttggtaggcaggattctcatggacccacacagctacctgcaggtctcattgtaagtatgagattgaatggaaaaattcattatagaataggcctacagttttataaactagttgataggcaacaatagtatttaggagatcccaaatttaagtatgccaaaacttaaaggaggcattttgtctggtgtttagtttgactgtggctgtgtttagttggatccaaagtttggattttggttgaaattggagatgatgtgactgaaaagttgtgtgtgtataacaggttgatgtgatgaaaaaggactgaagtttggatccaaattttggatctaaacacagactgtgtttgtttgttcggttttagttcggttgtgtgtgtttgtccatcatttgtttatccaaatcagtgtgcgtatgtatatcctgatattggataattaaatccaccaatttattatttttattatattattatgtcaaattttaattaattcatattgtgttctatatggactttttaatttgaatttcatatattttgaattgtagcttacttagactcctttctttttctccaactaatgttaaaatttctagtctgtgggagtaaacatatatttttgcttcatttgaaaagtgcttcctgtgtttgtgtagatactgtagatcctcccaacttacgttttgtcgactacagataattctagttctcttctttcgtgtgtatcttttaatccgatcgatttgcactacctacgcatatctacatcaatgtgagcgcttaacttcagtgtgaaaccttgcttcctagctgtgtacatcttcagttcttcttttcccttacgacgcggatatgcctggctttgtacgtcccattatataggatccacaagtccatatctatactgtcagtacatcacaaagtgtgaacatccaggtatagataaacttaattaataattattccttatcatggcaatgctctttctcagctatggccatccgtttcgatcgattgtaccttccaaattaaaaagccaacgtcacaaagagtcaagtcaatatccgtatatatacgtgtcacataagtaagaacggattaatttagtttttactcgttgatgttacagagtctttatattttcagccctttgcaaattcacccagcaatcctcgaccatataatacctcaacaacgttggcttgttttgatcttgcccttccaaacaagccaacgttacaagagtcaagtcaatgtccgtatgtacgtgtccacattagtaaagtggactaatttagcttttactacatctaccgagtctttatattttcagtatatgcaaattcacccaataatactcaactatatatgcatcaacaacattggcttgtttcgatctttcccatagaaacaagccaatgttacaagagtcaaggcaatgtccgtatgcacacgtgacacattagtaagaacggactaatttagcttttacttgttgacgttacaaaatctttatattttcaactatatgtaaattcacccagcaatcctcaaccgtataatacctcaacaatgttggtttgtttcgatcgtgcacttcgaaacaagccaacattacaagagtcaagtcaatgttcgtatgtacatgtatcacattagtaagaacatactaatttggcttttactccttgacgttacaaagtctttatattttcagctatatgtaaattcaaccagcaatcctcaactgtgtaatacctcaagaatgtctagtcaatttacaagttcagttctaaattcttttaatttgtgtacaaaactttcaaattttttaccaattttctattataactaggaaggcaacctgcacaaattcgcagccacgtatattaaggttagtttgggagacttaattatactatcaactggattttttgttttcattctttaaaattaagatttgtgtaaaatactttcttaatcggtacttgtttaagtaactttttccaagctatttgttagatgtatactatgcatataattcattttgtaagcaattatgtatgatccacttcatcatccgaaataaaggtagacttactttgtttcaaaaataggtaaatgtaaattaaaagtaagatgttttcccctttttcatagaatgttttggggatctatctttttttttaaagaaatctcaaaacactatcattgctaatatttatgttttattgcaacatcaagttatttctccctaattctttcatattatcgtaatttgaaatatactcacgtgtaaatcaaaaaagaataagagatatgcatatctagaccctacttcctacgatacgtgagacccatattattttttaagaaaaacataattaacatcaagtttaatatgacttttcaaccaattatatattgttatataagtgacctatatgcaagatgtggagaaactcatatgccgttgtacatatatgatagagggaaaacctttagcatctataagcacttaaaaatgatgcaatggttatagttacgggtgttctaatttttatggaaaggaaaactaaatttttctgagactataagatctttttggaattggttcactttgcttcctattggtattttctattttattttacataagttaacatgttcaaattttgtgctggaagcaaacaaattaagcaacaaatttatgaattcaccacgtattccctccatccaaaaaaattaattatataatatttcctagctagtacaataaatccggagaaatttatccagattcgttatactagctccaatactagaattattttatgttggacagagaaagtatatatcaactatagttagagcccacgtgtctaaaataaaatatgcccattattaatcgtcttaattggacgaatttttgctaaggcaattcccaacccaatgactaggatggtgtccatagtattaaataagctgccacctaggatgaaaaatgatgtggcaagtgaaaccatgtcctgcatgagacatggtttctacacaatatctaagatattatgtgagataagtagcactaaatttaagtatgtaatagtggtgtttgtattggaagagatagtgtctattactagtttcttgatgatgtggagtttataaaaaccatgtctagtgtcttgggttgggaatagcctaataggccgataagtcagactagccggctgaatgcgttcgccggataaaaaactgtccctgaactacatatgcgtgctgttctcgttatgcatgcactactacaaatatcatttttgcatgtggccaaaagtgatcatttgcgcatgcggacgggtgccctgcatgcacctagttgtctgcgaaaatcggattcgaaaccgtagtctcggaaccctaatccagaagccactgccggccatcatcgttgcacctcccgccatcgccatcgtcgcccctcccaccgccgccaccgtcgtccccgcagtcgtcagcaacggatccgcttgctcgagcccggcggtggtgcatccggccttcgtcaatgccgccgacgttgctctcgccgccgccactgtcatcgttgttgtccgtcctgctgtcgtcgccgcggttgtcggcaacggatctgctcgcttgagtctggcggttgcagacccggccctcgtcgatgccatcgatgctcctgccaccgtcgttgccaggaaactgttgctgccctcgctgatgccaccattgtccgagactaccgtcgccctcgtcgacaacgccgatgccgctctggctgtcacctaagattgccgccgccgtcgccaggattgggtaggtgtgggaggtgaggagttgggtagatggggagagggagtttgaggcgatgagagaagtaagtagaggaggagagggagtgggaggattgagtgggtagtggggagaaaaaaatagagtggggagaaaagagggagagatgccagtgtgggagagagaagctcgcatgtggctaatttcacatgttggtcacttaacaggcccatgaaccgatcatagggaagcgatttttgcagagtacagtagttatagcctgtttgcaatctaaagaggtttgatcagaaaaattaattatgtagtagtgatgcataccttttttgttttttatccaaggagtaaaataatagaccatcgatttaaatagagattgttgtttcagaatttataggttttttctctaatttatgttttggacagaatgatttttcatcgattttgattcagactcatctgaaacatcatcatccaacccaagaaatttcaggaattccagatgccgatccaaaaatcgagtacatctgccgccgtttcccaattcacataggtatggtcgaactattctactgtgtgatctccttagtgatctatttaagattttctcgatcttttatatgatttgtctggacttttaagtgatgaattactgggggatcatttctctatttaatgaactgttcggtgtccgttgaacgtacatgtttcaacctagctatttaagaaattaccgattactgattttgactgaaataatgaaatagctgttgatctttaacatgttgatgagccgtgctagtaatccggtaatcaggttcagttgacaaatcatagacccttatctatgacttttctctaaatctaaatataaacaagcaaatataatatttaattttccatatttcctgtttgtatgtccgtatacacatcatatagtctgcagcttaccttttcttttaccaatgacatggttcaagatgttgacaatgcgaaggaagcgtccaaagtcaaggtcaggataatcagactttgggatggcataaatcccaacagacgtgatatttattaataaaaggtcggtataaatattccccttgcaaataatgttggtatttatgggtatccccagagagcgctcacatttactataaacgttaactaaaagatctgtagtttattaggtcaatcgtattaccatgaccattgatcaatcaaagaatttgtgttaaaaccaagattaattgtgcacttctgggatgctcgctcattaggcagagagatcttaccacagttgattaggtggttcgcattcctatgatattcgatctatatatatgaattcgtgtaaattaaaatatgccacaaaaagtaacatgggctctttagttttatttttacaaaattaataattctgaaatcagacatcatagtgatcacagagtttcacctttcttgactcccaatttagaaatttgttaatttaatttcattttttaaattcataattagtaagttgtaacttatgtgaactccaaaccatacatctaaaatgtattatttaaaagtaacttagcacaaaacggaagtaagttattacaacattagaagtaaattcattgtagagagaaaaatatggtttatctaaaaattaaatttaaatttcacaaattatagaattgactaaaaaatataaaaataatcaacttatagcattatgaatgcataagaagtaatttaatcaaatctaaaagtaatttatatatatgtgataaaagtaacttatatatttaataaaagtaatttacaaacataaatatttttctaccataatataatcatgtaagatattgttgtaaagttttaattgcaacaaacacaattatgtaatcggattgtaaatcgaataagtaatttgtaagaaaactttataagaaggttaaaaaaacgtgcatgccaaatagcaaaaaaaagaagacctgcatgtgtattgtacttctctcacatatgagtgccgctagttaagtctaaatcaagaggcttctcaaattagattttgcgtattaataattagtcaccccatgcatcaacatcaacagcagtagtagtatataaagagatgcatggcaaatgcaaatctcgcacattcaagcaacaccatagctagcggccatggcacaaggagtgatgctgtggtatgacctccatgctctggctgcagccgtggcactactagtttcgtctgtgctggtcggtacgtcgacggcggtgaactgcggcaggaagtgcggcgaggtgcgcatcccctacccgttcggcatcggcgtcgactgcgcctggccgggcttcgacctctcatgcaaccatagctttaccccacccaggccgtacacggggaacgtagagatcaaggacatctcgctggaggcaggggagatacgcctgtacacccacgtcgtgtccaactgctatacttcgtacaataccaccgaatacgaaagcacctcctcgcaggacgacctccgcgatacgccgttcctgtttgcgcggagcaggaacgagttcacggccatcggctgtggcgcgattgcgtttctatggggcagggacgatgcgagctactcgaccggctgcatcacaacgtgtgcgagcttggatgaggccgcccacgacggtgacgactgcaccgggctgggttgctgccaggtgccctctatcccgcccaaccttgacatcttaaacatttccttcgaccccggaagcctcatcggcaaccctgcttggagagagagcccatgtagctacgccttcgtggccgaaaaacactggtacgtacccgttaatgcgtacactatacatggtcttaaattatgtccaatttaattcctgattgctacatatatatatatatatatatatatatatatatatatatatatatatatatatatatatatatatatatatatatatatatatatatatatatatattcattcactgagtttactgatgcatatatgtacatgatttaggtacaatttcagccggcatgatttcagtcatgccggcagcaagagcttcgtcaaccgtactggagatagaagtgtccctacagtgcttgactgggccatcaggggaaatggatcgtgctcatcagcaacaggggctcctgcctgtgtcagcgcccacagctactgtgtaaacgctaccaacggcaaggggtacctctgcaactgttccgcagggtactccggcaatccgtatgtcaccggcggatgcataagtcagtccttaattaattatatattctctccgtcccaaattatagagcaccctcaatcaaactcgatagcttttaactaataataatactaccttcatattttaatgtatgacaccattgactttttatccaacgtttaaccattcgtcttattcaaaaaaaaatgcaattatcatttattttactgtgacttgattcatcatcaaatgttctttaagcattatataaatactttcatatttgcacgaaaattttgaataaaatgaatggtcaaacactggtcgaaaagtcaacggcgtcatacattaaaatacggagggagtatatactaaccatatttgctaagtattatgcatattatatcattcatattttaaagtactccatgttatgctaaatttatattcgttgggaacataaaatgaaataaattaatgatcaaagtatgtcattgaaaactgtgtaaaaaatataggtcttgtaatttggagtggagggagtatactactttctttattttatattataaatcgtttttttatagtcaaactttttaggttttacaaagtttatacaaaaattaacatttataacactaaatattaatttcacttaatataacattgaatatattacataatatatttgttttgtgttaaaaatatgtcatatttttctatagaccttattaaatttaaaaaatttgactacgaaaaagttaaaacaacttataatatgaaatgaagagagtagtagttgttaatctacacttcgctcatggtgttgcatatattcgatcgaataactgataatttattatttgaaacaaaaattcatagccttttgcatctaatagtgtcaattcctgaattaataagtataacgcttaactcaccttggaatataatattttcatgatttaatcattctgaaatttggaattaatttatccgttttttatggcatgcatatagctaatatagggtatctagctagtattcttgttattgatttggcatcatcatttacaagctagccagttatttttttaaataatggaatatagtatccaaccattgtgtgcagatattaatgagtgcgagcttaggagagaagggcctgccatgtatccctgttacagtggtagcagatgctatgacacagagggtggttacaagtgcaaatgccgatttctacatagaggagatggcaaaatcgacaagggatgcaaaccgataattccagcgaccgtagtcgcaacaataggtcagcatttttttttctttattcccaccatcttaaaatgctgtggatcgtcgtttcttccgtgctttcaattctatgcattcatgcataacatgccatgcactaattaagtcctaagtcttattcccctgatttatatcctccgacagaaaagaaagatcatgtttgactattttatgataatatttgagatgagattntgaaataacatagttttggctagcatttctttttatataatatatacaacatggacaaatatattgaactaccataaaaagcattctacacatatttttgaagtaggcttgaacttatgcggaggagacggggggaggacagaaaaaaaataaactacagatttgttagctgaagcacgagctttaataaactgtgcaacagttagctgagctctgtgcaacagttagctgagcacgagctttaataaactgtatgtgagagagatgtgctcgatattaatgatgtagtataaatctacagctaactattgcatgaccgagctatttgttcggttgtagatgatatgataattgttgaagctagcagttgattatattattgtacttgctctaacagtaagtccataaatttccatattttttatgccaagaggcaaaacagaccttttttttcttttagaaattgaacatgcattcaactaatggaatattgaggatgcaagggacaaaccaaaatccggggacattttctttagttaattttttggacaatttgcaaatttaccactgctttgaatcgttattgtaagatcgccactagaaaattataaaaataccacttaaactgtcattcgagtggcatccttgtaaaattgaaaaaaccagtggcaaatttgtaaatgaccccttttttcgcggggggcacaggagagattggcttaattaatgtttggagcagcagtggaagtttatcttttaagtatatgttgtacatatgcatataaaaaaattatagtctcttctatcctaatatatagtcatctaggactggatgagacacatcctaatataacgaatctggatgaacccctataaatatttgttgtactaagatgtgtccatccagttatagattgctatatatacggacggaaggagtatatccaatgtcataataaatgctttctcagtatcacaattaattacataaatttttaatccatagaaaagaattaagcattcaaagttagtaccctgttgaccccaaaagttgaaatcaaccaggcccatcgtttggcatatgagagaaaaatgcgaaacaacatatttacaaatgaaaaaataatttatgaatacagctttttatatatgtgttcttaacgacctaaaagcaaactgaaaaaaaaatcccaaaatcaactccacatttaaagttaaaaattaaaattttgactgacaagtataattaagcgaaatgatgaggctgaacatttgaacgggcttaattgactgtcgaggtttcaaaagtttgattggatcttattgaaaacatcatttatgtgtattttactggaagaaataccaaaatggttcatttaattatttaaattgttaattgccagcaactgctgtcgccggaggtattctggcattcgtggtgctgtacattctcaaggagcatcggaggcggcagcaaaatagatcattcgacaaaaatggtggcaacatactgaacaagatgatggacatcaaaatcttcagcgaagaggagctgaagaagatgacaaaaaactactgtgagaaaagaagattgggaaaggctacttcggtgaggtttacaaggggatcacccaggacaaccagcaggttgctgtgaagcgctttgtcagaaacggtgaggagcatgacaaacaggatttcgcggatgagatcacgagccaggctcggatccaacatgagaatttggtccgtcttgtcgggtgctgtctgcatacggatgtgcccatgctggttctggagttcatccccag

SEQ ID NO: 37588 - DNA, 46038 bp, Oryza sativa
gtcaacggtgccaaatattttaaaacggagggagtattaattaatatagataccaaaataacatataatatgtgcttcagcatgagatatgtacatgttattttactatagggattactcatcttaatttgattttatatctaactatccatttaagtttgattaacttttaatactagaaaatggggtaatttacaaaattattatgggagtaggtatggtgggtagattcacttttaagtgacaaatggcgacgagggagaagatcaacttgcactagtaaaagacgacgaccgggacttactaagctagctgattccttggaggtccttataactaatggtggccggtgcatcgatcgaagaacgtatatatttgatactactgtactatcatatataagaaccaattttataattgtattttgtttttattttgaatatcaaataattatgcatcatcagtgagtgttacataactcttcgctgtattattatttattctattccaaaaaatttagtgatatagcgatttatgtttggaattcatatataaaccagtttctatatttctaaatttaattaatcatgtaatatgaactattgtttttattattagtttgcttcacccgaaataaaagagaggaagagtttggcttgccatgttagtaaattaaaggaatgattttatctcacctcaaaaccggaaatgctaatgcgcgggtgatcgccccgcgctggccccagcgatcacccgcgctggcccttccccctatagtccttcctcttctctcccttcctcctctcccttcttctctccccttcttctcttcctactacaatacaccacaaaaaaattttaaaaaaacaaaagatagaaaaatttatgtatagaaatactatatataaaaagtttgaattcaaattcaaatttgaatcgggtatgtaaacttttgacttataaactttgggtctataaactttaggtgtataaactttaaatgtatagaaatactatatatatagaaaatatttgaattcaaattcaaatttgaattggatataattcaaattcaaatttgaatcgggtatgtaaacttttgacttataaactttaggcctataaacttttaggtgtatagaaatactatatatagaaaatatttgaattcaaattcaaatttgaatcagatataattcaaattcaaatttgaaacgggtatataagctttaggtctataaactttaggtgtataaactttagatgtatagaaatactatatataaaaaatatttgaattcaaattcaaatttgaatcggatatataaacttttggtctctaaactttagatgtgtaaacttgagatgtataaactttaggtgcataaatttactaaaataggaaagtaatgcagcgccaaaaaaggaaatcaggtggagggagggagggggaggaggattgatcattacccccgtccctaggcgatcgatcgcccattcgggtccccccccccctcaaaactgccaacatgtgcagcttctagatcaatctattcatgcacagccaattaaactgagggatcttaaggtagcatgcggaggaacaccgcgctttcgttcctcatttgggccatggccatggcgatgttcatggctaccctccttccacaaagttaaaatgatcactaatctcacatacatgcattcttcttttcatttcattattgaaagtgaaaaggcatgtagcctaatggttgcagtgacctgagtagcatcccaagattctgagtttaaattttcataggagcgaatttgagattgggttatttgagggccagaggctggataaaaaaaacccttctctaaaagaaaattcattattgagaatttaatggatttgaccttattccaactatgagcagcgatcattaattggtatatatgagaagtgggttcacatcctttaccataatgacataccattacagacactacatgtgaggcaatagaaagcacgtgactgtaatgacagtgatattatattatatatggtaaaggatctcacccatgaaaagtactagagtatctgcccatgctgccccatagggagtaacaataatggtcttaccgttttggttttcagctaaagcatactgtgagtgccttcagtgcgcagacgtcgacacacacctgattgctttacctgctgttcaacagaatatccttaaatcccttgtgttaatatataatatgagccatatattggttcctaatattattcgtggaggtctatccaaatagatccatcatttcccatcgtatgttgtaatctcagaatacctatattgtctttctttcttgatggtggaattaatgaactaataaataaagttgtatgtgcattgtccaattaattattatttttagaaacaagtacaaacgcagacgctcacaacacgtgtgtactcatccctataaatacgcgcacacacatcctacccaaggccggtcctaacattttaagagcctagggtgagacaaaaattagggccctaaatagctacattaaattcattttagtagcttgtatgcatgtggtctttatctatgtgcaacgcaacatgcacatctcttctccattcctcttggttatacacatgtaacaatttaatatgctttgcaaaattatttctttgaaattatccatccaatatgtgatctaattatactgttatatttattataattaaatctttacaataagatatcacatgatgtatacatgtttcattcattttgattcgatgtttcaaacgtaaaagtaaaatgtttcaactggtcttctactatgttgcgcatatcttttgtatacatataatggatcatttctaatgttgcatatggtattatttgaatgtttcaataagtgttttacgatgtttcagtagttcatttgcaaatgttgtattgtgttctttcgatgtttcaataaatactttgcgctgtttcaatagttataaattgatgtttcataagctatataaatatgtttcaattaaagttataacaacaaatatatttttttcatctgaaatatggtcatgtgagatcttgttgtgaaaatttaattgtaacaaataaaatggtgcaatcgattcacagattgcataagtagtttacaagaaaacatgttttaaaagtttgataaaaaaactttacatgtactgttaagtgtgtgtgcgaaaggatgagagcatgtgcggtacgtgctctgatcagagagagataggattagagaaaatcatgcatgtgagtagctaatggagagaaaaggaagattgtccgacttttatctaaatgatcggggtcaggagatatatgccaccgggagataaattagtactccactgaaaactggtcaaattaattattacgtggtcagctttatcagtccagtgcatttgatgcttagtacttcctccttcccaaattgatcatcatacaatggaatttaaaatttctcaaattgatcatcgtagtataaccgcatggacatgatttcatcagaatacaattaatgtagcatgggagaatatgtgtatgctaaggtgtaattggtattgtgtttttaatcgatgcatgtattgtgggagaatatgtgcatggtgtcttgattgatattatttaaattatccttggtcttggtgcataaacttatacgatgattaatttgtaaatgagggagtagtataccttttcttttgtggcgagaaagattttgtacaattgatcagattctaataaattgcttgaacgacgagccaacaagactagctagggtcattttctctatccacaattgcttcactataatgctccgattttgttttgaaatccataaatttttttgagatagttttttttaataataatggataggaatatcaaagcaaatccctactttcaatagatgatttttcacaatttgacccatttctgtgcttccatatcatggtaaagctgacgacagactgtaattcttacctcccagattatggttgacctacattaatctgaaaacataatcgagccgcctcaaacccactaggaaagcacaaacattatcacgtggtttgtctgatagaaaatactaaaattgggccattttttgtgggtgtaacaaaaactaaaatatgcatcaccaactaaattattccattaattgattatatatgtacagaccgacacagtttgttccaattggaccgtatatttaacagattaacagtcacatgtacagcccattcacatccaaagctaatggtcaagacactgcagcaactgtgtcgaccaacctctctcccaaattggattaattacagtaattaactaactaattaattaaccatgcatcccgttgcaccctcaaatcaattgtaatctacgtttacattaattactatatcctttgaatcaaagactacccaaatgcacatgcatatatgtacaagagatcgatccaaatcacacaccaactaattaattaatatacttagttaagcccataagatatttcatacactaatagaactacctccaagcttaactagctagctttgctaataatatcaagcaaattggtactatgcatggctttgcacggtcagtacagatatataggttagctatttcttgtgtggcttgcttcgattaatttgatggttaattaatttataagcatcccacatatatattgctctcttcgaggatcacatgtacaaatcagttaattatctattactcctaaatatatttcgaaaatgcttatattttgaaacgaaagaaataccacgaaaaataagatgttgtattgtgcttaactattgatgttcttgactccccttaatatttttaacccctagctacccattagatccttctccacagttaattagtaacaactgcttataattaattaatatatgtatgtgcttcctacttcaattaactatatattgaagtacgtactacttgctgaaaattaattaagtatagcaaatttaactcagcatatggtaatttacaatatgttgtagtaaacgttttccacaagttgaggtgatagatggtcttgagtcttgactatccatctatagacttgtacattgttgatcaaattctaggagatgccaagtacacatttgcgtcgatccaacggtgcagatcgattatgtttgtcagttgacagagatcccagccgtccagaaaagctgtgcgggtgaaaagcttccacgtatgctagtcaacgcccgtgtgggccccacattgtcagggggacaaaatactgtacaattaatactaggtcatcgttgacaagtgcttggcttatgtcagcagctgacgccgtagagcagagaaaacgcaacgcatccgagatccactcgtgtatacatataatccttattgcgtctttgattaattcgacaattaaaccggaggagtagaatcttatttactcgcatactgaaagtattagtatggtatatgaaagcataatgaactttcataccaaaatgctattaattactctctccatcctaaaaaaaagtccaattctagagatgaacatatgtccatattcatctctagaattgaacttttttgggacggagagagtagtagattaatcataccaacgatatctcgaaaaatattatattatattttctccggtttttaatgtttaaagctgttgatttttaggactttggacgcacgtttcaccatgtgtcttattaaaaacttacataattattatttattttttttaatttgttttatcatcatgtgtactttaaatatgacttataattttatattttttttacatatttattgtaaaaacgaatcttgaattaaacaaattgtcaaacatatataaaaaagttaacggcatcaaacattaaaaacctatagagtatctttacgagtaaatagttaaattaagaagtcgaacacctcattttctttttcaaccgaactcatcttcaaattaataaaggttgacatatctcaaattgaaatatttttctttaattttagctagttgtcttttgaacttttgtacattagcaatgcaattaatgctaatattcgtctgctacaatttaaggtgactgtctccactaagcacaccatctagtctactataatgcatatgtttgacctaatgcaaggatcgatgggatgcatgtagagccaaatatgaccaattaattaagaacgttttcgttgagcctatatttgtaccttctattcttaattattagcagatgtagtatagacaacatgcatgcatctatatatgtagctgataataagacaagcatatggttcaaactgttgggttttggtaacatcaactattagttgactaatgttttactacggtaaccgtgacgtacgaacagtacatgcatgcttaatgggtaagcttcaaattaaataaacttaactgtgggtctcgcaaaccagcttagtttgatgtggttgtgaattttctatctatcagggttcaaaccctgcagatatacccaactaatacatatttgatgcactttcactgagaatttaaaggttgacacagattcatcactttagttgtgtggttaattatgccacgaatttaaattaaagtactctatgaaaaaagggattaggattaattgtgcatgcgtggggtgtgtatatgtatttgtctttaatgtaattgcaaaaggaaaaggcttagctaagtactatctctgtttttaaatagatgatatcctaaaatgtgggcagtcaaacttcgaaactttagatgattaattaatataaataatggaggtatatatggtatgctgttgtttttcatccataaattagtttttatcctctcctaacttaattagcttttaaattaataatcgagtgcatgccctccacacaaaatgaaaaaaagaaagaaagaaagaatcaagtgctcaaaatggcatgttcttctctgcaaactaagctaatcattctactactagtactctacatagctatatattcagtatataaataatttgctagtagaatgtaacaaacctgcaacaacttgtgattcgtatactaaatatagtacgcaggatgcagggcgtaatgaacacgtcttgtttttaactgtgtaagtatgcatgcatgtgcttaattaagcagtaaacatgtgcttatcatcaagccaaccaagcagaatctgaccctagttaggggtctataagatgcttaattatagcactagtgtgtggcccaaggtataagtataagtaattaacccccactaacctaagattctgtctgttaattatacatatatccctgtcattacttgtagctagcactactgacagactgacagacattgatcgacattaacacagatcgatcacacactgcaaatttactccattctcactcgcagagagatgatcggatcaccggatcgaggtgtcattttgactatttatatactccctccgtttctaaatatttcacgccattgattttttagcatatatttgaccgtttgtcttattcaaaaacttttgtgaaacatgtaaaactatatgtatacatataagtatatttaacaatgaatcaaatgataagaaaaaaattaataattatttaaattttttaaataagacgaacggtcaaacatattttaaaaagtcaacagcaccaaatatttaaaaacggaggaagtatatatcatatactaattaattacgacgacgaagaacagtagtgctagtacttgtgcgtcatcgattaagggtttagaatttataaattaaccatttggagttgtaaattgaactgaagattaaatgcgtggaggaatgcatggtccagaatttattcaacttggagaacttatttattatacatctggttctgatcttagccgtcactcatacaattggatattcaattcagtgtgcgctaagttgatgcgccttactttgttgtaggatatgtggatgaatacatattatacattatagaaatggtaagtgtatatgtttaaatgatgtggagataatgattttacattgctatgcatattgagttatatatatatatatatatatatatatattattactccctccgtccaaaaaagacgaatgtagaactagtacaacgaatatggataaaggcatgtccagttcattatactaggttggtactttatgggacggaggaagtactcttttacttcaataaaattaaatatgtaattatctatatattataataaaaaattatactggaaaatatatatttgaaaaaccatgttacataatcagtgggagtactacctctagccactaatatattacgctttaatcaagtatttgttgcctaccattttttcccgagcgacgtactcctttgtcaaaaaaaaaaaaaagccaactccatatctagatacatagctagcagttagttagcttttttcaaacggatgaagtatatataacaaaagttttcatgagctgaatttgctagttatgagcataatatcaatattttatctgattgacttggtaggtagatatattcgtctattaacaattgttggtttatttttgttttagtattttgagtgtttctaagcaattggccaattcgaatatagggaatgttttggcaaaaattccgaatgtttgctagaacttgggacgaaatatttctttttcgaatggtaattaaggcaattgccaacgttttatataaacaataaggtatctcatttttaggagaaacgagatcaaaccttataatgcaaggttaattagaaaaaactgaacaaaacccacaattacaataacactccaactacataagctatgatgatggcgaaaacaggacagccaagctcaacactcaacaaacaccatccacatgaacaagcaacaagctagaaaaaaaagactcccatacactagccaagacgtgacgttatcatcatcacactagcgcctacgcggctagacaactccaactttgttaagaaacataagggttacgacaacaagctagcccgcacaaaatgttaacctaattcaacgaggctcatgtcatcattgccacgcatcacgccccgtagacaccgcagctccgacttcatgagcaccggtctccttaatacatggctgagctagactgaccgaccttgcagctcaaaatgcttgctactccacactacgcgactggcgatgtttaactttggtcatcgttccaaaatgaaaagaagtctttcctctttcagttatagcctgactctgaactctctctctcaactacaattttgcaggcatatgcatatatttcaagagtgcacaaaagtacatctccttcataaattaagttacattacgatttaaaaaaaaattgaatattagggaagaacctataatttcaaataattagaaggggtctagcccaccaccttgtgaagctagctggaaatcccctgagcgtttctcagttacgttgtgatttattcatgatataccagaactaaaagatcgttatcgatacttgttacaagaggaaactaaacgacaatagcacaatgctgcagctctacaagcataacaggacaacccggcggaagcaacaaacgtcacatctgcaagatcgacggagaaaacaatagcgagaaggacgaatccatatatcgatggactaccaaccgagtctgaagagaccaggcttggttcatcttctacaccatcagttcgttgcttgctctcaattgcttaagctcctccagcacctctgccatggtgggcctctcatccacgtcatctttgagacaccggactgcgatggccgccatcgtgtcgaggcattcaatgcactgatcaggctgaaggctgtgggcatcagtatgcagcatgtcctggtcatacatctccctccttgcattgttgtccgtgtgacagttgacaaaatctgactgaacgtttctcccgtcatacttggcctttttccgagtaatgagttctatgagtacgatcccaaagctgtaaacatcgcttttctgtgtgacaatgttagttttcatgcacacaggatcgatgtagttcttgtcggcacatacttccttggttgcaaggcctaacttggaggacccaaagtcagagaccttaggcacgagatccttaccaagaaggatgttggctggcttgacatctccatgaataatgctttggagaccaagagaatgcatgtaggcaagagcagccgcggagccgatggcaatgtcgaggcgttctggcagcgagagagcccacaggtcaggtccatgaagcacggtctcgaggctcccattggggatgaactcgaagaccagcatggggacctccgtctccatgcagcacccgatgagacggaccacgttgtcgtgccgcatctgtgactggacaatgatctcattcacggacgctttttggccgagcgtaccatcgccattggaactaatggattttctaaaggccatctctttcacgaactcgtatttgcctcgtctaatactgctcttcgcggtggagtatttgacggcgacctcctggtcatcgtggagtcccttatagacctcaccgaaggtgcccttcccgatcttggttctcttcttgtttgttatcgtgtcaagctgctcctgcgtgaaggtggtaacgcccatatccttcagtagttggccaccgttactttcgaagaaccccctctgctcccatgccttgtgctcacaacgaatgaaccacgcaaggcccaaaagagcaaccatggcgcataccgttgctgcatgatcaatatatgtatataattaattaaggattctgtgggttcatctattggacccataaatagatactgcttgaataatccatatgtaaaattagcaattaatcaaaattcatgtacatatgggcggccacaattaagtatactagctactaggtagtactagtagtaataattaatcaagaatcaacggcgtcgatcggctcacctagtgtggcgactatacgtaagggaattatgggcttgcatcccttgccagtaccgtctcctctatggggaaatcggcatatgcacttgtaaccgccatctgtgttctggcatctgctaccattgtaacatggatagagttggccgtatatagaagactttgtcctgagatggcactcgtcaatatctgcacacatatatatagtggtgataaacaatccaaataattaagctaccaatccggtcgcgcttacgtacgcgagcaacttcaaacattaagctataccatactcgctagctatcgacgacgtaccacaccactactggagaagcggtttttactcccgatttataaccatttttattcgtggttatagcaaccgggacgagcaaatcacgtaccaccgcagctggagaaactgtttttacttccggtttacaaccatttttactccattgcgggagaaacggtttttacttccggtttacaaccatttttactcccggttataacaaccggcgcgagcaaatcggaagatggagaaacggtttttactcccggttataacaacctttacaaccatttttactcccgttataacaaccgagatgagtaaatcaggagatctttagtcccccggttataacaactgagtcgagcaaatcgggagatctttagtcctggtattatctttagtggagatctttagtcccacttgagaaccggtactaaaattgcatagcaaatgagaaatataagtgggatgtgagattcgaacttaagatctctcaccttagcctccatatgcataacctttccacctactacatacatcttacttgaatagatatctttagtcccagatagtaacaccaaccagaactaaagatcctcaatctttagtccaggttggtgttaccaattgggactaaagatcaatgtttagtcacggttggtttataccaacccggactaaaaatgttttgagggacttggagtatctttaataccggttctttaacctaacatggataattgtgattttaggtaccatgaaaaaagatcagttatccacttgtgcacatactagataggatatatcttcatgcatgccaacttagagaagaatacagttagctagtcagtaatctgcagtatataattaattaacaactaacctatgcatccgccattgcctttgagatagggattgccgtcgtatccctcggagcacttgcagatatacccctctccgttattcctattgttgcagtggctgtggtcgctgacgcaggcaggagctaccgaccccgagcatgacccgttttccctgatggcccagtcaagcaccatggggactctcttgtggccatcccggttcacaaatctcttactgccagcatgaccgaaatcttcccgtctaaaattgtacctgaattgcatatatatcaacaacaggtttaaagtttctctatccagtacacggtatatattgtgtggatattaatttgacccagaaggatattcatatatatcttgataggccattctttaattaaattgatcaaattaatgtgccggaatttgatgacatatgctttatatatatatatatatatatacctaattaaaaaatacgtaaggtttccggaggtatttttcgtccgtcattaccatgcgcttcgctaaaatccagatttaatccggttaacagccggattgggcttttcttatctactccaaaaccgcgtctgatacgatatatacacatttcatgtaattgcctcacatgtgtagtagtctgcccacttggttaaaggagaaagttttcacttcggccacctgggttcgagtcccactttcctctcaattttgcacctattattacttgcactgtgtatagggctctcttagaataagtctattttgcctcccccaagtcaaattatatttgccttctatttttttctcttttttcaacagatttttattggttatgaaatcttatcttataatgaatcagtttttaattcgaaaattaaaaataattaaattatattcacaaaaatcaatataatatatgttgacctaggccctagaatatgtctactttccctccctagtccgaaatcatatttgcgcgtaatttttttttctctcaaccattagcacggaccatgcacatccgatggctgaaacatcaaaagttctgcacctctttctttaacagatttttagtgattctgaaatcttatagtacaccggtttttaattcgaaaaataaagattattatattatattaaaaaattagtataaacacgtgaaccaaccggtatttttttaaaacatgaaaattgaatatgtgcatggcgtgaaacttcacaccatggctccgttccttctatctcgatttttgttagcgtgtttttaaaactttctatatacaagttgatataaaatactagataatttttcttaatttttgttataataaaactcaattaatcatgtgctaagaggttttctaaaaagaaaaaggaacggcatggtatggctggcactgttcaggttttgtcggttagaacatagcactgtactgttgcattgtgattataatcaatgcaatgttatagcaatcatcaattatgaaaaaagattataaaagtgtcataaaaaatgtagtttataataattaatgaactcccaaaaaattcattatttacttatacgtaaaggtgcgttgcttggacgtccgtttctccaatgctacaatcattgggaccatgtgttagggacatcattcacattctgtacgtgtagagcggattaattatccaaacacaaatatgcatttgtgataactatgaaggtgcttcgataaatcgttaaggccaaatttcattcacctcaccaagtcaccattacccagtacaatgatatcacagtttatcacataagggttgagagagagagagagcgtgtttttattctgcgtgattatcattaacctaataaataatttatctatcttgaaacattactatatatatgttaactctagactttatagcatttaactgttcctttacccgtaacaaagcatgtgcatttttctagcataacaataatataattaaaatagccttcacccgttacaacatacgggtgtattattaaaaaatcagaccgggccaaaaaaaaactcagcaaaaaccatgtgtattattagaagaaaaaccagattggaccggaaaaaatgagcaacccagatcagaccagaggttgccgttgtcgtttctttctctatctatcagaacaatattgtcagtcgcatttctgctgttctggttttcttcgttgccaatgtccaccatcaatagatgagtccaattatgagatacatcctaccacagtcctcaccaccatttgatcatcggaccatccacgcccatcttgagtattatgagaatatgagtatatcaatatgtaatggtggttttatccattctaattatcattaaaatttctaattaatacttagtctaagaaataatttatccgtagcgaagcacgggcattttgctagtatatatatatgcacgtaagcaacgtaccagcctttctccgccacgaaggcgtagctacagggggcgccttggtcccacgcgacgttgggcaccaagctcgggtcggcccactccaaatttaggacgttaaggttgggcgggatggaaggcacatggcagcaacccagccccgtgcagccgtcaccgtcgttggcggctgtctccaagctcgcgcacgacgtgatgcagccggtcaagtagctcccgtcgtccttgccccatagcaacccaacccaatcgcaccgcagccgatggccgtgaactcgttcctctcctccgccaacaggaacggcgtgccggtggcgttgaaactcgcgtaaataccgctggattccgtggtgttaggcgagttgttgcagtagtcttgcagcacgagactgtagacgcgcatctcccccttctccagcgagatgtccatgatctctacgtcccccgtgtacggcctgggtggggtaaagctatggttgcagtcgacttcgaagcccggccaggcgcagtcgacgccgatgccgaaggggaaggggatgtcgacgtcgccgcacttgctcgagcaccccgcccgctgcccacccgccgccgccgccgtagcagcatggaacagcagcagcagcactattattagttgttgtggcatggctagtattccgacgcgcattacgtttcgtttcttgctgcttgtacgtactacgtggtagctagaggtgctgcgtgggatgcgcacgtcgccgcacttcctgccgcagttcgccgccgtcgacgtacccaccagcacagaggaaactagtagcagtggcgccacggctgcagccagagcatggaggtcataccacacactggtggagaaaccatctttcgtcggtcggccgatttccacagtagtcccggatgcaataaaaaccggggctaaagatgttctttagtcccggttcaaaagggtaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactaaatttgcacctatgttttgcacactttttttgtctccaaaatgtagttgtaagttgatgagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgagcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccaaccaccatacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcagcgaccttcacccggaaccaaaggagaaaggaagccattacttgagtccagccagctacactcttagcaaggcagggaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttctagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtatatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaattatgacggtagacaacaatttattccgtaaagcccatttcactgttctacaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacaaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttcattacagttttgaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatattttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatatatatatatattggaatttttattaattataagtcatatatttgcttattacgatttatccactaatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctttatctctcgatctctccgatctcagctcgatctctctccgtctctctccgtcgccgccgccacgccacgccgccgccgccacggccccgcaacgccacgccgccgccgccgccgtcgccacggcaccgtcgccacgccgtcaccacgccgccgccgtcgccacgccgccgtcgccacgccgtcgccacgccgccgccgtcgccacgccgccgccgtcgccacggcgccaaccgccgccccgatgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatgtatatatatatatgtatatatatatatatgtatatatatatatatgtatatgttacttcgcatttgactatatgcatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtatgatacaatcgcggaggaaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatctaacggaagtggaagaagatggacgtcctagtgccccggccgaagccgccaagaactatgtacgtcacagcggttgggtgtgcgggataacgtgcctgtcagtagggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggcaggaacgatcgaagttctggtactatgctcacggtggaacgctcaacccagctgatggctcactggtcttcggcgttcagatacgagaggctgcgtgacgactaacagatgcagtggaagcctcctctcagggcacgttccgacccgacagagatagggacgagctgacactcgccctgcagactccagagcatccaggacgaacacgagggaaatgggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaatggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatgctgcaccgtctcctcctcatgctccgccagcaccgactcctcctctggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaactagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaatgtatatgactcaatggataaaaaagagtctacgtttgacaaggttttcgaacttatagacaggtactggcataagtttctctgttaattaagaaattcttgttatgttaattatttctactatgaatcatatctttaaactccatgtagggcttggcatcggttccgtcatttggtccgcggcaactggagagaaagacttaggcggaggttcaaatttcctgtgagtacacatgctctgcatttatatttctccgattcaaattaatacatacaactgtatattaattagatctcacgccgttaatttgtcatttatttgtagtgcacaaagcaaaagcagggaactaacttgtgcggctactacgtgtgtgagtattgccactgccttgcaaaccaaatcatcaccacaagagagctcgatgtacgtacaaataaattcaaaatttcattacgtaacgatttcttgtttaattactaatcaatttcatacattcgtatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgtatttgcataacatatatatgtataaatacatatatattatgcatgtatatacatataatataatataatatatatacatatatatatgtatgcatatatatgtattgaaacatatatatgcatggtttatatatatatatatatatatatataaaccatgcagcaacagggccatgcaaaaaaaaaaaggtcagctcgatgtttagtcccggttatttcacccgggactaaagatagcgatctttagtcccggattggtactcccggtttggaaaccgggactaaaagggggttacgaaccgggactacaaagggtttctccaccagtggatagaaaaaaaaatctgaatgcacttcattgcacaatgataaaaaaatatgttcacacatactccctctatcccataaagaagcaactcctagcttcctaatgcaaaattaaagaggtggagaaagggccaaaatatcccttattaatagcatattagtattggtggataagcaggtaataaggggtattgaaggaataaaatgtttgcgaaccaaggatggatgagaaggtagaagttgatttattttggaacaaaatttgaatctagaagttgatttattttgacacggagggagtatttagcggttctgatatccatgccgtacccacactcaaatagatattcatattcaaaattataatcccatcagatgcacattgacatagacagcgagtttaaagtcatacatattctgagtttaaagtcatacatattcttcacatattgacatggacatctcgacggtgtgggtttgcataagatatatattcatatatactttatccacttattattataattgcattcaaccaaaacagaatggatgcttttgaggatttagcacagtttcccatatctaaagcaccacaatgttcttcaaatatggcaaaaattagtggcgtatctaggatttaaagtgaaggtggttcatctatagacgggcatctataggtggcaaaaattagcagctggatgagttgtagcactggttctccacgggagtgtagcactggttaggactaaagcactaccgtgcactacctagtcacatccttaataatactggtcgctaacccgtgcgttgcatgggctatagttattaacaatataaatattaaaaatgtaatcctgtgatgaatatgttggtcatcaaattttcttgaaagttatacattttcaagttggagtctttaaaagtacataattatacattctttatactttcaattgtaaagaaacttatgatttaataatttcaaaatttgtaaataaaatatgaaattgtactcggtctagagccacggttatagattgttcatgattgaagtcccaattgtaacttttatgatttaataattatgaaaatagtaaataatatattttagttgtatggtttggagttcacataagtttcaacttactaattatgaatttaaaaaatgtaattaaattaacaaatttctaaattgggagtcaagaaaggtgaaactctgtgatcactatgatgtctgatttcagaattattaattttgtaaaaataaaactaaagagcccatgttactttttgtgacatattttaatttacacgaattcatatatatagatcgaatatcataggaatgcgaaccacctaatcaactgtggtaagatctttagcatcccagaagtgcacaattaatcttggttttaacacaaattctttgattgatcaatggtcatggtaatacgattgacctaataaactacagatcttttagttaacgtttatagtaaatgtgagtgctctctggggatacccataaataccaacattatttgcaaggggaatatttataccgaccttttattaataagtatcacgtctgttgggatttatgccatcccaaagtctgattatcctgaccttgactttggacgcttccttcgcattgtcaacatcttgaaccatgtcattggtaaaagaaaaggtaagctgcagactatatgatgtgtatacggacatacaaacaggaaatatggaaaattaaatattatatttgcttgtttatatttagatttagagaaaagtcatagataagggtctatgatttgtcaactgaacctgattaccggattactagcacggctcatcatgttaaagatcaacagctatttcattatttcagtcaaaatcagtaatcggtaatttcttaaatagctaggttgaaacatgtacgttcaacggacaccgaacagttcattaaatagagaaatgatcccccagtaattcatcacttaaaagtccagacaaatcatataaaagatcgagaaaatcttaaatagatcactaaggagatcacacagtagaatagttcgaccatacctatgtgaattgggaaacggcggcagatgtgctcgatttttggatcggcgtctggaactcctgaaatttcttgggttggatgatgatgtttcagatgagtctgaatcaaaatcgatgaaaaatcactgtccaaaacataaattagagaaaaaacctataaattctgaaacaacaatctctatttaaatcgatggtctattattttactccttggataaaaaacataaaaagtatgcatcactactacataattaatttttctgaccaaaccctcctttagattgcaagaaggctataactactgtactctgcaaaaatcgcttccctgtgatcggttcatgggcctattaagtgacccacatgcgaaattagctacttgcgagtttctctctcccacactggcatctctccctcttttctccccactccatttttttctcccactacccactcaatcctcccactccctctccccctctacctactcctctcatcgcatcattaaagaatcatcatagcaaaattccacagaggagaagcaatcaagattcagatatcatcacttctttcttgcttgcttgtacgtggtagctaggagcgtgggagattagtgaccatgcatgtctttgtataaatataatactccacttttgattaatgattggccgggtgactcagcttaattatatctatattaatttaatcctcctagttgactgcactagctaggaacttcattatggagtatcttttaataggatcataatcctagctaattatatatacaacacgtgtgttctaatctatctatctatctattatctatctattattattatatactaaaaatccattaaactttctacaaacgctcctaagccgagcgccatgtctgggtgtgtgtgagtgtgatgcattggagacaatacagggttatttaactctcctttgtcctttctaccgtgcgttcccagaaactgggtcattcaacgtccaagtccaagacattgactattggtcaacattgtgtgactccgtgagcaagtgcagggaaagcacaacaagcaacttgatgatgcttgatcatgaaatgattgcttgtattggtatattggaaaaccttgactatcagtcaacctgaggcaaacaacagtgatccttatcaactctactgttcccattccaaaggggaaaaaagggagacttttggtgcataaagcactaacgatacgacgtgttatatatgcaaatccaagttggcaattggtgaactcataccccattccacatatataatggttaaatttattgcaggcttttacttcgaataaaactattgcaggcaggcaggcatgcacttactgaaaataaattttgagtcatgtgactttcttcccattccgaagggggtgaaagacgaccttagtctttgtaagtttgttgtttggctggtgatgcacatacagcctgttcatttgtgcagtttccatataacttctctacttccaaagaaaagagaggacaaagaggtccttctttgggtacatccgagtgaactgagaaaagagaaaacattacatttgcataatttttttaaatacagatgcccccctaaaatatcaggtttctgtagttgttgggaaaaactttcatcaactgcattttttggtgcagaagtgctatatctgggacagggcagagaaagatctggtgctagatacagggtcccactgcagctaataacacaagggaacccagaaactctatcagatgaagaaatcacaaccatccaactctgttagcggagcacatcaatcacaatcattcaactagtacaaaacttcaggaaagaagagcagacagtggccattaaaagaacacacgtttttttttctgatatgtcaggagatcatttcacagtacgccagatggcaaacgaatcgtgttgtgcacaaacaaatcttttgtgtacataggcaagggcaatcgatcactacaggttcactacgcagcatcctgaaccgtttctccaatttcattgctttctttttctatattacaggtaacatgtacagaaaccttgcaaatttgcaagtaatggtcatgtagaagtaagtaaaaataatttgattggtcaagacctgacagtgcagtcggttaaacttgcaagaattttattttcaggtatagcatcattagagaatcatcatagcaaaattccacagaggagaagcaatcaagattcagatatcatcacttcggaaaaaaaaaggaaaaaaagaaaatacctgctaccttcgcgcggttgtgaagggggaatcagtgcgagagagaaggatgtttttactgtacgtgggattttcttatataagtcatacaaaggaaattaaggttttgactacaaaatgattagttggatgtcatgcatgcaacttgtgaaaggctgaaaactaagagtgttgatataagaacttactccctcctttttatattataagtcatttgactttttattagtgaagcttttttaagtttgatcaagtttgtagtaaaatatagtaatattttaaatataaaacaaacattatatcaaaatatattcaatgttaaatttaataaaactaatttagtgtcatatatgttgctaattttttctataaatttgagcaaacctaaagaatttttacagaggaaaaagtcaaacgacttataatatgaaacagagtgagtattacataaattaaaggagatttgtgtccttaattaagttaacacctatgtagaagtactaagccacaggaataacctcaatttgtctcatatcagatgttcaagttagatgttaccactgctagagaaacgatcttttattgtagtccccaaaatacaaatatctcaactagattaaaaacggccggtactaaagccttagtaccgattgtaaaagtccaaatccctagaaacatctttcgttccggttggtgttatcaaccggtattggctggtagcaccaaacaagactaaagctagaagattttaagtccggattggtgttaccaaccggtactataatgcctcttgggttagttaaaaagaaagcatctctatccaagttagatgtgtgtaataagtgggatggtaacacacgtgagggctgaggtgagaaatcttgagcttgaatcccacatcccacatattttttatttagtatgtatctttattaccggttctttaaccgatactaaagatcgagatctttagtctcgatttactggcctcgattgctacaaccggtaataaagctggggttgtgaactctctagcctctcaacgtgatcttgattaattagaaaaatactttcgatcgggtgcccgattgaggccacaagacagtgcatgcatgcatcaggtgatccagtatgaccgtgccaatgatattaaagtcgtccccttagcctccccaagaaagctaagtcacttatacgaagaggatcgatgctaatattattagcgtcgaagacctatttgtaatttatttttgaaaacaacctattcctaattcatataggacatctcagatcttcgaatactgtactcccaagatttggctgtctttgatctttgggggacaaagctagtagatggtgtggaagtagttactaaatgtctaaatctgaagcacgcagagcatctctatcgtggctaatgacatcaatatatataatactcccttcgttccaaattgatctacatatttcataggtacaccaagaccaagaaaaactaataactctctcatactatatttactatatcaacaaactcaatgcatgcaccatccccactatttcctagtcaatagcaaatcaagatattgcatgtgggttgtaaatacttgtgtgcatggatgcatgcaccaatgtccatttactccaatgcacaaataacgaatagacctaatgaatgtagatcatttaggaataacctaaaaaaactatatgtagatcaatttggaatggagggagtactaataagttgacaaagaactggtttagttgaggcctaaattggtcttaccaatatttggcaattttaatagtatttaggtactatttagtttgaagctaaattttggcatgcctaaaaaagtatgctatttcaatagttaacttaagctattttggtttcaatccaaacacacatttgccttgccaaaattagccatgccaaaacatactaaaatttgacattaacaaaaattagtaaggctaatttagatcacaaaccaaaccagcccagaattaaatgcgtcctgttgattgagatgttaattaatttactttgcacttatatgcatgttcgaggctcctccttcctgggccagaagatttcggcccgttggcccaaatctgttgtccattacccccgggcggcccaagtcaggtccaggagctgttgcatgagctatcactatagttaaaattatgatattttctcccgttcattaaaaagtacctcaagatacctgtatcttatggtaccaaatcattttcggtcgttggatctagctgggcaagatgggcattgctaaatccaacgatcgaaaataattttgtatcgtgaagtgctggtatctcgaagtactttttattgaattggagcaaatctctagaattattgttgcaagagaagtacgtacgtagtaaatgtatacattgataaagagtgtaagaccaaaattctgttggcatggacctaaatttgtacgcaagatcaacagctataattaatttaatctcatatatttcaggagtactgcagcatgcacgcacctcgaaaccttaaatcatgttgcattacatatattcatgatatcacaaccgaattgttcaaagtaatagtagcttacagcgcgaaaggtacaacattatatatgtagatcacaccacaagcgcatatagaaaatatgtaacgtaataatcttacctactgatagccttaaccaaaccaaagtatacttcatatctgttgagagattgaggagaaactaatgacgaggtaaaacgaaatgatcattgacgaaacaaacgatatatcgatcgaaagctttaattctacatgcgttcgttgaccatcgtcgtcgttgtggttatcaagctaggtcacgttcaggcttgcactcaactgcttgagctcctccagcgcctccgccatggtcggcctctcgtcaatatcctccataaggcaccgaatcgcaatgttggccatcctgtcgaggcattccatgtagcgaggccgcagagcatcatcggttgatgacaacatgttctggtcgtacatgttccttctcgcgtagtcgtccttgtaatacttggcaaagtttaacgggaggctttctctgtcgtcgtccaaggctttcttccgggtgatgagttccaggagcaccactccaaaactgtacacgtcgctcttctccgtgaaacggcctgtcttgatgtaggcaggatcgatgtagctcatgtcagccatcacggaccagttatcagacttggcgactgacatgagcttggacgatccaaagtcagagaccttgggctctagattgttgccaagaagaatattgccggacttgacgtccccatggacgacgcttttgtggccaatgttagagtgcatgcatgctaaagcttcggcgcagccaacggcgatgtcgaggcgagttggtagcgggagatgcgtatgccgaccatcgccatggagcttttcgtagaggctacccttggggatgagctccagaaccagcatgggcacatccgtatgcaggcagcacccgactagacggaccagattctcatgctggatccgagcctggctcgttatctcatccgcgaaatcctgtttgttaagctcatggccgtttctgacaaagcgcttcacagcaacctgctggttgtcctgggtgatccccttgtaaaccttaccaaagtagcctttcccaatcattcttttctcacagtagttttttgtcatcttcttcagctcctcttcgctgaagattttgatgtccatcatcttgttcagtatgttgccaccatttttgtcaaatgatctatttcgctgccgcctcctatgctccttgagaatgtacagcaccacgaatgccagaatacctccggcgacagcagttgctggcaagtaacaaattaaataattaaatgaaccaaatcagtacttcttcaagtaaaatacatgcatgtgacatttttgatatgatcctactatacttttgaaacttcgactatcaattaatctgttaaataaaaaaaatgttattttaaacttttctaggtcaacaaggtactactttgaatactcaatcaaaaattctcgtttatatggattaaaaaattttatacaagtgtgctattgtaaaagcattcgtaatgacagactttaatatatactttttaatatatatgagacctgtactttaaaacaataactatagtcaaaatcaaattgttgtgattgcatggatcacatatcaatattaaacattatttcggcagaggtagtaatatttgaaatataaacgacgacatgtgtacatttgttttaaaaaaaatactttcacaatgccgtaactaaacttattagattttatgtaattgtgaacgacttgttgatagagagcatgcgagtacaataatatagtcaagctccaaaaattattacatcatctacagccgaccaaatagcctggtcatacaacagctagctgtgtgtctatctatacacacacactacatcattaatatttggctcatctctctttacatagtttatttgagctcgtgctttatttagctggctataaatctatagcttgtttttcttctctctcctctcctctcccctctactccacataagcacaaatgcgatacgataactcataaagcccgattacatcgtattattataattgctctcaaaagtgtataagtttgttgtataagccagagtattttatatttatattcattactttattaaacttgtgaaacctcgacaatcaattaagcccgctcaaatgttgttttcaacttttcgggtcaagaaggtactacattacatctgaattatattttctttatacggtttgcctccccccaccccaccccacccccacaacccctcttcacctcaaaaaataagtctctgatttttggtttgtcccttacatccccaatattccattagttgatggtttaatttcttaaaatgatctattttgcctctatgcataaaacaaacatggaaatttatggacttattgtcaaagcaagtacaataatataatcaactgctagcttaaaaaattatcaaatcatctataaccgaccaaacactactaaaaaaccctcataaggaccggtcttataggtgctggttcatttaaaaccagcacctatgagccttttcccacctccgcacgatgaaaaaatatagaaccgacacctttaagcactataggtatcaggtctattaaaaaaccgacacctatactataggtgccgagtttttttaatagaactgacatctatacttatattttaggtgtcggttctagagaaaaaaccgtcacatatagtataggtgttagtttttttacagaaccgacacctattaaaaaaacctcatccttatctttttgaccacccacagctagcgcccccttatcttataccacatcccacatcgctccttatatatatctctctctctcttccctcctctccctttgccttcctttctctagtggatcggcgacagctgacggaggagcggtgacggctgacggagaacgcggcggcggccctctcccagcccaggggccctccccccttctctcgtcctccagggacggcacagcggtggagaaggccgtccggcgtgggcaaggtaacagcacggcggtggagaaggccggccagcgcaggtgaggtggcggccaccacggaggccagcgcgacgaggtggaggctatggcggtggtggtggaggaggcttggatctcgccggccctctctctcccacgggacctccctccttcccttctcctctagcacagcgtgggttggtggccggcgcgacgaggtggcggcacggtcgtcggatctcgtcggccccctctctcccgagggacctcccccatcttccagcgcagtgttgggtggcgggcaccggcgcggaggccggcctagcgaggtcgcggtgtggaggtcagcgtggcttttttattattttaatagtataggtgtcggttctgaaatcggcacctatacgattggggtaaaggtgtcaaccaatagatgcctactgggaaaccaacacctatggggttttctgtggttgtgaaatagctcggtcatacaatagttagctgtagatatacatactacatcgttaatatttagcccatctctctttcacatagtttattggaacttgtgttgtagctggctataaatttgtaacctgtttttcttctctcttctctcctctctactcgacataagtacaaatgtgataaggcaacttataaagcccacttacatcgtcttattatattcgctcttagaagtgtgtatagtaagtttattgtataagctggactgttacatatttatattcatgcatgactttattgtacaagtattatttgtggaaaagtttatttttacaaaaaaatatttattttatttatttattaaatgaatatgtgtagaatactttttatggtagttcaatatatttgtccctgttgtatatattatataaaaggaattgctacccaaaactatgtcatttcaaaatttcacctcaaatatcacaaaatagtcaaacatcatcttcttttctgtttgaggatattaatcgggggaataatacttaggacttaattagtgcgtggcatgttatatatgaatgcatagaattgaaagcacggaagaaacgaggatccacagcactttaagaagtggaaataaagaaaaaaaaatgctgacctattgttgcgactacggtcgctggaagtatgggtttgcatcccttgtcgattttaccatcccctctatgtggaaatcggcacttgcacttgtaaccaccctctgtgtcatagcatctgctaccaccgtaacagggatacttggtaggctcttctctcctaagctcgcactcattaatatctgcacacaatggttgcgtataatatgtatatcaattagaaaactggcaagcttgtaaatgatgatgccaaatcaataacaagaagtactactacgtacagccgtcccatatgaattgtaattatagattgtttagcatatattaaagtttgagaagaaagactactacgatgtcccttatcaaatggtgtataggtaagagtggaatggtaattgagggtaaaatggtaagaaatttgaatgaaaagtgggaccattagtactatattgtgataattattttggaacaaattcaactagaaatgtaattattataggacagaggtaatagctagctagctatatgcatgccataaaaaactgatatgatatttaattaattccaaatttcagaatgattaaatcgtgaaaatcttatattccaaggtgaattaagatttatactgcctatggtccaaattataaggtctataaattttttacacagtttttaatgatatactttgtacattagtttatttaatattatgttatcaacaactataaatttaatatcacataaaagtattttaaaatttaaatctagtgatttaacatgcataatacttataatagatattgttagtataactattagttgaaagttaccgagtttgattttcataaaaataaaaataaggatgccctatgaattttttttcaaatcattaattatcaattattcatcgaatacatgtaacactacgagcaaagtgcagattaacaactactcccttcatttcaaacgataagtcgttttaactttttttcgttgtcaaatttttctaaatttaattaagtttatagaaaaatatgacaacattacgaacacaaaacaaacatattatcataatatattcgatgttatatttagtgaaactaatttagtgacatagatgttaaaattttctataaatttacttacacttgaagaaagtttaactatgagaaaaagcaaaacgatttataatataaaatataattaagtgtaagaacaaacttatgcatccgccggtgacatagggattgccggcgtatcccgtggagcagttgcataggtagccatccccgttggtagcgtttacgcagtagctgtgggcgctgacacaagcaggagcccctgttgctgatgagcacgatccatttcttctgatggcccagtcaagcactgttgagacacgtctttctccagtactgttgacgaagctcttgctgccggaacgactaaaatcttgccggctgaaattgtacctaaatcatgtcgatcatatatatgcatatgcatcagtaaaactcagtggatgaaaacaatcaagaatttaattggacaacataagtatggtgtatatatatatatatatatatatatatatatattggtatacgtaccagccttgctcggccacgaaggcgtagctacaggggctgtctttccaagctgggttaacgatgctttcgcccaaggaaatatttaagatgccaaggttgggcgggatggaaggcacgtggcagcaacccagccccgtgcagggctcaccgtcgtgggcggcctcatccaagctcgcgcacgtcgtgatgcagccggtcaagtagctcgcatcgtccctgcccaatagaaacgcaatcgtaccacagccgatggccgtgaactcgttcctgctccgcgcaaacaggaacggcgtaccgaggtaggcccacgaggaggcgtttccttcgtactcggtggtattgtccgaagtgaagcagtcggacacgacgggagtgtacacgcgcatctcccccttctccagcgagatgtccttgatctctacgttgcccgtgtacggcctgggaggggtaaagctatggttgcatgagaggtcgaagcccggccaggcgcagtcgacgccgatgccgaaagggaaggggatgcgcacgtcgccgcacttcctaccgcagttcgccgccgtcgacgtacccaccagcacggaaagtactaaaactgctaggagatcatcataccacagcatcactccttgtgccatggctggccagtagctagctaggtgttgctaatttattaattaaaccccgcacgtacgaggtacgactacacggcttccactggctagaatatatgtgcgatatttgcacttgccatgcatctctttatatactgctactgtacgttggttgttgatgggtgactagccacactataagccagctataaacacatattaaacatattaagaagattaaagaggtgagattagaatagcaacgagctacagatttctgtagtattaatagtgtagtatatgtacatatgatatgaattggctattaaatcgactgtagatggtttggagctaatagttggctatactattaaacttgctctctaacacctatcaactccatcccaagatattggatgcctaccaatttttcaattttccgttaaaataatattatttctaaaaaaattcgtatattggacatggttattaagaaaataattagaattaaatgaagcgaggttgtggttagttgagaagtggaaattgatgggtaaattgaatggttataaggattttgattagttgggaagataatgttagtgtagtagttgttatatctctatctctgctattataaaaattgaagatgtttttgccggtattttggtaaatcattcgtgtttgagtcggttttcaagttcgttcgtttttggcaatacagacatgtgtttgagttggattttaagctcgtttgcttttaaaattacaaaaggaatcatataagagatctctttaaaaaaaactcatatgctaagttcaaatgaaagtcgaactcttaaatgcagctcattattttctaaaaagaaatatccaagtgaatttccacagtgaattttatcctatctaaaccgtataacaataataggattaaaatagcattcacctgttggaacgtacgggcattttttctagttttaagataaattatgagtgtgagaactaaattgttaaattttggaatgtagcaagaatctcgtattttcatcctatacagaacttcgaaggagtattgaaaacaaaacaagtgtttatattctctcccattgtattgtacatacaactgttggtttataatccatctactacctccgttccaaaatatagtaacttttagctatgaatctggacacacagttatccagatttaaagctaaaaatgattatattttgggacggatggagtaagaaacatgaataactcagtctataattgttgtctatatatataacatagccaaattgttactatctccgttccacaattcttacgtttccaaaacaaggtttggttaaacaactaaggacatttttaatttcaggggtgaaaagtttttacgtgccacattgaatatacagacacacatttgaagtattaaatatagtcaaataacaaaacaaattacatattccgcatgtaaactgtgagacgattttattaaacctaattaatccgtcattagcaaatgtttactgtagcaccacattgtcaaatcatggcacaattaggcttaaaagattcgtctcacaatttacacacaatctgtgcaattggtttttttgtctacatttaatactctatatatgtgaccaaacattcgatgtgacagcgtgaaaagtttttacgtgggaactaaacagggccaaaaactgtctatcaatatctatctatctatctatctatctattatatactaaaagtccatgaaacttcctacaaacgctctcaagccgccacgtggcgttctaataaaatagagaaaatcctagaaattctacgaaaaaaacaaaacatccgaccattgattttcatttaaattggtggacccattattttacaccattagatttatctcaagaaaaaaacaaccaaatccacctctttccatcgttagattagatctattgagactcacggtcaagcacacctcgcctctttccgtgcatgcgacgcactgtacgcacacttcctctcctctcttttgctgcccctcccctcctattctcttttctatttgtaagcaatcattttttttatcaagaaatcaacagttcgatgtgttcaaaataattactatagttttaatttattttgtaagcaaactatcagatcaagaaaatcctccgtcgatatatggagcagttctacccactgttgtaacaatataagtaaatttcttgaagcttttggaaaataaattaattaattttaggcatttgggttatcaggtggtttttaagagagcgtgccctacctcttcctacgtatgtgcctccctactcttacactctaataagtcttaatttatacaattaaaaactcagttttgaatatattttaaatcataaaaatataattttgcgggaacattatattatattatacactaaaagtatattaaactcccaacaaacgttctcaaacattcacgtgacacagtggcttagataggatttagagtaaaggcggtccatctatatgtaataggtcaattaaaagggtggtccactatataatttttattatattaactagcacatatactatagttttaatcttgatcaatcttttaggtggtccatggcctacagtgccaccttgctagctacgcctctgacatgacgttctacagacgcttctaggatgtcatgtggcgctttaataaatttaaaaataaatcatgaaaattctaattaaaaagaaaaaaaattctaaacattgattttctttaaataggtggacccaataattttaatcttaaaaataaatccggtaaacccaccttcacccccaccgtatgtgatcacgcatgtaagtactcctccatcctcctactctcctctaggatcccactctcctctctattttctagctaactttcctattttctagctaacacaaaatatataaaaaaaacaatagctaaatgatcatgactctcaagttacatatacttttctcaatctatttgctttcttgtgttattgtataattaaatacataatccaagatctatattgcccatatttactatataaaagttagataatttggtcgatctaactacaaatatttgagtaaaatagcactttgaaaatgatggatgaattcaaatatgtacgtctaaagtccaggttcaataaccaccaaggagcttggaaccataatacatactctgaacccgatggacaccgacggcagcagtagcattgacttccacaagttcctaaccctaatagcgtgctaaaggacaaatactgataggaggggcagagggagatgttccgcttcttcagcaaggagtagaaaattacttcatctctaacgccaagccccgccatgtcatgtccaatgtatcaggagaggctcactaatgaggaggtcgacgagatgatccatgagaccgatggtagcaagcggatcaactataacgagttcataagtgaattcataaaaaaaataaaacaagcaatttgattaaaatatacattaaaccaaaaaaaacattaaaagtacaaaaaaacaacatgattccatgtagaatataaaatatcaagagttcgtatgaaagtatgagttataaatagataaaattgggaataataaaataagtatcaaaagaaaagtccaaacacaacacgatacgagattaagtacaatttaaaatccctgaaaagacaatttagactcgaaattagactcgatcactaaattcaaaatacattaaacatttttcaaagaacttttctatgttgattcacatgcataacgaattgcatatatacgaagcaattaaagaaagggttagcagggtgggaaaatacatttattatagtttgtcgatatttcttcagaaaaaagatacaatgaacactcaattaaaaatagaaaatgccttactttaatttcaatttattttttagaactattttcaaaacaaactaatatgcatgccgcgcgaatgcgtgggctatcttcctagtttttttaaaaaatattttgtttgagcacactaaaacatgataaataatttggccttaattaaatttttttaatagaattaaatatataattatattttatatattgtggactaaaattccgaacgttttgtatacataattaagagaataactgaacttgtgacagaagtaaatcgtctacacattcattacagctgaggattaaatgctgggtgaatttgtatggctgaaaatataaagactctgtaacatcaacgcgagtaaaagcttagccgaattagtccggtcattatattcttactgatgtaacctggccgtgtacatacggacattactcttgtaacattgtaacattggcttgttttgaagggcgacgatcgaaacggatgccatggctgagaaagagcattgccacgacgaggaagaattaattaagtttgtcaatagctggacgcgcattcacactttgcgatgtatatattgactgtgtggctcgtggatctatacaatggatacacacgttaaacgacaccttgaagaaaactcttgtgaaattaaactgaagctttcggatcagaatctgtactcgacaaacgccgtgtttagttccaaaatttttttaaaacttttaactttttcatcacatcaacacttttctacacacagaaacttccaacttttccgtcacatcgttccaatttaaagcaaacttccaatttcaacgtaaactaaacacacccaaaagctgagttttgggaggatctacagtatgtatacaaacacaagaagcacttttcaaatcaagctaaaacatgtttactatcatatactaaaaattttcatattaattagttagaaaaaaattcaagtagaaatacaattcaaaatatatgaaatttaaattaaagaaaattcatttagaatacaatatggattcattaaaatttcaaaataaaaatataataccatcactggatatctattgtagttgctgcgtagtttccgaaagctagcaagcacttgctatcaagcaacgaaacaaacagtggccacaccttgtccatctagacttgattagttgacatgtacatttccttggcttggagggcacacaaaacttatgggcaacgacacacttatgatgatagttgagtggacgtcaactcctgatagtagcaaaaccaaaagttgggcattgagtagtggtgggcgtatggatttactgattctccgtttccgttgactttttagcatatgtttgactgttcgtgttattcaaaaaattttgtgaaatatgtaaaactatatgtatacacgaaagtaaatttaacaatgaatcaaatgataggaaaataattaataattacttatttttttaataagacgaatggtcaaacatgtttaaaaaagtcaacggcgtcaaatatttacaaacagagggaataggtttgttttaaatgggtttatgaaaggtctgttttctattaaatgacaaccgaataatgtgtgatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggcccccccgggatctttag

SEQ ID NO: 37589 - DNA, 9066 bp, Oryza sativa
ttccgggggaaacaaattgcccgagacaacgtacgaggctaaaaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacatgacgggatgctgagacaccccgccgatggttcgcagtggcgaaacatcgacagaaaatttaaagaatttggaaaggacgcacgaaacatactgtcggtgatatgggaccgggagtatcgtgaccagaggcttgaggcagacacaatcgcccacgtggcctgacaccctcggggacgtcgggcccgagggtgaggtgtccgccctcctcctgatttccccgaggggggtcgggttactcctgccccggccccgagggccgaggcgccccgaccccttgtgggttttttgcgtcacatgtatgggttaggtgaacacggcagggctcacctaaccgcatttattgcggctcggctaaacgtgtcacgccgcacgaaatacagtgcagtgcactcgtttatccggtctgtgaccagtcacagaccggtcagatcgcgggttaggtggcgacaggcggtcagacgcacgcttcgtcccatcccatcaaggcgagagcttctaagcactcgtccccagctggagctagcgtgttacctcccagagatggcacgttagacccggtcgatatatgccaggcttcatcctaaccattacaggcaaggtgttgtgtgaagaagggcaaacatgcatgttgctgagctgacgcgtggtggacaagaattaccgatttgtgaccggtctgacactgatcatgtcgtcggcagacagccacgttcccacgacgcgcctgcctccggcagaagtggaggtaagtatgtgccgtcccgtcagaaggatgttcggagggcaaccatgcaaatctccgtccatttatgaaaagaagaaaagtccagtttggaaagagaagggtgcatgtggtatccccttgaaatataaaaggaggaccttgcccattgaggggttgagattcttttccagattcagaacctagagcaagggggaggttgccttacactttgtagctccttcacactcagatccaccaaaacacaggagtagggtattacgcttctcagcggcccgaacctgtatacatcgcttgtgtctcatgctcttttgataggtcgcgatctttccacatacagagagagcttggaatctcaccctgagcccccggccgaaccggcaaaggggggggcctgtgcggtctcccggtgaggagcccgaagctccgtcatctggcgcgccaggtagggggctcagcgtgtgttttctgagctctcgcactttttcgtgtgcgccaagtttttcttgttcagcctaatggccgggcaagcaaaggcgcacgacctctctccgagtgtgagcggcgacgacggggagccaaacccacgccgtcgagctcgtattccaccgcctcctccacaccaaagtcctaagcagggggaggcgctcgagagggtcgaaagatccgcggcttcaccgatcgcgggcgatggaggagaacggcgagatggggagcgtcgcctcctcgtctatggcgacggcagcacgccccagggcgcgcttcaggctgctggcgcgctcctacgtcacccgcccgtcgtccctgacccggagtctccagcctagcgatggctggacgacgtggccaacttggttatgacggcacagcagcgcctgggtgctggtggacggtcctccaccaccaggacctccggcgccgctaccactggctccgtgtcgtcaaggcggagggcgcggcgagcggcggctgttgcacgccattcggctgctactccctcgtcggcgcctccgactcgggaggatcagcggggagagccggatgcccgcctcgacatcgagcgccggcgtaatgatcggcgtgctccccacgcgacggagggcgcctcttcgtccagagtgtcacctcgacatggacgcgaggaccagccctccgtgcccccggctggtggtgtcggctgtagagcctttgtggcgagtcttcggaatgtccgttggcccccaaggttcctgcccaccatcactgagaagtatgacgggagcgtcaaccccaccgagtttttccaggtctatacgactgggattgaggccgctgggggtgatgacagggtcatggcgaatttctttcccatggccctgaagggacaggcgcggggttggctaatgaacctgccacccgcatcggtccactcctgggaggatttgtgccaacagttcaccatgaactttcaaggcacatatccgcgcccaggcgaagaagcggacttgcacgcagtacagcgaggggatgatgagtcacttcgctcgtacattcagcggttttgccaagtccgcaacactataccatgcatccctgcacacgcggtgatctacgcgttcagggggggtgtgcggcacaaccgcatgctcgaaaagatcgcctctaaagagccccagactaccacggagctttttcagctcgcggaccgagtggctcgtaaggaggaagcgtggacctggaacccctccggttccggagtggcagcttcggccgcccccggatccgccgctcagacagggcagcgtgacaggaggaggaagaagaggtcggtccattccggcgacgagggtcatgtcctcgccgtcgagggcgctccgcgggccacccgaaaggggaggcctgcgagcgacaaaaagaaaaaggccggcgctcccagcagggagcgcccagccggcaagtggtgcaccgtccacaacacctccctccacgaccttgcggactgtcgcgccgtcaaaagcttggctgagcggacaagaaagtgggaggaggagaggaggcaggagcgccgggaaggcaagtccccggcggttccttccggcaatcggcgaagtgaggccaagcagaaggcccccgccgaggacatcgatgatggcgatgatgacctaggtttccaagaacctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttaccctcacctttgaccagaccgaccacccaccgtgcattgcccggggagggcagattgcgatggtggtttcccccaccatttgcaacgtgaagttggggcgtgtcctcatagatggaggagcggccctcaacatcctttcccccgcggcctttgatgccatcaaggccccggggatggtgctccggccgtcccaaccgattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgtttgtctggagcagcgcgcggaccacctcgctactgcgtccaagcccgagggtggtgacgagaggcttggcacctccgcccccaccgccccgaggcagcggattgccacatgcgacgaggtcccggtcaaggaagttgccctgggcgacggcccatccaagaccacacggatcggtggtcttctggatggcaaataggaagacgcgctcgtctccttcctgcgggcaaacgctgacgtcttcgcatggagaccggctgacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgccctttgggttaaagaatgcaggtcctacttttcaacgtactactcgaatttctttgggtagccaaataggacgtaatgttgaggcttatgtcgatgacttggttgtaaaaacgcgcaaccaagagactttactctcagatctagcggaaacttttgagagtctccgctccgcccgcataaaactaaaccccgataagtgcgtgttcggtgtacccgcgggcaagcttctcgggttcttggtatctgcccgaggcatcgaggctaaccccgagaagatacgagctatagagcggatgtgcccccccagtaaacttagggatgtgcaatgtgtcaccggttgcatggccgccctaagtcggttcatatcgaggctgggagagaaggcgctacccttatttaagctcctcaagcgctctgggccgtttacttggacggaggaagctgaacgtgccctcactcagttgaaggcatatctcagctctcctccggttctagtcgccccggagccaaatgagcccctgctactctacttagcagcgaccccccaagtagttagtgcagcgttggttgtggagcgcgatgaggacaaccctcattccgcgcacccccaccctgtgctgacttggcccgggagcaagcagggaggagaggcccccgagccgaacggtggcctaaggcccctgacgaccggagtcggccctctgcccgctcgtcagacggtgctgggcgcccccgaccctcaggaaggccccgaggccactgcgggaaggccgcacctatcgccctttgaccccgaggctaaccctgtgcggactcgacccgggagagagcagggagaagaggcccccgagccgaacggtggcctaacgcccctgacgaccggagttggcccttcgcccgcttgtccgacgacgccaggagcccccgacccccaggacggccccgaggccactgtgggaaggccgcccctgtcatcctccgaccccgaggtcatcggcacagaaaacgagtgcgccccgagaggccacttggacgaagagcgccccggggatacggcccctagcgaagaggatcggccccgccgaaaggtgcagcggcctgtctactttgttagcgaggccctccgggacgccaagacccgataccctcaggcccagaaaatgctttacgctgttctgatggcctcgaggaaactgcgccattattttcaagcgcatcgggttatggtggttacgtcttacccactcggccaaatcttgcataatcgagagggtacaggacgggtggtaaaatgggcaatcgaactttctgagttcgatttgcactttgaaccacgccacgctatcaagagccaggccctcgccgattttgtggcagagtggaccccggctccagagcctgtctcactccccgaggtcagctcggacccctcgcagccgccacacaccggccactgggtgatgcagtttgacggctccctgtctcttcaaggcaccggtgcgggggtcacgttgacctccccgaccggagacgtcctgagatacctggtccgcctcgactttcgagcgaccaataatatggcagagtacgagggactccttgccggactcagggtggcagccggactggggatccgccgcctcctggtgttaggcgactcccagctagtcgttaaccaagtctgtatggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacccgaccccctagggaagacggatgtgcctgaccggcccccgaggcccgtcggagcccaggcctcgggacccgaggggagcgcttctagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctcctgaaatgcattcctcaggaacaaggcgttgagcttcttgccgatatccatgaaggcgagtgcggagcccattccgcctcgcgcaccttggttggcaaggcctttcgtcaaggattctattggccgacagctctcaatgacgcggtcgacctggtccggcgatgcagggcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactggtgaactcttcggcgactactgcgaagacatgggcatcaagctctgcttcgcctcacctgcccaccccagaagcaatggtcaagtggagcgcgccaatgcagaaatcctcagaggccttaaaaccaagaccttcaatatcctcaagaagcacggcgattcatggatcgaggagttgccagcggtgctctgggcgaaccgaaccacaccaagccgagcaaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtccctcggccgggttccgtgcggctggccacgggcgacggcactgagctgcctaacccgtggaacatcgaacaccttcgtcgcttctacccctgagggggggggcgggtgtcaggttttgggctcgggccaaccccgcaccccccctcgggtgtgcagggctggccgggggctaccacacatgcacattctctttcctcttatttcagtatttcaataaaagctgtttcaatttcctaagggctgtgtctgtgccgttttttccttttgaagaatcttgacttgaaataaggtcactcgtgctcaaccttgctctcgggggctcggttcggtctgctaaaaccgccaaacggggcccagaaccgagccgtgccctggggcgtggtgaactccgggggggaatcggcaaaaacccacaatcgggtcacccataacactcggtcaccacgttcccggcctggccagtctcgacatgcggatctccccaggcactagccccgacccgcgcctttcgaggactgggacttgggcacgagcccttaaatcaagctaagacacaaaagaggaccacggcacagatcatcctcatctcattcgcatagcaagataaaattaacacaaagaaatttttcatcatttttgattgcagattataagttgatctatacaaaaaagaggcctgaaggccttagaagaaagaaaaaagaaaaactggagattggcgggggcctgggggctcaatccgatgcgcccgggtcgccggcctcgtcgtcacggtcgtcagcaccgctggcgtcgccctcctcgtcggagttgggggcgaacgcgagccgaggggccgacccctcgaaactgtggacgatgtggtcggcggcatcccggacccgcgcgcgcgcgtcgtcctcggtcccgggagggaactcatccagcgccatccatggggagaagttggggtccctggcctggtaactcgctagtacgagttccaccgctccttgggcgaggtccctcgaggatgacttgatggtcttctcgagctcctcagggagttgctggagagccccggccatctttgagaggtgctgagcgaggcctcccaagttggtggagtacttcatcgtctggcctttccagaggcccgcctgccgaccggcgcgatccagacgggagactgcatcccaaagcatccgggccctatctcgcccgccaagcggagggcctcggcttccccggtgatgagtctagcgcgcgctgcatgtcggcgacggtgtgttcggcagctgcgaggcgggcggctaagtcgctttcgcccgcagccgccccgccgatgcgcgccctcgcgtccagctccttttcccgcgcctcgaggtcagcagcccgctgctccagtgcggctctctcggcgcggacgg

SEQ ID NO: 37590 - DNA, 2888 bp, Oryza sativa
gctcccgtattgaaggcgaagggagtcctgcgcctcgttcatcacggtggtggcgatgagggcagccccccgctcctcctccacctctcgaccgatctccgccagtgccgtcttacgggcttcaagatctgagacgtgccggcggtgagccttgcggcccgcttccaccatggcctccaccgagcgccgcccctcctcgacacgcgcccatgcagcgtcgagctccgcacgctccgcctgcagggcctccacctgggcacttaacccatccaacaccgcggtgtttgcggcggctaaggcttgcagaagaggctctgcgctcagcggggcgacggaaggcgtggggaagagctgccttggagaagatgccgcgcggctcggcccgccaatggacgtaccggactcggggatgtcccccggacctgtttggtcctgggcgtcgcccgaaggagtgggcccaagcgacgcgcccgcggcctcgtcgcgagctgcctcggaagtcgccatcgcctcagcctggcgagcccgggcggcctcctcccgagcggcttcctcagcctggtgagcccgggcggcctcccgggcggcctcttccgcttcccgcaggcgatctgcggcctctcgccggtcagattctcgcctccgtgcctctgcggccgccggatctttggcctcggactggccggacttgggatggcgggaggaacgcgacgggacatcgctgaagcggaaggaaaaccagaagataaacaagatgggtaagagaaaacttgcttttgggatagaagaaagacggtcgcaaagagcgtgggacgaacctgcgagggggtcggttgaatgaccaccttggcggggaaatcaggtttccccgggatggttctgtctcccccatcttgcgaagccgcttcttctcgcgctccccctcgggctgcgacgtcggcgcggccccctccgggcgcctgctgctggcacgcaccgccccgccccctcggggaggagataggggaggtgttcctcccagcttcctcttcccccgggcgtcggtagggcggttgctccccgagcccccgacgtggggcccagaagcacgaccccctcctggggtagattgttccccccggcggttcccacccgcgccgtcgtggcccttaggagcctcctcctctgaggccccgacccccatcatgatggtcaagatggaggcacggtctggatcgctgcagagggggagaactccttgaggaatgagagacgcttccacggagttgaggttcagcacccgttggatcaatatcttgaagtcctcaggagcccaatcccatctgactccctggtgggtccgcatgtagtcttcggacttggtgtactcccaggcgccacgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggccggcgccgggggctggctcggaagtcggaggcgcgcttcgtcggcgaggggggtgtagaaccagtcgctcttccagtcgtcccacttcttgcggagggcgcaggggatgtagcggttcagcaccggcccccgcggctggaagtagcaaccaccaaccaccgacggcggcgacaccgactgcacggtgtagaaccaccggaacagccgaagagatgggcgcaccccaatgaacatctcgcacagatgcgcgaagatggccaatgtcatcactgcgttgggggtaaggtgcgccatctggagatcgtagaactccagaacatccataaggaaagaagaaaatggcggaaccagccctgccattgcgaagggaaggaagaagacggaccgccccgggtagtctggtgctgggcgaccctcgcccagcatcactatctcccagccggtggcagattccggcatgaagcggcgcggcagcccggcctgcctctcgctcacgatgcgagaaggcggtagtacgctaccgtcgagcagggcggagccccgtgccatgacgccggaggaagggatgattgggaacgagcgcgtgtggcgaaggtagggcgcagcagagaaagagttagggcgcaagcggcgaaggcaaggggaataatggcgaaaggaagggagcaaatttttccctcggtatctttatacccttgccatcgctgtgcccggctcctcgtttctcgcgcccactatctcgctccctcgtttctcgtgcccatgcttccactaatcccattcgcccgcttgcggcgcgtgaggtggatatgcggttgtggcagtcgagatagatcgtatcgtgcgcgcgttaattacgctcgccaaccgaagcgacgttaccatatctccaggcgaagcaaatcggctcgccctgattcgtgcgctgctcaggtgatgtggcagtcttgaagagactgcccattattgacagccaagttaccattgccgatgtgcatggtttgagaccgttgggtttctgcccaaccatggagaccggtcccacctgtcaccaggctttaggagtggcgtcacgcccgaccgcttcccttgagaagggcaatcgccctggcacaacgccgggggctactgtcggtgatatgggaccgggagtatcgtgaccagaggcttgaggcagacacaatcgcccacgtggcctgacaccctcggggacgtcgggcccgagggtgaggtgtccgccctcctcctgatttccccgaggggggtcgggttactcctgccccggccccgagggccgaggcgccccgaccccttgtgggttttttgcgtcacatgtatgggttaggtgaacacggca

SEQ ID NO: 37591 - DNA, 2464 bp, Oryza sativa
  unsure (1)..(2464): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttgagtgccaggttctacgcatggttcggcatcgcaacttgataaggatactaagcatatgctccaacttagatttcaaagcactgctgcttcagtatatgcccaatggcagcttggagacgtacttgcacaaggaaggccaccctccactaggattcctcaagagactggatattatgcttgacgtgtcaatggcaatggagcaccttcactatcatcattctgaggttgttttgcactgtgacctcaagcctagcaatgtgttgttcgatgaggagatgacggcgcatgtggcagactttggcattgcaaaattactgttaggtgatgacaactctgcagtttcagccagcatgccagggacaataggatacatggctccaggtacttgcacttactattcatgagaaatttgttttaccatttgagttctgtaacagagttaatttaatttgtttctttctctctttttttgaaaaatcattcgttgaacagaatatgtatttatgggaaaagcatcacgaaagagcgatgtgttcagctatgggatcatgttgctcgaagtcttcaccgggaagaggcctacggatgccatgtttgttggtgacatgagccttaggaagtgggtttctgaagcatttccagccaggcctgcagatattgtggatggtaggcttctacaggctgaaacattaatagaacaaggtgttcatcagaacaatgcaacctccttgccgcgctctgctacctggccaaatgaaggccttcttttgccagtattcgagcttggcttgatgtgttgcagtagctcacctgcagaacggatggaaataaatgatgtggtcgtgaagctcaagagcatcaggaaggattatttcgcttttacaggagcaatataaaattagcatttgagcgcattttgtttatctatattatatgcggacactatctcacttgctagtagccacaattattctcaagtaagactcattcgagcctaaagtactgtatcgacatataaatgaagagaatttttactgtccagcaggtggaggcggtaccaaatacgtccgttgggacagatctaatggctgaaaatcgtcagtatcgtgaggtaccgtaaatcctgtgcgatgatacctcttctccatccgcatgaattgagcaggtggaagggtagaactggatttttaacttaaatttagagttgattttgaggttttttcatcgtagtttatttttcagcctttacttttagatctatatgaacacatatataaaagttttaatttacaaattattttctatttgcaaatatgtcgtttcgcttattcgaaacgatggagtccttgagtttttttcgaatgtgaaaccagattactttctactacaaataaacaccgtagttttttttcaaaaactatactttgatctaatttctttttaatgttatcaataactacaaaattagtataacatgaaagtattttaaaatacacatataatgatatgatatgcatgacagtaagcatataaaataaactagaagttgaataaaaaaacgtttgttcgtcccacttgcatcagtacttctcctagtaatattgatttgttatctttaacttaggtggcgtttagatctagggagtaaactttagtccatatcatattggatgttttgacactaatttgaagtattaaacatagactacttacaaaactaattacacagatagaggctaatttattgagacgaatctattaagtctaattaggccatgatttgacaaggtagtggtacagtaaatatgtgctaaacatggattaattagttttaatagattcgtctcgcaaattagtctctatctgtgtaattagttttttaagtaatctatgtttaatactctaaattagtgtccaaacatctgatgtgacaacgactaaactttagtctctagatccaaattaacaccaccttaaactcagtactccctcggttacagagcatgtcattttaaacacgcatgttttaagtcgaaaaagtatactttgactcctttaactatcgtctgagtatgattcatgacctccaaccataaaatcgggtatatcgactcctttaactatcaaaaccggtgtaaacaatatccctcgctggttttgg

SEQ ID NO: 37592 - DNA, 2238 bp, Oryza sativa
tgaatcggtacaattaagcatcaactgcaagagtttactatcgaatctctgcttcatcaatcaataataagattgccgttgattatacaaccgtcgttgttgatttggacaagagaaatctattatttgtgcgggcctcatcagtacagcagcagtggtcgttcgactcgccgtcgcacaggcctccgttgaaccccttgatttggcagtcactcatgcacttgttcatatcgcaatttacaaggaccatgcacgaatccatttctccatatccacctatatatatatatgcacatgtaaaatacatatttttagaggaaaaatcattatattgttaatgaccccgacttttacagagagccgaaatagttcatacagaaaatgtaaaatgcatatatacttgtcaggctatatatcagattattccagcatcattgatcactaatcatttcatgcaaaagagaacaaattaaactgtttttgcatttggatgtgatcaatcgagaggtgtatatatatatatatgtataccttgtgtagtatgaccggatgagaaatttacggtggccatcaccataagagatgtgaagaagaacactgctgcagccttcttgttgagaatttgcgccatgatgagatgagatgagaggagatccttttgacaaggaagctactgcatatgctggctactacctggcccctagcttcattttgcagctgtttatatagagtcacaagagcaaatcttggatgattcattagtaaattacctccattattatgcattaatgacgtgtgtgaggtttcattaatgaccgtttctcaaatttattgcatgagcatatcgtttcaattaattttgtttctatatcattttacctatgtcgtcgtttagtgtccacctctacaaaatattccattgttcaaacaggcctaaatgtacgttgagtcattcgaatgaaacaaaagcccattacaaacataggcccatgggctataaagcatgtcaggctaccagagaagtccacgacaaaggcccaatgtttacaagcaaaccacattcctttttcaggtcagaatattcctttttttttttgtttcagccagaaataagaaaatacaaggagcacatcatctactttcattttcatgatggaaatttattgaccagcagttcaatcacatttttaccccaactataaattgttgcagaacctgaagcaccatagatattgaagttttgggaatttttctctagaagcttcactacttttttcatttctctaactctgctatatacatgtacatatgagtagtatatgggcctcatgggccaacacatacataactcaacactccccctcaagatgggcgatagatatctatcatgcccatcttgttacatgatgaagtacactccccaacacttaaagcttttgttaaacagtcagctacttgttcccccgacataacaaaacctagcttcaaaatcccttcatctagtttttccttgataaaaaaacgatctatctccacatgttttgttcgatcatgctgaactggattgttagcgatgctaatagccgacttattgtcacaccacaacttcatgggaatattcattagcaactttaactcagaaagaagatttctcaaccataacagctcacttaaactcactgacattgccctgtattctgcctcagcagttgagcgagacactaccggttgtttcttgctcctccaagagaccaaattgccaccaacaaatacgcagtaaccagaggttgacctcctatcatcaaggctgctagcccagtccgcatcacagtagccctccacacctagatgtccatttttcttgaaccataagccttttcctgggctcccttttaaatatctcaggattctatatactgcgtccatgtgaccacttcgagggtcatgcatgtatcgactaacaacactcacagcataagttatgtcaggtctggtatgacacaaatatatcaatcgtcccacaagtctttgatatctttctttattcactggatctcctaattcagcacataacttatgattttgctcaattggtgtagaggcaggtcggcaaccgagcatacctgtgtcacaaagtagatccaatacatactttcgttgtgaaagaactatccctctaggagatcttgcaatctcaatgcccaaaaaatatttgagctgaccaagatctttgacttc

SEQ ID NO: 37593 - DNA, 17100 bp, Oryza sativa
tttccacggtgacgataaaacaaggtatggtctccattgcactgtttgtagcccatgccacacattgcacgtctaaatctatcaaaccaagcccttggtgactgctacctggcccctagcttcattttgcagctgtttatatagagtcacaagagcaaatcttggatgattcattagtaaattacctccattattatgcattaatgacgtgtgtgaggtttgattaatgaccgtttctcaaatttattgcatgagtatatcgttcaattaattatttttctatatcattttacctatgtcgtcgtttagtgtccacctctaccagcgcaaaatattccagtgttcaaacaggccttaatgtacccatggggtatgaagcaaaagcccattataaacataagcccatggggtatgaagcatgtcaagctaccagtgaagcccacgacaaaggcccaaattaatgtttacatgcaaaccacattcctttttcaggtcagaatattccctcttttttttttgtttcagccagaaataagaaaataaaagcagcacatcatctactcccattttcaatcacatttttacaccaactataaattgttgcagaacctgaagcaccatagatatattcaattcaaccgtaaacacatagaagcaaagggtaattgatcactgggtatacactgatgctattcctaatacagaagaaatggatgcaaaggatatatatatttcattcgctcatataccacgagagagcgatgaatcactgctgcacaacgctcactgtggttgccatcaatttgacatagtcctttctaatcttgttcagtgtcacgaccacatcgctcatcgccatcctttgctcgggggagtcagccgaacagagcaagcccagctcgaacactggcacaaggaagtcatgcatgttacttgaagaagaagaagacccatcctgtagaagtttgcagtccaccacatggacaagctctgcaggaaacgcctgttgaacccactgcctgatgttcagttctcccacaaacatagcatctgtgggtctcttcgcagtgaacacttcaagcagcatgatgccgtaactgaacacatcactcttccgtgatgcttttcctagagtcccttactctgctcaagaaaaattagacaccaaaaattagttgcaccctatctactcaataataataaaagatcgggcaaagtttgagaaagacaagaaaaactattaagtacctggtgccatgtacccaactgttcctggcatgctagctgagatcatggagttgtcatcacctaacaacaaccttgcaataccaaagtctgccacatgtgccgtcatatcatcgtcaaatagtacgttgctaggcttcaaatcgcagtgtaagaccacctcatagtgctcatgatgcaggtattccattgccattgacacatctagcataatatccaacctctcgagaaagcctaattgcttcccttgttctgagtgcaggagtgcttctaagctacccttgggcatgtactgaagtaccagtgctttaaagtccaggttggaacaagtgttcagaatctttatcaggttgcgatgtcgagccattcggagcacacgacactcggtgtcaaagcttctcatggcatgttccagatgctggtgtataacttttatggcaaccaccataccgttgctcaatcgtcccctaaaaacttttccaaagcttccgaagcccaacatgctatcatcgctgaaatcatcggtggcacgaagaagctcttgcaatctgttgattatagcttaccgggtcagggcttttgccccaatctgttttcgacagcatactgtcgttgtaagctctttaattgtattgtacccttcatttcttaatgaaattggtcgaccgaacctttcggctgacccggcaaaaaaaaaaaaagctcatgctaggagagcaattgatggctgataaggtcagccttaccagcagaagtattttgatggttagctttctttctaatcactacatacaggcaacaagctacaattcaactactatgattatagtaggtagcaaatattttagcatgtgaccattatttctgttgggggaggtggtttggcatggtgggaatcctaaacgggcagcaccacatagccctgagtttccttccaagtattgtaaagtgatgtttgcaaagacacctccttccggtatttgaccatgtagtttgttgaaagataggttcaagctaacaagggtcgtaaaattagccaagtagtttgggatggtaccagaaatactgttatgggatatgtccaaagtttgcaagccagttaaattaccaaaagagtctggaacagaatcatagaatccgttagctgatagattcaggtgtgttaacatctgaagttgtcctatcgaatatgggattctaccagaaaagtggttgtcagagagatccatgatggtaatttgcttcaaataccctacatcaaccggcagtgcaccactcaagaagtttcgagaaagatctagcctgacgattttatcaagatgaaataagcttggtggtatagttgacgttaatttgttatcagacaatagaaggtgctctagattagtgaggttcctcatgtcctttggtatggagccagaaatttcgttgctttcaaggaacagttttacaatgttccttagaagtgcagtattcgatgggatgaagccagacaagctatttccacttaggtcaagccattggagattctcaatcgtcatgattgattctggaattgcattgcgcagttggttatgtgaaagatctatcacctcaagagcagttaaatttgaaatggtagctggaagcgtgccagttaacttgttgttagataacgtgaaccatttcagctgtgacgacaggttcccaacatagtctgggaggattccggtgatataattcaggtccatttggagggtagaaagcttcctacaattggaaacagtagaaaggaagttgagatccccgtgtagattgttttcagtaacatcaactgccgttagtgagttcatgctatcaactgtcgatggtaatgatccatccagcaagtttcctttcagtagcaggattgccaacgatgaaaggttgccaagagaagcaggaataggtcctgttagttgattcatcgcaagatgcaaccatgaaagttggcctaggtgcccaatatctgcagggatgtttcctgttaggttgcacgtcgtcaaatctaagactgtcagcatggtgaggttgctaagttcagtagggatggggccagcatcaaagttattcccacccaaggagatggcatcaagattggtcaacctgcccagccatggtggcaaaacaccctcgaataaattataaggcatggcaataacttggaggtatggacacgctgcgagccccagtggaatctgaccaaagaaattgtttttactgatggcgaaccatcgtagaactgggaggctgaaacttgtattaccagggatagggccagttaaaccattcgatataagagaaatggtacttaatttagacatgttgaagatggctggtggcaccgccccagttaagttattggcctgaaagttaaggtgttggaggattggcaaggaaccgatgcaacccggtatcagtcctgacaggctattgttaccaacgttgagataagttagcaaaggcgtgttgttgaacagatcgtccggaatcgatccagtgaggtaattgtgacggagattcatgctgccaagactgtgcaacccctgcagctctgctgggattggaccgtatagctggttaaactgtagattaagtagctgaagcctcgtgaggttccctatggcgattgggatgccaccagacatggcattgtggccaagatcaaggagctcgaggcgatgcagccttcctatttcgttcggcaccgagccagcgaggccggtgttggtgaggttgaggatgaagagaaaagaaatgttaccaaggtgagagctgagttctccttggagcggtgacgcgctgccgccggcggcggtggctgctgcacgagacacccacccgccggcagaacggcgttccggtggtccaattgccggcaaggatgttgttaggatcggagagctgggctttgaaggccagcaatgcagcgaggtcggtgtcgctgccgttactcttgctggcgatcggacctagagagggagcacaaggcacagtactggacgaagcgattaacaacgccgcaacgaaaatccatactggcaatcgaacaagagccatgtctggttgtgtgtgatgcattggcagcaagagtatgcatcatacttcacagtgacgatcaagttgagctttatttagcacagtagtgctagtttgctttcgacatgtaggacgaccttgactgttgctctcagaaagcgaaagaaacttaaatgatactccttccggtcataaatatttgacagcactactaggtaaacgctggaaaataaagacatcacaaaatatatattcagcagatcgcggtgtgcacgacacgctagatatgatagctgtgtcgctccgtcatcagccataggctcactgaaattttttttttctgtcaaacaatttgacggcaacggccttacgtactcttttgttgattgggtggttagaacggcaacgattgtgtagttagagcaagtttaatagtatagcctgctactagcttcaaatcatctatagctaacgtaatagacaattcatacaatagttgtttactatactattaatatctggtctcacctgttatacacacattacgtcttgtaatccatgctgcagctgactacagatatgtaatctgctgctcttctctctcttcctttatttctttaaagtatgattatagctggtatatagcctacttttgtacttgctcttaagcagtttcaatagtattgctggttgccagctccatccatgtccacattaactagagtaagctagcagttaatctcgagatgtatttctttttcttgtgggacccaactgactagcatctttcattgcattcatctcactacttgtgggcctatggccatttttaaaaattgaaaattcctacctcgtagactttttcaccttagagctcatgtagagctggccgactattgtcacccgttcctactaccttttttcttctctgtcctacagcctcgttagttttactgagatggctatcggttattgtacccgctctcatccggctttctgatcttttttgcgtgcatgacagcctgaagatgtgctctctgaagaccctgttgtcttgtggaccttttgatgttctgttagcctggaaagcttgttaagtttttctgcttaggtgtaacgacccgcctctcccaggccgggcccacttacatcggtagcttttataggtcatagaatgccctcacaccacttacatctggcagcttttataggtcatagaatgccctcacaccacttacatctggcagctttcataggtcatagaatgccctcacagaccaacacatgtcttttctgcaacactttgtcctcactcgtgtgcacccgggaagaatttcccggtcggtcacccatcccaaattgcttcaggccaagcacgcttaaccctagagttctttggagattagcttccggaaaagaagttgcaacttgttgatatgagtattctattaatcttattaagccctaggccgggatgttacacctgtcacgccccgaactagccccgaccggaactagcccgtgacgctccaaattaacctgttaatcgataccagtcccaggaaacagtgctggtatcacaagaagacagaatatcacagcaacagaggtctctttattatagagtaggagtacagtcatgttgggctgcggacagatcccgagctcacaactgcattacaaaagggaagcagaagccaagacttggaccaaacatcacaggcgcgacttgggaactaggccgaaaccctaaaactcatcgtagccggcttgctcctggaagaactcctcgtcaacgggatccgcttcatcttcttcagcaactggggggttatttatatagagcaagggtgagtacagcagtactcagcaagccatgggaaataagtgtttaatgcaggcttcaaagaaaggctgttgtttttgcaattgattttatttgaactcttttctgaaacaatctaagggagtgcttctcaaatgacacggatgagacagtgcgtctcgtccgatcagagtatgtgcaatgtatcagtcttttaaattgatcaagattggcacccggccaacagctttcaaacggccacccaggtctggctgatctcatcagccgcagattttccaaccatcaaacccattccacaacagcaaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtccggagacctccaagctttcatgacaaggcatttcgaaagccgacacaggttcaccatatgccaacgagaggggtcccagaccaacaccagattaggtcccagaccatactatgccaggaagcccaggggtcctccccgacaccaccccgacgaatccacatgtctctcggcatcaaggctcccctgataagctagttactcagccaggggtgtcccattccacccatgtggtcgtacttgtcttatgttcggatgaaaattccaaggaaacggtccttaagtgcaagagcgggaaaccgtacacccggtacgttccccggtccgcggtgttggaaattcatttagttcgcaagcaccgacccaggtgtcgggttttccaagtcttttgtaaaacccaagttttacccaagatgtttttcagattttaagtttgaaggcgaccgtcgatactcgtgcaaagtgcacgatttccgaggcgcaactgggtggttacaagggaatatggtataacaattaacaaaggaaggatcaaatgcaacaaattaggtaggtccgccaatctgccttgcagacgagacaagcagattaagtgcgatcctatcaatgcataatatttttcaagcaacatatttaagttcaaatataggctcaagatgttcaaaggtggcttgcctcgctcgagatcttgagcttgatcctcgaaatcctcgcactgcaggtcttcgggcttcgaaactacacgcaaaacgggacaactcaacaaacggcgaaaataaagccctattaatgacctctaagcgtgccattagatagatctcgagatttgacgaattttggaagttgaacggagtcaaacggatttacggttgggaagatattgaatttctaaggttattggatttttggtctaaaggaaaaggatttatttaaatcctttttgaaaaagaaaagaaaagaaaagaaggagggagggaaattagacttccctcgggcggctagggcgtggcccgagagaaaggggcggctcggccgagcttaatgggccggccggcccaagaaggcggcccaaggcacgcgcgcaggcggggaggggagagagagagccggtgggccgggtccatcccgcgtggtcccgggtgggacccgcttgtcggtggctcggctcaccgtgcggagggagcacgcggcgcgcgctagggttcggggagagaaacgcggtgcacgcgcgcggttcgcggaggacgcggatgcggcgggcccacgcgcagcctcacgtctcgcggtggaccgcgcccgcgagcgtggtcggagggagcggctggccggggtcggctcgacccggtcttggccaacctggcgccgacgtggtgcctacatggctgccacccgggccggcgggaggtagacgacgatgtcggccgaaacggacggcggatggcggttgcaaaagacggggcgacccacggcgatccagcgaaagcaagcacaccgggtggttgcacgagacgaggggagacgacccaacggctcggattcgccggagggagctcgacggcggggattgcgatggcggcaaccgccggcgagggaagggggaaacggcgatgaggtcacgatgggccgattcccggcggtgagagcatctacgcggctacgggaatccgttgctagtgtcggattgggtggagcgacgccgagcgaggccggcgacgagcaggcgttacggagcacgggcggcgacggcggcgagcacacagcgagcggcggcaacggtcggggcggcgccagctagctacgggaagactacacatgctactaccgaaaactaaggggaggagatggaacgaggagagtgaacggaggaaggcactaccgagatgaggcggggcgctgtgacgagaggccgacggcactggagtgatctctccggcctcgggccagggagaggaaggagagggtgcgtccggagtccccttccgcgtcctaacgcgcaccggctcctccggcacacgcgatggcggcggccggcgagagagacagcaatggcgcgggcgagaaacggggaagattgggaggggaaagaggaagggaggcgcttgggtttatagggcggcgatgtcggtttggaaaccgaccttgggcggtcaagggagcgagctggcgctcgtcgctcgtggccaaaacggcgacagaggcggatgacgccggtggggaggggaaaaggaaaaaggaagggagaaagggagcttgccccttgccactttgggaaaagaaggagggagcgggggcgacgcggcagagggaggaggagctctgcctccgtcccttggaggctagcgcgtggagtggcgggggccgggttgtgacgacggcgatgacggtgggggcggtgtggagcggagcggcgacacgggcgacaggcgcgggcaggcgcggcagatgctgacggcggcagcgaccaggcggtcggccaccatggcgcgcgcgcgcgcgtaaagcaacgggcggcgcggcgatttcggcggcgtcggcgggaagcggcagcgagggaggagggcgctcagctcggcgcggttcacgcgcacgcgtgtgcagcgcacgggcagagcgggggagagggggagagagagagagagagagagggagatgggccgagagggattcggcccatcgaacccgagggaggcgaaatagacttttgcggagggatttgatttgggaaggatttggattcgggattgaactcaacgatagatcggggatctgagatctgagatggtacggacactagtcaacaagcaaagaaacggatttcgcaaatagggtttttaagagatagttttcccgctaggcgccacgacggaacgggcgctacattaggactgttaattgtggttgtttaaggctgaatgagccggagttgtgatgctgtgccgataatattccttttttatttatttattttggccagaaataagaaaacataagtagcacatcatctactcccattttcgtgatgcaaatttattgaccagcggttcaatcacatatttacaccaacgaaattgttgctaaacctgaagcaccatatatatatatatagagtattcaattcaaccatacacaaatacaaacaaagggtaatcgatcactgatgctattcctaatgcagaagaagaaaatgatgcaaatgatatgtatttcattcgctcatatacaacgacagagcgatgaatcactgctgcacaacgcttactgtggttgccatcacttttttgccgggtcgggtggctgccatcaattttttttttaaaccgtagccaggctaacttagagttatattaaagagaataaaaagtatttacaatatcatcaaggaaggaaggtgaaagagagagaaaaaagaaaacatgaagaaaaatagaaaagaaacacacactaaataaaatgaaaatctaagcggatattctcgcaatattttttgccccacacatgcgccataacttgacatagtcctttctaatcttgttcagtgtcacgaccacatcgctcatcgccgtcctttgctcgggggagccagccgaacagagcaagcccagctcgaacactggcacaaggaagccatgcatgttacctgcggcggctacacgatacaccaacccactggcagaacggcgtgccgacggtccagttgccggcaaggtgaaggatgttgttaggatcagagagctgggctttcaaggcaagcagtgcagagaggtcggtgtcgctgctgttgctcctgctctgacctagagaaggagcagcagcagcagcagccacagtggatgaagtgatcaagaacaacacaacggatatgcataatattggagatgcaaactccatgtttgggctctgatgcattgccaagatgatggttgcattgtttatggggattatcggcttgagatttatttagctctccattcctcttgtgcatgtatgtatgctgcatccaaccatctatgaccttcaacatccaagactttgactatcagtcaacctgaggtcaacaattgcaggaaactacattatgaatcttttttttttctggaatacttctttgtgcacttttgtattaagagactgtgaaccttatctagctcctgtactgttcccattttaaaagggggtgaaggagaccttgatgaaaagaggccaggattaggatttgtagttgggtaccaatctgagccgttggttcttgtcgccgggaacggagaggagttcgccgccgccgccgccgcgggctccctgtcctacccaggaccctgccaccgctcccacctcttccgctgccaccatctccaccaactgctcatgcggcccccatccccctcttcgctccgcccagtttcaagtcgccgccaagatccaggacctcctcgacgcggcgcgctcgccggagtcagcatccccaagatgctgggctgctttcagtccctgatgaaggatttcaaggtatttgatctctgacaactccatgaaaacgtgtctgcttttcacaactcgtatgctgatttgaaccatctcctgtctcttcacatcctaatcgtggtagctaattggcgtgattcttcacttatctatctatctatctatctatctatctacccattggttgattaattcatctagatatttttgttcttaccaaagattatctcttggactgttgcgtactcgttgatttcggtatcatcgatttgtcctaaataataagaactataatcatatttccatttcccgtttgggcagtgtgttcattgttctctccatttcaatgttataaatcaaacattgcaaatcgtaaacaagatagtaatatataaggaaaactatcctgtgacctatgactatgagcgtatctatgcaacagatcatttcctgccatgtcatggtgcaaatttatgtagcagcagatcaatcacagatgtacgcaatttaactattgtgtaactaactaagaaacagaagagatttattcatattcatccatacacataaagaagtaaagagtaattgatgctattcttctgttattcttaattaatgcagaagcaaatatggatgcagaggatgattcgttctttcgtatacgcagtcaggcagggtcaatggaacactgctgtttggttctcatctcttcccatagttgctatcgacttgacgtactccttcctaatcttcttcaacgtcacaacaacatcactcatcaccattctttgctctggcgagtcagacgagcagagcaagcccagctcaaacactggcataagaaaggcatcaatgctactggtagaagaagagctgtcctgtagaagttggccatctacgacatggacaaggtttgcaggaaatgcctgaagaacccactgcctgatgtttagttctcccacaaacatagcatctgttggtctcttcgcagtgaacacttcaagcaacatgatcccatagctgaatacatcgctcttccgtgacgctttaccaagggccccgtactctgctcaagaaaaattggtcaccaaacattagttgcaccacttgataattactctataaaagatcaacaggttttatcaagcacaaatgcgactaattacctggtgccatgtacccaactgttcctggcatgctagcagaaatgatggagttatcatcacctaacagcagccttgcaatgccaaagtctgacacatgtgctgtcatatcatcatcaaatagtacgttgctaggcttcaagtcacagtgcaggaccacctcgcagtgctcatggtgcaggtattccattgccagcgacacgtctagcataatgtccaacctctcaaggaaacctaattgcattctttgatcagagtgtaggagtgcctctaagcttccgttgggcatgtactgaagaaccagtgctctgaagtccaggttggaacatgtgttcagtatctttatcaggttgcgatgtcgagccattcgaagaacacggcactcagtatcaaagcttctcagggcatgttccagatgctggtgtataacttttatggcaaccaccaaaccgctgctcagctgacccttaaaaacttttccaaagcttccagaccccaacatattatcatcactgaaatcattagtagcatgagcaagctcattatatgagagtaattgatgatttatagtgtcaaccatatcagcaggattctcttgatgcttaactttcttcctaatcattacatataggcaacaagctacaactccaactgatatgaatatagcgagaagtaaatattttagcatttggccatttcttttgtgagaggtttggcacagtgaaaatcctaaacgggcaacaccacatagccctgggtttcccaccaaggattgtagcgtgatgtttgtgaagacacctccttctggtatctgaccatgcagattgttgaaagacaggttcaagcttgtgaggatggtaaaattggccagatattctgggattgtacccgaaattctgttgtgagatagatccaaagtttgcaagcctgtcaagttgccaaaagaatttggaatcgaaccatcgattgaattggttgataggttcaagatggttatcatctgaagttccccaatcgaatcagggaggctcccaagaaagcggttcctggatagatccatgctgtttattcgcttcagttggcctatatcaattggcaatgcaccactcaagaagttttgagacagatttagctggataaggctttcaagacgaaataagctgggtggtaaagtggatgataattggttattagataaccttaggatctctaacttggtgaggttgccgatgccctttggtatggagccagagaatttgttgccttgaaggaataaatgttctgcattctttagcattccggcatttgatgggatggagccaaccaagctatttccactaagatcaagctcaaggagattctccatctccatgattgactctggaattgccccttgcagttggttgtctgaaagttctatcactctaaggccagttaaattcgaaaaggaaggtggaagttgaccagttaacttgttcctatgtgatctgaattcttgcagtgtacctgataggttcccaatgtaatctgggatgcttccagtgaagtaattcatgccaatatagatccaggaaagatttctacagttggaaaacgtagaaaggaagttgagatccccatgtaaacggttttccgagacaataaagtctgttaaatagttaatgttccctattgatgctggaaccgatccatccaactggttttcgttcaataccaggcgtgctaatgaagacaggttgccaagagaagctggaatcggtcctgttagttggttccctaaaagttgtaactcccaaagttggtctagctgtccaatatccaccgggatggctcctgttaggttgcaaccgttgagatctagtgcagtcagcatggtgaggttgctaagtcctgcagggatcggaccagcatcaaagttattccaactcaaggtgaggccagtgagattcctcaacttggacagccatgatggcaaaacaccctcgaatagattgtcatgcatggaaatggtttgaaggtatgggcatgctgccagtcccattggaatttgaccagtaaaattgtttatactaatgtagatccgttgtagtgccgggaggctgaaacttgtgttgcccgggatagggccagttaagccattcgaggcaagagcaataacagttaacctagacatgttgaagatggatggtggcactgggcctgtgagattattgtgctgtaggacaagccactcaagcatgtgcaaggagccgatgcaacctggtattggtcctgacaggctattgttgcccatgatcaggcgacgcaatgaaggcgtatggttgaataggtcgtttggtaccaagccagtgaggtaattcgtctggatatttatgttgataaggctacgcaggccctgcaactctgttgggattcgaccagatagctggttaaactggagattaagaagctgaagcctggagaggttccctatggtggctgggatgccacctaacatggcattgtggccaagatcaaggagctccaggcgatgcagccttcctatgtcatccggcaacaagcctgtgaggccagtgttggtgagattgaggacggagaggaaagataggttaccgaggtgggagctgagctctccttgcaggggaacgttcggcagctccagggcaacgacacgctgctgatggcggctgcacgagacgcccacccactggcagaacggcgtgccaggggtccagttgccagcaaggatgttgtcaggatcatggaactgcgctttgaaagccagaagtgcagtgaggtcagtgtcgttgttgctgctctcggtcagacctggagaagaagcagcagacacagtggacagggggatcaacaacaaagctgataagcatactagagatcctaaagccatgtttgggctctgatgcattgccaacaagatggcgctatttcaagggatgattggcttatatttatccaatacatcattccgctgtgcatgcagtcatcgccttcaattgtaaactcttttccctaccttgcttaatcaatcttgtcggcgtcaatctggttgctcggtgatgaagtcaaccaagaagatgccataatttcaggggatgattagcttgagatttattccactgctcaagtaaacatctgccaccttcaattataaattgttttccctccattgctcaataaatttgttggtatcaatctgctggtctggtgcggtgaagaaatcaaccaagaatatggcattattttagcggatgattggcttgatatgtattcagcgctcaacattaccctgcccttgcaaccacatggtatggtgccttcaattgtaaaatgttttcacttcccatatgctctataaatttgggtgtcaatccgcggccggcgaaaaagtcaatcaagaacatgacattatttcagaggatgattagcgctgagatttatggagttctccattctttgtggatgcaaccatctgggctccttcaattatgaactgttttccctccatcgttctatacattcgggcagtgccaatcggtggacccggcaaaaagtcaaccaatatgtcattatttatgattggcatgagaattattcagtttttctctatatctactgaacgtgtcattgttttgttgattgcatccatccggtgccttcaattataatttttttcgcctacattgtactccctccatccctaaatgtttgacaccgttgatttttttaaacatgtttgaccgttcgtcttatttaaaaaatttaagcaattattaatttttttcttaccatttgattcattgttaaatgtacttttatgtatacatatagttttacatatttcgtaaaagtttttgaataagacgaacggtcaaatatgttttaaaaagttaacggcgtcaaatatttagagaatgagggagtataaatttgggcagtgtcaatctgccgaccagcagccagaggtgaaaaggtcaaccaaccaagaaaatgtcactatatcaggggatgattgggttaagatttattcagctttccattaattatgccttgcatgcaaccatttaatttggcgccatcaattataaactgttttcaagggaataactagtcaatctaggcattctggtaaaagtatgcatctccgttgtctggctgtatagatggacatgtgttgacagtaatgttcaggttcagattatatgtatcctgattcctgaattgagtactacatccttcggttacagaaatatgtcgcccgccgtccgccggtcgccagcggttgcaatcttcacaatcacggtggtcacacgcctgtgcgtgagtgtaagacggaagcagatcctctaatatgaactccctactaacgtgatcactgataggtgggcccgcaaccgcaagcgatggggccctcatgtcagccaccatgttcctcttattttacttcagaggatcctaatccgtgtgagataggggtgaaaacgatatagaaactttccggattccagacttattttcgaaaacggaatctatcagtcgtaattttttcggaaacgtaaacgaattcggaaatattttctcggaaacggaataaaaaatgataagggcaattttcgctggaactcagaatcggtcggaaacttttcggaaatttttgtgactgaaatactctggattcttttttttaagcactaaatagtgaataccatgttatttggctgttattttttaaagagtaaatttcaaaaaactatacgttttgtggtccaagttgcaaaaaaccacccactttgacacttgacacttaagtacatatatttt

SEQ ID NO: 37594 - DNA, 15582 bp, Oryza sativa
ctatcaatgaaaggattcacccgcgagatgacgtggctgtttcacaaaggacgagggcgtggcatcctattaccagccatcgcacgaaattaatatgatatgccacatcatcatcctagatggaataactacgtcatcacacgggtgaatccattcatcgatagtgtggttttgtgaaactaaactaccaaaatatatgtacttaagtgccaagtgtcaaaatatgtgtggttttctgtaacttgaaccatgaaacatgtagttttgtgaaatttactcttttttaaaaaatatttgctatgcaaatatgatgttacataagaatatttttttcctgcagtgggatttaccaccagcattactctcttaaacatagataatttattccatagattgtgttttatgatgtactgttgagaattaacaattggacttatatgattgtgttttataaataattgttgaccgttgagacctgagaattggatttatcagtttgaggggttgttgtattccgataaattttcgttaccgtattcacgccggttcgttttcactccgttttcggtttcgataatattcaattccgttttcgtatcggggtttccgattccgaaaaaaatatgaaaacgaaaacgataaaagtggcagaatttcagaaaggaccattttgcaaatattacatccatatcaggtgttgtttcgtaaatttcagtgccgaaaatttaatgtcggttaaagaaagggatttttatgaaaaaacgtcaggaggaggaggagagttgggtaccaatctgagccgttggttcttgtcgccggagaccgccgcctctctctgacgccggcggcggcctccccgtcctacccaggactccgccaccgctcccatatcctcctcgtccacctcttccgccatcgccatctccagttcctccaccaactgctcatgccgcccccatctccagtacctcttcgctccggccagctgcaactcgccgccaagatccaggaccacctcgacgctgccgcgcgcgccggagttggctgagtggcgaccacccgcaacccaagctgctgtgctgcttcagtcttggaggaaggatggatttcagggtaatggtctctgcgaacccccatgaaaatatgtgcttttactgaactccaatgctcacttgaaccaactcctacccaacatctacacattgcttgatctcttcatctactagatatctttgttcttagtaatgattatcgcttggactgttgcgttccatttcccattgggtagtgttcgttgttctctccatttctgtgttgtcaaaaaaaaaaattgtgcaaattggaaagaggatatgaggaaggctatatatcctatgggccataacagagcgggcatgtcaggcaaccagtgaagcacatgtcttaatgtccagtgtttgcacccaaacttgattccttttctaggtttgcaatgttcttttttctattattattattattttcacctgaaagtaagcacattcaagcagcatccatcatttactcccatttttacagtgaaaattcatgaagcaaaagatcagtcatacatgtacaccaaacaaatattgtataactaacgaacagaagaaatatgttcatatttgaccataataaagatatagaggcaaagattaattgatcactggacatgttgctgatgctattctcttgttattcttaatgcagaagcagaaatggacacagaggacaattcattctttcgtatatgcaggcaaggccacgcttcctgtcgttgatatcgatttgacatagtccttcctaatcttcttcagtgtcacaaccacatcattcatcgccatcctttgctccggggagtcagctgagcaaagcaagcccaggtcaaacactggcacaaggaagccatgcaagctactgggagaagagcaatcttgtaaaagtcgggtgtccagtacatggacaagctctaccagaaacgcctggtaaacccactgccttatgttcagttcccccacaaacatagcatctgtgggtcttttcccagtgaacacttcgagtagcatgatcccgtagctgaacacatcgctctttcgtgacgcttttccaagagcaccatattctgcaggaataaaattggtcaatgcttattgattgcaccatacgataattatgaaaataccactactttgagcaagagtacagaagctgctagtacctggtgccatgtacccaactgttcccggcatactcgcagagatcatggagctgtcatcacctaacaataaccttgcaatgccaaagtccgatacatgtgcagtcatcatcgtcaagtagcacgttgctaggcttcaaatcacagtgtagggccacttcatggtgctcatgatgcaggtattccattgccattgaaacatctagcataatgtccaccctctcaaggaaacctaattgcattcttccttcagagtgcaggagtgcctctaggctaccattgggcatgtactcaagaacaagtgctctgaagtctaggttgctacaagtgttcaatatctttatcaagttccgatgtctagccattcgaagcacatgacactccgtatcaaagcttctcatggcatgttccagatgttggtgtataacttttatggcaaccaccaaaccgctactcagctgacccttataaacttttccaaagcttccagcccccaacatgttatcataactgaaattatcagtagcacggacgagctcttggtaggagagtaatctgttgctgatcatgtcaaccatactagaagaaatcttttgatgcttcttaactttcattcggatgactacatataggctgaaagcaaaagctccaactactatggttatagcagggagcagatattttagcatgcggccatttcttttggaagaggttgtttggcatgatggaagtcctaaacgtgcaacaccacataaccctgaattccccaccaaggattgcaatgtgatatttgagaatacacccccttttggtatctgaccatggagattgttgaaagacaagttcaagctaataagtatggtaaaattggctagatacttggggatggtaccagaaatattattatggaatagatccaaagtctgcaagctagttagctcaccaaaagaatctggaattgaatcatcgaatgaattaacagataggttcaagtaggatatcatttgaagttgcccaatcgaatttgggatgctaccagtaaagcgattggtagagagatctatgttgttaatttgcttcatattgcctatatcaaccggcaacacatcactgaaaaagttatgagataggtctaactggataaggctagaaagatgaaatatgctcggtggtacagttgatgataattggttatttgatagtactaggtgctctaacttggtgaggttgcccatgtcctttggtatggagccagataatttgttgctttgaaggaatagcttttcagcattctttagcattccggcatttgatgggacagagccagccaggctatttccactgagatcaagccaccggagattcaccatttccatgattgattctggtattgtactgtggaattgattatccgaaagtgctagcaccatgaggccagttaaattcgaaatggtagacggaatttcaccacctaacttgtttccagctacaacaaatgactgcagtgtgcttgacaggttacctacatagtctgggaggtttccagtgaaataattagagtcaactcgaaggaaagagagctttctacagttggaaacagtagaaaggaattcaagatccccctgtaggtggttttccgcaatatttaatccccttagcgagttcatgttaccaactgttgctggtactaatccatccaacatgtttcccatcaatagcaggtatgataatgcagaaaggttgccaatagaagcaggaatgggtcctgttagttgattcattgaaagatgcaactctgaaagttggcctaggtgtcgaatgtccaacggtatgggtcctgttaggttgcatgatgcgagatctaggacactcagcatggtgaggttgccaagtgcagcagggatcggaccagcatcaagtttattccctcccaaggagacgatattgagattcgtcagtttgcccagccatggtgggaaagcaccttggaataaattattaggcaggccaagaacttggaggtactggcatgctgcaagccctactggaattggaccagtgaaatcatttctagtgatggagaaccattgcagagctgggaggttgaaacttgcgttgccagggagaggaccagttaagccgttcaagccaagagctaaagcacgcagcgtagacatgttaaagatggctggtggaactgggcctgtgagattattgacttgcaggacgagagtctgtagtattggcaaggagccaatgcaaccaggtattggtccggacaggctgttgttaccaatgttgagataagttagcaaatgtgtattgttgaatagattgtttggtatcaagccaatgaggtagttcctacggagattaatactactaaggttctgcaggttctgcagatctgctgggattggaccagatagactgttaaactggagatcaagaacttgaagcctcgtgaggttccctatggtagctgggattctacctgacagagtgttatagccaagctcaagtatctcgaggcgatgaagccttcctatatcatccgggagtgaccccgtgaggccggtgttggtgaggttgaggatagagaggaaagagaggttaccgagttgagggctgagctctcctagcaaaggagtgtcccgcaaatctagggcagtgacgcactgccggtggtggctgcaagaaacacccacccatcggcagaatggcgtgccgactgtccaattgctgccaaggatgctgagaggatcactcagctgcgctttgaaagccagcagtgcagcaaggtcggtttcgctgccgttgctcttgctcggacctggtggagaagcagcactcacagtggacagagcaatcaacagcacaatgtatatccataccagcaatccaagcgccatgtctgagctcttatgcattggcacggcaggaataatcagcttgaggttaatttatttagctctccattccattgtgcatgcaggcatctggttctttctaaatctaagatgttgactattggtcaacctgacatgaacaagtccaactgtccaagcatgcatgatgatttttccttccctagtctaaaagcatatgagcacatgcaactttttccctttcccacttgtgactaaccaagaccttgatagatacaggacaaatagctatcagtattcttagaaaagattatctccctgactgttgcatactcgttaatttcggtatcattgacctgttctaaataatgactacaattttataaatcaaagattttgcaaattgtaaaaaaaaaaagaaatgaggaaaattatcctgcggcctataagcagagctggcctgtcaggcaaccagtgaagtccatgtcttatcttgaatgtttacacccaaacttcattcctttctaggttagaatattctttcttatgttggcctggacataaagcatattttaatagcagatcatttacaaccatatcatggtgcaaatccatgaagcagcagatcaatcatacatgtacacaatttaaatattgtgtaactagctaagaaacataagagatttattcatattcatccatacacataaagaagtaaagagtaattgatcattggacaagttgctgatgctattattctgttattcttaatgcagaagcaaatatgggtgcagaggatgattcgttctttcgtatacgcagtcaggcagggtcaatggaacactgctgttcggttctcatctcttcccatagttgctatcgacttgacgtactccttcctaatcttcttcaacgtcacaacaacatcactcatcaccattctttgctctggcgagtcagacgagcagagcaagcccaattcaaacactggcataagaaagccgtcaatgctactggtagaagaagagctgtcctgtacaagttggccatctatgacatggacaaggtttgcaggaaatgcctgaagaacccactgcctgatgtttagttctcccacaaacatagcatctgttggtctcttcgcagtgaacacttcaagcaacatgatcccatagctgaatacatcgctcttccgtgatgctttaccaagggcgccatactctgctcaagaaaaaatgatcaccaaacattagttgcaccacttgataattactctataaaagatcagcaaggattcagcaaaacagatgatactagcttacctggtgccatgtacctgactgttcctggcatgctagcagaaatcatggagctatcatcacctaacagcagccttgcaataccaaagtctgacacatgcgccgtcatgtcatcatcaaatagcacgttgctaggcttcaaatcacagtgcagaaccacttcgcagtgctcatggtgcaggtattccattgccattgaaacgtctagcataatatccaatcgctcaaggaaacttaattgaattctttgatcagagtgtagaagtgcctctaagcttccattgggcatgtactcaagaaccagtgctctgaagtccaggttggaacaagtgttaagtatctttatcaagttgcgatgcctagccgttcgaagcacctgacactcagtatcaaagcttctaatggcatgttccatatgttggtgtataacttttatggcaaccaccaaaccgctgctcagctgacccttaaaaacttctccaaagcttccagaacccaacatattatcatcactgaaatcattagtagcacgagcaagctcatggtaggagagtagttgatgactggccatgtcaaccataccaacagacatcttttggtgcttaactttctttttaagaattacatgtaagcagcaagctacagctccaactgtgataattataggagggactaagtattttatgatccgatggttttttttgggagaggttgtttggcatggtgaaaatcctaaacggacagcaccacatagccctgagttcccaaccaaggattccagcgtgatgtttgagaagacacctgtttctggtatttgaccatgtaggttgttgaaagataggttcaagctggaaaggacagtaaaattggccaggtattccgggatggtaccggaaatattgttgtgggatagatccaaagtttctaagctggtaagcacacgaaaagaatctggaattgaattttggaatgaattgactgataggttcaagtaggctatcatttgaagttgtgcaattgaatctgggaggatgccagtgaagtggttgctagagagatccatgatattcatttgcttcaaatagcctatatcagccggtaatgcaccactcaagaaattgtgggacagatctagtttaacaagtctatcaagatgaaataagctcggtggtacagtggatgctagttggttatcagataaatctaggtattcttacttggtcatgttactaatgcccatcgatatggagctggagaattggtttgttccaagaaataatctttgaacattcttcagcacgccgatatttgacggtatggggccaaacaagctattttcactgagatcaagccactgtagaatctccaaatccatgattgattctgatattgtactgtgcagttggttatcactaagatctagatacttgagactagttaagttccaaactgtagatggaaggacaccggatatattgtttcgacgtgcgatgaatgcttgcagcgtgcttgatagattgcccacatagtctgggaggtttccggtgaaataatttgagtcgatttcaaggacagaaagcttcctacagttagaaagagcagacaagaatttaagatccccctgtaagctattttcgaaaataacaaagtatgtcaaagagttcatgctgccaactgttgatgggacagatccatccaacaggtttgtgctcaaatccaggcgtgataatgcagataagttgccgagagaagcagggatgggtccccttagttgattccttgcaataagcaaatctgaaagttttccaagctttccaatatctgctggaatggttcctgttaggttgcacgtgctgagctctagggaagccagcatggtaatgttgcttaacgcatcagggattgaaccaccatcgaagtgattctcacccaagttgagcttgacgagattcgtcaacttgcccagccatgatggcaaagcaccctcgaataagttctgaatgagggaaaaaacttggagttgctggcacgccgcaaacccctgtggaattggaccggtgaaattgttggcatcaatggagaaaaaccagagactcgggagtctgaagctttcgttgcctgggatagggccagttaagccgttcaaggcaagagcaataactcctagcatagacatgttgaagacgcctggtggtactggtccggcaagttgattaacctgcaagtcaaggaattgaagcatgggcaatgagccgatgcaggctggtattgatccagaaaggctgttgttggcaatgttgaggtaagataacaaaggtgtgttgttgaacagactgtttgggatcgacccagtgaggccattgttctgaatgttgatgctgcgaaggctgtgcaggccctgcagatcggctgggatttgtccagagagctggttaaccgcgagacgaagaacgccaagcctcgtgaggttccctatggaggctgggatgacccctgagagggcattattgccaagatcaaggagctcgaggcgatgcagccttccgatatcgtctgggattgaacccgtgaggtttgtgatggtgaggttaaggacggagaggaaagataggttaccgatgtgagggctcagctttccttggaggggaactccgggcagctccactccggtgacacgctgccactgccgccggctgcaagtgatccccatccaccggcagaacggcgtgccggcagtccagttggtggcaagaatgttgtagggatcggagagctcacctttgaaagccagcagcgcagcgagatcgctgtcgctgccattgctcttgctcgtccctggaggagaagcagcagcagcagcaaccacaggggacaaagtgatcaacagcagagcggacatgatgatgcatactggagatccgagcgccatgacgacgctgaagtgatgcttttgtggcaattaactttgcaacaagctaagaactaacaaagcattatatgtatttccctcctcctgattggctgactgacggtaatcaatgagcccttggatgttgttttctctccacatgtgggattgtggggcatgaaacttgtttctttcacactattgacgaatcaagaccttgacagatacaaggtacatatagctatctttgccgaatgagtcgaatatattgactgttgaccaatcatgcacgcaccggttttgattggaaccttgtttgagctttcttttttaaagctggatcaaaatatcgtcacaatccgctggtggaattagaatggcaaaaatgaaccgttctgtctgattgagatcagttacagcactggaatattcacttgctttgggttggttggtaaaaccacctgagttaacttgttgacaagctgctctacagttcgatccatggcgtctgcactagagcgaataaggtaaatttgacagtgaaaccatttcttgcgttcaaaaaaaaaaaaggctaaaccatttcagtcgcaagaaatctattctgatgggcaaggcaagaaactcttacatgattgcgtgacagaaatacatgttatgatgttaaattggtaattttaccatccttaagaagataccaagagataccatattttctaatgtaaaatttggtatctttaggtactaagtatctcaaggtataatttagataccttgatgtacttttctaataacggtaaaattcttctttatagtaatgtttgtacaaatatcaatcagcatgatgctgcatataactcgctagaagatttacatgggccggccccgagagcaatcaggcactgggcctttataacggcacatgagatgacggcccaaataattcaggagtaaaaaacggcctcagggccgacgaatcgaagcggtctgaaaaattcaggagctgttttttaagattgcgtggctagtatcgttatatttttttttatataatagcacatatatttttatattttattattaaaatatatcaaaatgtattttatttttttaaaaatagtggagtgagtcgatcagacaaaacaaacgaacggaagaaaataacaaaaactaaatatcaatgtttgtgcattgaatgtattagtttctatcgattaacagtcggtcaaagaataataagctagctagagagagagaataattaatgtggacgaattaacttgagtaacatgcacataattaaacactacaggagttcattgcttgtgtcaaaattatgtgacgaagctttgtttcgtcactgtttatcgtatttgtaatgataaaataaggtttttgccactgtaatatcaatcattagtgctaaaatgttataagtcatcacaagatatagtattagtgacaattcttgagcgagaaattattagtattacatgtaaacaaaagacactacaataaacactgcaacggtaacaatagaaacggtgtaattaatactacaatgcggcgtcacgcaaactcaaaccaacgtgcgtgatatctgctgtgctgggtaacgagaggcaacaagctagcaaagtcatcgacggaccaactgaccgagaacctgaagatcgggcttgcattcatccagtcggcgtacgtgtaaatcgatcatctaggacgacacacgcgtgcatatttgctctctcaactgcttaagctccttgacaacatccgccatggttggtctcttctccaccttgtttttgagacaccggaccgcgacggccgccatcctgtcaaggcactccatgcagtaaggatacagtgcatctgtagacgacaacatgtcctggtcatacatcttcctcctttcgttgttgtctttgtaccggttgacaaattctattgggaggcttctcccatcgtcgtacttggcctttttccgggtgatgagctccaggagcacgaccccgtaactatagacatcgctctccatagtacagtacttgcccgtttgtatgcatacagggtcgacatagttcatatcagcacacacatgcttcattttcaatgcgagctcagatgacccaaagtcggagaccttagggataaggttgtcatcaagaaggatgttggctggcttgacatctccatgaacaacgctttggaggccagatgagtgcatataggagagagcctctgcggaaccaatggcaatgtcaaggcgatttagtagcgagagagtttgccgctcgaatccgtgtagttttttctcgaggctcccctgggggatgaactcaaagaccagcatggggacctttgtctgtaggcaacatcctatgagacgaaccacgttcacatgcctaataagtgattggatccttaactcatcaacaaattcttggccacgcgctcgcgatgatggaacttttgttggaacgagaaattttggccaacgaaaagcattttgtgttcgtgttgcaccctttgcgatggagtatttgacggcgacctgctggtctttgtaggttcccatgtagacttcaccaaaggcaccctgcccaatcttggtgcacttcccttttgttatactgtccagctccttctccgtgaatatagtaatgcccataccctcaagcagccggccaccgttattatcaaagaaccatctacgcctccatttcttttgcaagaacaaaagagcaagaaaagcaatcaccgcgcaaaccgtggctgtatatatagtgagagaaatagtcaagagagaaagtcattatgtcttttttttttaccaaaggttagagacccggcttttaaatgaaagccaaaacaatatagtttagctggggacgccagcgtacagtagaggaagctcccaaagggatcagccaacaccggagcccaactagccatccaactcttaagcaacgaaaactatttgattgaactcccaaatattaacactactaatcccccacacattacgtctttttgccggtcattgaaaaataatcctcccttccgcattgtgccattgtaaatgatccaaactaaagtagcactcagattttaacaaataccaaaaataacatgaaaactaaattatggccacttaataatattcatagaagcataaaactggtattttatgatattattattattattattaaatattccacgggcatgttttggtatgttttacaaaataatgtgtaccatagaattatatatatgcatggtatatcataaatatttttttggaatataagagatatgcaatatatatatatgaagtgtgaaaatatttttcttcaaacattttgtttttgagctacatgtacaaacatttcaagctataattaaaaaagaactttcctctcatctttttgaaattttcttaccataaatttgattacaggcactacttcaaaaccactcataggtatcgggacataggtgccggttcttttaaaaccggcaccaataggccttttcccatcttcgtgtgataaaaaaaatcggcacctttgagccctataggtatcgtttatagaggaaaaacaaacacctatactatatgtgcattttttaaaaaaaagagttggtacctataatatattataggtaccggttttctaaagaaccgacaactataatatattataggtgccggtattttaaaaaaaccgacaccaatagaaacagaccgaaccaaacccccaccgagccgatagcccccaccacataaaaaaaaaccccatctgccgatccgcgcaaccttatcctctccccatcctctgtcttctcacaccttcctcccccttctcgatccggttctctcccctccccttcccccctccgtccgtcctcctcctcctctccaactacgcccacctcctcctcatcttgagaagctcgtgaacgatggcagtcaccgtggccgggagatgcgaggaggtgtgctccaccgacaccactcctctgggatcacctcgcgccagcgccaaggccagtgacggccgagaaggcttcctccacagcttcttcactgtcggctccacaatggggcatgaaggcggctgcggccgcggctagaggaggtggggcaatgtggcggggttgtctcagggcggtgttcctggccgtggtgcagctcaaattgacgcggtacaagaaagcagagcaagaagtagctcaaattggccatggtggagcgctctcacaaaatgaactagagaggtggagctttggtttaggcagctcctcaactccactccagactcaactcctagagttaaatttaggagttggagctataccaaaccaaacaataccaaaatttgccttgagctggcggctgagggtgcgattgccttagcgtggagttgtgatttgggatttttttatttggatgaacttgtttttgtcaaatgaagattgtgatttggggatttgtgtgtgtgtgtgtattgtgagttgtgatctatggatgtggattaaatttgctttggggcaacagggagtaactcgatgcatcggctcgaatcgagctgatggatcgagattttttttttatcgtgtgttccttaaaggtgccagtcccacaaccggcacctttgactttggactattggtaccgctaaattggtacggtaaaaagaaaaataaatactagcggaagatctaaaattttgatagtggaagagggaatatggtctcaattagtggaaacaaagaaataaaaattctcaatatatagttaatgatagtacccgcccgcgatcggtatattttagctacctactttgctattttattcgtattgatcaatattaatagccaaaattaagtgagcttaattatagaataattaaggtcaactcaccaagtatcgctacgataggtgctggaatcatgggcctgcatccctggtcactggttttaccattccctttaagtccaaagcggcatttgcagtcataaccaccaactgtgtcgatgcatctgctaccacggtaacaaggatagagtttctcgtacttggcgggatcagctttcctaagctcacactcattaatatctgcacatcggtgataaaaaagcactaaatctgtcatattcaaacagactatattcaatcaactaatgctgtaagcaaattgaatactgtagtaagctacttatatgcatgaatggtaacccatgtcatatggaagaaaattgcccgagatcagtagtactacctccttcccaaaataattatatttctaggattcaaaattcatctcaaaataattgtaattctagagtactaattgccccatcaatcatctctcattcaaatttctccctattttaccctcaaccatctttccactctcacataaacaccatttaacgagggacatcatagtctttcttttcgaaccttaatatatgttaaacaacatagaattacaattagtatatatactagtactccgtattaattaagaactaacttgtgcatccgtcgttgccggtaacatagggattgccggcgtatccctcggagcacttgcagaggtatccattcccgttggtgacattgacgcacttactgtttgcgctgacacaggcaggagctacctgtcctgcagctgatcttgcagctgatgggcacgatccatttttcctgatggcccaatcaagcaccgttgggaccatgttcttcccattccggtgtccaaacctcttactgccggcacgactgaaatctttcctggtgaaattgtacctatattacgtagtaaaaaattatatatgtatgcacaaggtacagtacattcatagataacactgacattctaaaacatgacatcaggagtaccatatatggacactttagcttttttctctagaatttatttttatttcgaaataaatttactatgttttagaattaggaactataaggttgtatgtgtgtgtgtgtgtatatatatatatatatatatatatatatatatagagtagctctattatagatcccttccctagaataactattctacatcccctcccccctcccatccgtccccacctccctttccccatcccacgcgcggcccctcctcctctcgcgcctctctccccctcttttttccctcctctcgtgcttttttttcttttcctcccgatctctct

SEQ ID NO: 37595 - DNA, 5812 bp, Oryza sativa
gatccttccctcccgatctgcctctctccccctcttttttcgtttttctctccctcctctcctgccttttttttcttttcctcctgatccttctctcctccctcccgatctgcctctctccccctcttttttcgtttttctctccctcctctcctgcctttttttcttttcctcccgatccttctctcccccctcttttttcgtttttctctccctcctctcctgcctttttttcttttcctcccgatccttctctcctctctattttttcgttttctttttctttctcttctctccctttgcttcaccttgaaagaaaattaaaaattaaagacaaaccaagacttgaacccatgatctcatgtttcatagcaaactcttctagccaattttccttatgatactatgtgatttgatcattgtttgcttgctttgtatgtatgtccaaattttatgagaacaaattagctagttatgttactgtaataatcatacattgttattatgattcggcagtaacattaccatgtaagggtagtaacatgatatgttactacaaaatttatatcttgttactggcagtaacaacatgacgaaatttgtagtaacaaagaacctgcatagtaacagcggccgccctatagtagtaatgttttttagatctagagtattttaaatctcaatctttatagagtactaatgtacacgtcatgtcttatttttctaacccatttacatcatggcgttcgtaaaagaaaagtgcttaacgaaactagaactatcataactattttttaacgttgttactgcgaaaagcagaagtgttactgcatattggccatcgtgttattacgctattccagtgagacgaggactaaaaaaagaggtaaatctcaatctttagagagcaatatctctcacatcatatcttgtatttccaatctgtttgcaccatgaagtttataaaaaaacgcttaacaaaactagatccatcatggctactttttgacgttgttattgcgataatgttgtcttgttactgcacgatgaccgtcctgttactgcacgattcctgcaagacgagagcagcaaagtggtgggcgggtttgattggcgggaggatgctttgaccgaggtgggaagggggttttgggccctaggaagggtgggggaggtgggtttgacccatgggagggtgggggtgtagaatagttattctaggggtggggtgtagaatagattcactctatacacacacacacacacatactttacatactttatctataaagttacaatccattaggtctaaatctcaacaagcaaccatgccacatcatcacctactaggaacaattacatatttaacttcatgcaagcatgtaacatcatctacaatctatttaattctacaaatcaacatgtaagcatatccaatcatcaaccctcacatcatttccataatattttaacaaatctatctatcatttttataatatttaacatataattattaatatatacgttttatgttaaagcgtgtgtatcatttatttgttttatatactaataaacccaccacctgatgtttcattatttttttctttttacttctatctcgattgttgaaaaaaaaatattgaagattgcttagtaattcccgtagtctcgcagtatatcttgaacttctaacatgcaccacttttcctccagatgtagtcgattcatttgtttcttgtttttttctacttctaaaacaacatttttgttgtgcagtatgtaaaatatctttgttttgttcatacatagtctggatgattcaatattacaatttgcatgataatagaattagtctagatgcattattatgcttatataaaccataagacctcatcttttcacttatgtttatgcttatcagctaaaatatgaattttcaatcttaaatttcgagctgcttttgggatttttttttcatcgaagtttatttttcagtttttgcttttagatcgctaagaacacatgtataaaaattttatttacaaattacttttcatttgcaaatatgccgtttcgcttatttcacgaataagtgaaacaatgaggctttatataatttctagatttatactctctccgtcctataatataagtgattttgggtggatgtgacacattctagtacaataaatttgggcgtataggatgtctagattcattgtatactagaatatgtcacatcaatccaaaatccattatattatgcggcggagggagtataaggcagtgctgcatcccaattttcgggtgaagttttaacaaatgctgtgcacttaccagcctttctcggcaacgaaggcgtagctgcaggggctgtctgcccgcacgaggtcgtcgtcgaagccgtcaccccaggaaatatttaagacactaaggttgggcgggatggaaggcacctggcagcaacccagccccgtacatgggtcaccgtcgtgggcggccttatccaagctcgcgcacgtcgagatgcatccggtcgagtagctccctttcttcctgccaatcagaaacgctaccgtgttgcagccgatcgccgtgaactcgttccttttccgcgacaagcgagatttgccatggagcttcaaccgcgtggagacgtgctcctcgtggtgtgatgagtcgtagcattggtgggccacatgagtgtagacgcgcatctcccctgcctccagcgagatgtccttgatctctatggtgcccgtgtacggcctgggagggctaaagctatggttgcatttgatggtgaagcccggccaggcgcagtcgacgccgatgccgaatgggtaggggatctccacgttgccgcacttgctcgggcacgccgccggcaccggcgccggcgccggcgtagccggcactgccagatcagaaagtgtcgccgctgctgcaggagcatgaagaaaccagcatagcacaactactactatgtgtggcatggcaattagtcgtcgtatgcgaatttcgtcgtttttgcccatttctagtagctagctatgcgtgcggatttgcagtgaccacgcatgtctttatatagtggatcgagttgtactactagtagacatatatacggtgtttagctagctaacgtttttaatcctatattatgcatcaagatcgccaatgatggtctcctaacatacaacctccgcccctaaatatttgatgccgttgtcttttttaaacatgtttgaccgttttaataatctgttagatacaatcatctagagtaacctgaagcaccatgattgtttactagctagatcgttgtacccattacttgagtgcaagctattagacgtctacaacttgaaggcaaagtaaattttctagcaccattataatttttctctattcaagataataaatagattactaagttagaatagataaaaaaaaacacaaccatgttttcctctaaattagaatagattaaaaaaaagttgttgtatggtacacagtctatggagttatatgtgatttgttatatatccgttggcgttgttaattggggcatttgcaaatttgccaccgttttttcaatattgcaaggatgtcactcgaatgatagttctagtggtatttttgcaattttctattggcaattttacaataacgatttaaagtagtggaaaatttacaattgccccttgttaattaggtttgcctaggctcacacaaatttctagatctgccactgtatggacattttctattatgggactcaagctaggttaaccgtagtttcgccactgtttaattaatgctatacgcaaatttcacattcttaatactccctcccttccaaaaaaaaatacaatttatacccggcatggatgaaagtgagagggtgtggttgggtaaaatggagaaatatagtcagggtaggttgttggaggggaaatagtactataaatattctagaaatttatttttatgggataaaatttaaatgttaggattgaattgtctatggcatgggttggagggaagtatattgtctatgccgtctttggataccattactagtatagacgtcggcgatgttgggttaaatatatataataattggcatatatagacgttggccatttctggagtatatatgccgagtagctgacaagtatctttgtaattacgtcgtcaacgagtaaagtcaacagttaattactacaaaaacgtgcatataaattaatgcacatgtataccagacttaatatctcgctactcgcgcgcgttgttgccaagtttcacaaatcataacactaacaacaactcgctatcagacaatgaaacaaactatatactctatgtcaatacagtggtctgtgtcattctgtccatctagctgaggtttgacttgtacatcgcttatttaatggaacgaaacagacggcggacgatgacttgtaaatggctgataaggaggaattttttatctggtgtgtactagtgatatgattgacgaacgatgtattatttgattaaaggttggcgccaaagattattacagcatgcaagttgtagggtggattgggcgtcggaacagcagcacacacactccagacgaaaccttttacgttgctgtggaaaatggtagaaaattaagtgtaagatgaatttatttgttagctagacaacgtaattttaaatcgaacgactcctaagtctctaacatctgcggtgcccttactgtctcgctcatctcccagtttctctttatttaggatgcggtgcttcacgtacaactctcgccagggggtcgaggatcgtctcgtttggcgatggatgtctgaccagcgctgctcagcgcattcggcgtaccaggcattcttctatggcctccattcttttgcctgtactaatcttctctgacacacaaaggatcctgctaaatgcaggttcttcctttagtttgcattccagcagtgctgctggacggctgatctcctccagaaacgtggtatcgatagtcactcggcttgccccttttgtactcaggatcttgagacagtgaaccacattctccttgattgcgtgttcgctcggcaagtctggttatggttccaggactggtggccatcctccagagcttgcttacctgagcatctctgtgccggcttcgaccccctggtgctcctggtctcttagcagttatggaaggaacggaactctagggtttttgactccgtgctctcttccgtcacagtggttctgtagtccatccgttctgagggccatctgtggtctttagctggcgttgccgcttttggggacttgttgagagtgtagcgtggctaggcccctttccgctgcttggagtttgtgtttagccaccgtagtttctctagctttaactttttattttgctttttctcccttcccctgccataagctggtctggctgattgcgtgatgtaactaaaattccgaacgttttgtatacataattaagagaataactgaacttgtgacagaagtaaatcgtctatacacattcattacagctgaggattaaatgctgggtgaatttgtatggctgaaaatataaagactctgtaacatcaacgcgagtaaaagcttagccgaattagtccggtcattatattcttactgatgtaacctggccgtgtacatacggacattactcttgtaacattgtaacattggcttgttttgaagggcgacgatcgaaacggatgccatggctgagaaagagcattgccacgacaaaaggaagaattaattaagtttg

SEQ ID NO: 37596 - DNA, 1637 bp, Oryza sativa
  unsure (1)..(1637): unsure at all n locations
gtgcccctgctcgcaacctaggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacaaactgagcaaagtccggaatattgtcgtcttctacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaatcccttttcctgttagcttcggccactctcaaaaaatagtgcacgccgtcaataaactctttggaccgccggtcagcgtacatccattgccgatccatctacatgagtcaaaaaaaccgtacacaaataattattcttcttataataatgacagtcatacaataattataagatatctttattcatacaaaaatcataaaataatacaccaaataattcttaaaaactatttgtaaagttttaaactaattttaatgtgttttacttcttttaattttcattttagtttgttttctattatttaagattaactttcactagagttttccttctcaactatnttataaaaacttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaatanattcaatagaaattttggcatgacctcccctcttttttgaagaaattttgaagcttgctcgggcagctggaggaggaagaagacatatatataggggtgggactttagtcccggttggtagcaccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaagtttttataaaatagttgagaaggaaaactctagtgaaagttaatcttaaataatagaaaacaaactaaaatgaaaattaaaagaagtaaaacacattaaattagtttaaaactttacaaatagtttttaagaattatttggtgtattattttatgatttttgtatgaataaagatatcttataattattgtatgactgtcattattataagaa

SEQ ID NO: 37597 - DNA, 7260 bp, Oryza sativa
  unsure (1)..(7260): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcgaggcggaaggtgatggaggaagcccaagaggtgtagttggtctgaagatcccacccgccgttgggcttgccgacgccgtagctggcgccggacgccgtcgagaacgccgccgccgccaccacaacgacggcgagcaatgccattctttccaagctcactatttgcagctaattaaatggatgtcgaatatattcgaactactcaattaatggcactgatcgatcaatgatcaatctaatcgagagctgatgggaattgttaagacgtgtgatgattcatatgtgtctcggtgcatatatagcgttgatttgattgcagattatggtcgctgaacgttgctggattctgtcggtcttaattagtcagcatgcgtgtaccacatggtcattagttagctagcgatctcaattagctttctcatgataaaaataagggagcactagtacttagtcgcatcgagcaggtgaaaattatcattgtcagattattttcagaggacccggtcactcgtgtgttgagtgtctcaaaagattttggaacttgtctcgtatatgaacttaatttaatcttgctttctttgacaagctaattctgctgctagaaacttccaaaattttaatttgcttagttaactttgaaaaaattgtcgctaggcctagctcccgctaatgtcgcggtctttccatacaggacttgcgactgtttcgttaattttaagcaaaacttgccctactaagtaatactgtaattggtaaaatttaacatcgctacattcgatatttaataggggacgttgtttacttttaaaaagtcttttacctttctttttattttttaaaaaatacacaatttttatttattttgttgtgctttagtttatcattaaaaatacttctttaatactttaagcatgacttacgttttcgtatttgtataatttttttaaataaaatgaataattaggtcaaaagttaacaaagtaatctaaaaccgattggagtattcccaagtctttaggttgaagccaacacttaccaaataattaaatccgtaaggttttggttttatgctcaaggtttcaaggtttgttactaccaataattgaaatataaacagaaaacaaaaggtagagaatcaaacttatcccaaatataaagaagcactagtaatgtgatgataaagtaccagcgatatgatggtggtatcatggattaaattttagttctcacaaatattacgtacacgtggatacgtttatattaggattttagtgagactagtgagttgcttcaggtttagtgaggctatgtttgaacttgtgtaggactgtgtatctttttgagatcacggatttcgtgaggctattttcgagtgtgcgttagtggttttgtgtcagtttagggtgtgtcttttaatgatgaggaggaacaactaatttgcttagggcaagtactataagcatctgagtacaaactcctaagatgccacttaagcttaaataatgaggtggaggagaaaagaaagaagatagagcatgagccacctctcatgcaagggcaacctcttcacaaactttaagaaaaaaaagaaagaatgaggttgattggataagagtggataaaataaatagttatgttgcattgtgtcacaccccaatctggcatcgccgtacaacggcacctgacaggaacgtgtcgtaggaataacggcgcgaaccgcttcctacgaaaccgcgttctcagtaccagtcccaggacatagtgctggtacccacggtgataaatatgaatcattgcaaatccttaaaaaaattagaggacttatttaccttaacttaggttgcagctcaggacagcctgagaatacaaccgacgacgcggacggggaaacaccaacagcagtagcagcagcggaaccaacgaactaacacccaacaccacaggcaacggctgggaaccaggacaaaaccctaatcttcgcttcacttcatcttctcttcgagacagaggaactatatatatatatatatttatatagagcaagggtgagtactttcgtactcagcaagccatgggaattaagtgtttaatgcaggcttcaaaggaaaggctgttatttttgcaattgattttatttaaactcctttttgaaacaactaagtgagtgcttctcaaacgatacggatgagacagtgcgtctcgtccggtcggagtatgtgcaatgtatcggtctttgaattggtcaaggttggcatccggccaatagctttcaaacggccacccgggcctagctgatcccatcagccatagattttccaaacatcgatcccattccacaacagcaatttcacaaagcagtagtcaaacaaaactacgctaggaatcacctcacattcgcccatgactgtgggcacggctgttcgaacagtttaataacctctgcagagggggtacactttacccacatgatattactagccttggtcacctagcccgtgtggatcagacacgtttggtgacttggggctttcacgacaaggcatttcaaaagccgacacaggttcaccatatgccaacgagaggggtcccagaccgacaataggttaggtcccagaccatactgtgccaggaagcccgggggttctccccggcaccaccccgttgaatccacatgtctcttggcatcatggctcccccgattagctaattactcagctaggggtgtcctattccacccatgtggttgtacttatcttatgtttggatgaaattccaaggaaacggtccttaagtgcaagagcgggaaaccgtactcctggaacgtcctccggtccgcggttttggaaattcatttagtttgcaagcaccgacccaggtgtcgggttttccaattcttttgtaaaaccccaagttttacccatcgttggatattttaaatttgaagggaagtgttccgatgctcgagcccgaaggcccatgcatcgaagcacaacagtcgacaaaggaggtctaagtgttcaataattcaaggagggtaattgcagcaattaggattggggccggcaggctatctcgcaagccgcggccgaaatacttgtgttaaacctattcatgcaatatttgcggaaaagaaatacttagatttaaattataggtgcaagatgatcaaaggtgactttcctagctcaaggtcttcacggagcttcacgaatcttcgagaaaacctgcgatcgacgaaaatccggtaaccgcaactatacgcaaacaatcaaaaacctaaacaaaagaccaaaagaaagatcctatttagactaaataatagtgccattaaatagatctcaattttacggaaatactagaagtggaacaaagtcaatcggacgaatggatcgagaaatatgaatttggaagcttaactggaatttctggacaaggaaatgatttattggatttttctagaacacgagaaatggtttatggaataatattctcaagaatattattgatggtcgctgacatgcgggaccaaaggaaatgattcatggaatttttggaataaggaattgatttatgaaaaaggaaaaaggatttattaatccctttggataagaaaaggaaggagggataggaatcagactttcctgagcggcttggcgcggcccgagaggatttgcgtggctcggccgagcttattgggccggcacgggctacagggaggcggcccaagagaggggcgcggggagagagaggggaaggggagccgggtagaccgggctcacctcgcggggtcccgagcgggcccgcttgtcggtgaggcggtgcacgtggaagcggcgcacgcgggggcgggcgctagggtttcgggtgtgcgtggttcgggcgcggcgcgccgggtggacggatggtgacgggcccacgtgcagccgcacggcttgccgtggactgcgcgcacgggggggaagatggagggagggggcggctgataggcttggcccggtcaaagatgaggtggcgccgacgtggcgcctacgtggcagtcacgtgggccggcgggaggaggaaaaaggggaggccgagatggacggcggacggcggccaagttcaccggagctcgtcgcgacgattcgagagagagggagtacaccggaacgatgggacggacgagaggaagtgagccaccggatcggattcgccggagggaggccggcgacaacgaatcgcggcgacgcacgccggcggcgagaaaaggaggaaacttcaccggagcaacgggggttcgattaaaaggagggggagcatatccggggttcaaggaatccgtttccagcgccggatgggacgaaggagtaccaaggagggccggcgacgagcggcggcctccgggagcagacggcaatggcggcgaggccatgccgggcggcggcggggctcggggcggcgtccatgcgcgttcgggagtgccaccgagctatcacgcagactagagggggcgagggagagcgaggaaggggaacgggaggaggcactaccgagccgagacgggcgttgtgacgagcagccgacggcgcgggagcgagctctccggcctcgggccagggaaggggaagatgacggtgcccggagtcctcttctcgcgtccttcgcacgcaccggtctccctggtgcttcagcgacggacggcgtgggcgactgcagggcaggggcaacaaggcgcgattggcgacgagagaaacgagtgagggagatgggaggggctcgggtttttataggtggcgatgtcggtttgggagaaccgaccttaggacggtcaaggagaggagctggcggtcgggcgtggtcaaggtggtggcaggcggtgacgctgatggtggttgggcaaaacgaaaaaggaggaggagaaagggagctctgctccttgctgttttgggaaaagtttaaggagggagagggagtgagagaggggctgcctctctcggctttggaagctagcggcgtggagcggcagagcggcagcgcacgacgcaggcgacgccagggcttgacgcggcggcaaccgggcggtcggccacgcgcgagcgcgcgggaacgagcgaaggcggtggaggttttgggcggcgacggagggaagcggcgtcagcgcgagagagagaaaacgagagagagggagatccttctctcggcgacggctcgtgcagcgcatgtgagggagatggcaaaggggagagatgggctggggagtggatccggcccatccaaaacacggaggaggcaaaatagacttttacagagaagactgatttggagtggattcgaattgaggttttggatttggatttcgaatttgatgcttggtcttagggacacaaggtggagtcaaggaaggaactcaaatgggaatcgagaacaggtatttggcgaggattcaaggaggcgattgaatttcggagacttgaatcggaattggaattttgaggtgggcgattttgatggcaacgagggggaacaaagatggagattgaattgagatcttcacacaaagaacggaatttttgaaattaggattttgctgaattagtttttaacgtctcacgaaaagcggagcgttacacattggagctagcatattagagacaatatggtgtatgagctaccctctaaaaattaattgatgagatagataagtttagatgtgatagtcatatctatcataccacttgcccttaccatgacctagggcgaggatgctaccttcatggccgagcaacttaggaagctagggggtattcgtacaggggcagccggagctaggagaggagagaagatggggaaggagaagcccaagggttatttggtgccaaataatattttagcacatagccacgtatttagaatgaaattttatcgattctcatttggcatttggataaaaccacttttcagttttcacaattagtataatcccaatttcctttcaccactcagggacctaattgaaaatttccaatccagcaatgggcatgaaatccagcaatacgacgtatattgacatctctcatgagctgaagaagctcctccttgacaaattgttactgattggaagcataccaaattcagatggtgattgggtcatgggcaagttcaccggccgatgggcaaagttggagctccagagcaaaatgcaatcggaaagcagttcatctacagtttgtgctcaggaacagcactgagcatatgcagccaattttatgtcctccgtccatactccttatggcgagtatagttctaaacttttttttcaaacttccaactttttcatcacatcaaaacttttctacacacacaaatttttaacttttccgtcacatcgttccaatttcaaccaaacttctaattttagcgtgaactaaacacactggcatatagcaacggagatatgcttcttccgcgaagacgagacaggcagctcatcatcgtcatcatctgcatcatacagaggcccaagcagagaattatccaattatgtgatgcacctttctgcaaagtatatcatgtactccggaaatgggtcgggacgcagccaagagatatcacattattttcaacagaaaaaaattggcggctttgattttctggtatatattcagtcagtcatcctttcaacttgtgatatcccacatgttagggatgatcaattcaagaattctcatgaatatccatggcaatttcataattaccgtgttgctggtgtgattgaaaatataaatactagggaatgaactaatatcaaataaatataagggatgaggcttcaaacccaaaccggctagcccaccactttgtagagttagccggaagaaccctgggtgtttctcgttgctggtgtgattggctctgtatagtgatagttgtaggtgacatctctgaaattactcaagtgattctgaataattaaattaccttgacttccactactatctcataaattaaacaattgatgtggattcaagtgaaaaggatcacataatagaatccaacaatatatatactgaatcaaattacattcaacaaagaattgcataattaagtacaacaattcgagcagaattcatctcaggaaaaaaagaatataaagtatgatgaatctggtatctccaaaaagaacaa

SEQ ID NO: 37598 - DNA, 15673 bp, Oryza sativa
ccggcgcggaaggtggcggcggacgcccactgcgcgtagttggtgcgcgtgtcccacgacccggccggtgctcccaccgtgtaggtggtggcgcccatcgccgtcgtcgcgagcaccgccgccgccgccgccacggccacgacgaggagagctctggctgatgctgccatggccgcgacgatcgacgatcgaggagatcgatggagcttggaattgggaggagatgatgcaagaaatgagatggcaaggagacgatgggaagtatgtgtatatataggtgatgggtgattaattagcttaagctaagaacatatataatacagattataaatcagctataatcacatatagaagagatgagagacgaaagaaaagagaagactatacagatttataactagctgtagtacagactttaaaatgttatatgtgtataacaggtggaccaattattaatgatgtattatatatttatagttaattattgtataaattaattattagattgatataatttagagttattaattagctatactattaaacttgctttaatgcattaagctaattaagcgcgtggattggcagggatgagtgaggtgaggtgaggtcaatgcaggggttggttggtcaatatgtgtttgactagactcgtgtgaaagtgtagttaattaattaattaattgatgggtaggtgtgttagaatagtcgtcgagttggctgctcgactttggtctgaatcacctgattgaaatgatcaaagctgcatggatgtagactgactggcttctagatgagaattttctctttctggatggtttttttttgtctttttataagaacaagatggggtcttaatttgattatctaccaatagttaggaggttttttccccctcgagataatgtagctgcataacatcggcgtagttacacacaccacatataaatatccacgaatgtatccactaacacacatctacaagctttgctataggcagaagaaaaaaaattcataatatgtcatatcataatattgtactattctataatatttaaaatattatgggggcaatttgtaaaaaaaataattcaaaagcactaatagggtggtagattcgctgccaccactactaaaggcttttaaaggagtataaatgatactccctccatacttgtaaaggaattcgtttaggataatgtttaagtcaaacattggaaatataaatcataaataatgctcaagttgttgagtttgaaaatgtaaaaattatatgaatagatttgttttgaaaaatactttcataaaaatatacatgtatcacttttgaataaatatttttatagaaataagatgtcaaagttgtgttttgaagaccgtgtcgctgtccaaaacgaatttctttacgagtacggagggagtacacaatatgctacgtggacaagtgtggggtgcccgactgtacgaggccctaattttggattgactccaacgcgttctaatatgttccatgacattctcattctgtttttgtacgttttacatcctctccttcagtgatctagcttgaacaaacttgtttttcttccctttgatgatcgttcgatggtaattatagccacctaaaatatccgttgctcatgacggcgatgcgaacacacgtttgaggtgttgaaattatgtttttatacttcgtaaagaaatcagagtaattcatcaggatgcatgcaatgatttcgtaagtttaaacacacaatatatagttacaatgttagcttcctcgatcatccacatgtttatattgtaccatataactacagctgttattagtcatttaatgttctttttttttaatttagaggagcacattagatctatgggtagttgatagttcttctgatgtggataggggatcatcatccacagcgtgaataaggataattttacaataaattgtaaaatatgttgcattaagtgaaaagtggctatagccttggcctatacacagtataatgtaaaacatactctttgcttaattaatcctattttctaaacagagaatttattattggttagcaccagggcatcggatttataggtacggatatttgaaggtttagctagcatatcccccgtttcggtaaaatatggctataggtatttatatttatgttcatatgagccagaggcttttgaaatggaattctcccccttttgtttaattgcaactgactaattaaggtgtacattttaggtgaaaagacaaaattgaagtcaaacaatagtgatgatggtcaaaaacatatatatatagcaataaagaatcaaaatataagcaagctcaataacatgtaaccaaaaattacataagtaacaatatgagctggactaatcacaaacaaatcaatacatatgaacatgatcaatcgatcgccaatgaagagagaacaaaaaatattcttcctctaatttagaaggacatgaggccagcaactatggcgcccaaactaagcccaaccagagatgcaacaccagtggacttgctcgccgagctcgatggagacacaggccgaccaccagccataggtggcatcgcgttcggtgccattgctgtaggcgtgcgcggacgaggcgccattggcgacagtgcagtgccactaccgccggtggcagtggcggcctcgaccttgactgcgatcttcatcccggcggcgcaatggccagggaagccgcacatgaagtatcgggtgccggtagctgtcaatggcacggtgtcatcgccggagttgaaggtggcgacggggccggagctcgagcaggagtcgtagccagccttggtcacctccacgacgtcgtgcgccgccggcgagtacttgaacacaagctggtcgccgacacggaaggtgacggcggacacccactgcgcgtagttggtgcgcgtgtcccacgacccggccggtgctcctaccgtgtaggtggtggcgcccgtcgccgtcgtcgtgagcaccgccgccgccatggccacgacgaggagagccgatctgttggcagctgccatgatcgccttaggatcaattagcagagcagatgagagatcgatcgagcttgcaactaggtggatcagatcgatcgatggaagggtgatgatttgcaagaatcgatgatggttttgagtatatttataggtgattgtttgcattgcattgcagagacagtggaggtgatgtcagtccaggattataggggttggtgggtcaaatgcgtttgactccatcgctcaaagacgtgtgtgtgtgaacgtgtataataattagtaataacaatctaactaagtctgctcgactaagtctgaaacacctgattgatttttttattgttaaatggaccaagtgctcacgcatacaccacacacaaacacccgtttgacacagctctagctactaactccaacttacctagaaaagacacgaatattagggaatgacttaatatcaataaggggtgaggcttcaaacaagatcatctagcctaccatcttgtggagctagctggaatacccctaagcgtttctcaactccaacttacctagagctggagctgtaccaaatggtatagattctccattttttttagagcggagctagcagagctgctccacaaatttgtactacgggggtggagctgggtttttctgccccacagcttcacttcattccaaaagacccactaccctttaaattttcatgtaattacgtgatatgccattgaactacctattcatatcccctctcttcccgttctctctcctcatcttcctccccatcctcctgacggccatcctcctctcgacgacggcgggctgcgcgtgggcagcggcgtcgacaggcggcggctgaggtggcgagtttgtggcgcagcgcgggcggagaagcgacgtttgcgtcggcgacgacatgtagtggtggtgggctggtcgcgtcggcggcggtggctaggacagcaggatgacggcgtcggtaggcggcgtgtggcgtcggcgagcggtggcgtcgacaggcacgagccaaacggcggcggcaacagcagggaaacgcatgtgcggcgacggcagcaatggcagggaaacacatgtgcggcgacggcgacgccctctatgtgttcaacgaaatggctacaaggcacgtggtgacatggagctggtaaatctagccaaacactttttacccacctcaacttctatatgagctagctcccactagagttgaagtttataattgggagttagagtttgtagctctaccaaatgaggcctaatatatacactaataagcgcataccaacaacaaattaatttctaatcctatgaaaattctattgaaattgtacccgcgaatatatatataaccggatgtatgtactaccaatataaacaccaatataaacgatccaacagatccaacagttgagattgatttatctttctacttaaatacttttcagtacaaggatatgccacatcttgtattttttttaattttattttttatgggacgaaggcaatagataacaatatcaaatttaaaaggataaaattatttttgtattataatgtcttaattttagccgatagtgaaacatcattaattggatctttttctctgcttgaacccttcccccattccccatcgacctcttccctaaaggaattataaggtccggctatcagaacggggacatgatgacttgatatgatgggaggctgggagcctagatcactactacaaaacccctaatagggatcggcttatagttaccggattatttaaaaccgacacctattaactgcccacctccgtaggtcaaaaatatagaaccggtacctttggaactataggtaccagtagtacttttccatgccattataaaaaaagtgtcattgattcattcacactccacatatgtttcacataaatcaaactaactattttgcttgccgaccctcaaaataataatactaataaaaagaaaacaatttcaagcatggttatatatatgtgatacagctctaggatagtacttacgcgaagttgtgaacaaaaaactaccaattcaaatacataagttaaattatcaagatactttattgaaatatatgtatgacgccgttgactttttattcaacgtttgactattcgtcttattcaaaaaatttatgtaattatcatttattttattgtgacttaattcatcatcaaatgttctttaagcatgacataaatattttcatatttgcacaaaaaatttgaataaaacgaatggtcaaacgttggttaaaaagtcaacggcgtcatacattaaaatacgtagggagtacatgttagtattcagttacatgttctagaaggtggagctttatgctaaatttctttggagtgtaatatatgtatcctttggcttgaaaccaccaactagtttctctcatcatataggtggaagctggctgtttggtattggttgaaaaaaaagcgagtatttgctttatgttggactctatgactaagtaaaaatgatatggtttttgacaaaacttcatctaaattttatttacagatactttttaggtaacatataggtttcggtttttgacacgactacaaatgtctgtcatggacaaaaacctatacatctctcttttacatgccagaaactactatgcacattttcatcaactttcgatcgagatttactagtaggattgctacttgagtaagttgttcatatcttttttgagtttggtgtctcatttttattatctgctcatcttttgttgtctatttctattgaagcaaaaggcagatttccaatgtttatccattattttaaaaaagaatattgttgagctttagatatggtctatgctttatatgttgttttgtgttgtttaattgctattgatttgtttctaactaaaatagggatatacatatttatgttcacatgagccacatgcttaggagatggaattctccattttaggtggagatacaaaattgaggtcaaacactagcaatgggtcaaaagaacatttatataatattggaatcaaatcgtaatgagctaaattacatgtagcaaaaaaaatgagtaacaatatgagccgaactcatcacaaacaatcaatacatatgaacacgatcaatagatcaactttgaagagagaaaaaaaatattttttccctctaatttaaaagaccatgagaccagcaacgattgcactcaaactcagaccaaccagagatgcaacaccaacaggcttgcttgctgagcttgacggaggggtgggccggccaccgttcgtagggggcatcgcatttggtgccattactgtaggagtgcgtggaagaggggccaatggtgacggggtagggttgctgccggtggcggcctccaccttgacggcgaccttcatccctgcggtgcaatggccagggaagccgcagatgaaatagcgggtgccgatagcagcgagagggatggtgtcatcgccagagttgaaggtggagatggggctggagctagagcaggagtcgtagtcggccttgttcacctccaccacatcgtgcgccgctggggagtacttgaagacaagctggtcaccgacacggaaggtgatagcagagacccactgcgcgtagttggttcgtgtgtcccatgaaccggccggagctcccaccgtgtaggtggtgacgcccatcgctgtcccgagcaccgcggccgccatggccacaacgaggagagctctggctgccatggttgggaagagaggttgaaattggaagcaagagtataattggagatgcaagaaatgaaatggaacttggttgatttggggaggaggtatgataggaggtgtatatataggtgcttgttagttaattaggtgtaagctaagcgcgttaagtgaggtcagtctaaggctttggttggtcaaatgtgtatgactcgatccgctcacactgacacgcgcgtatatataggaaaatgtataattaattaatgataggtgcacgtgagaaaagtcgtgatcgactgctgctgctcgaccgagtctgaattaatttaatgatcacctgattgaaactatcaaattgacagagtctgaaattagttatctaattgaatttgtgtacgtaatacatataatcatcatctgatgtgtagtgcaagaattcgtgggtggtgggtgggggttgttcgatttggcgactaaattttattccttttgttttttaatatgtaactatttttactttaatttggatacgatatctaaccattcattttatttaaaaatttaatttaaatatataaaatataagttatatatccttgaattgtctttaaggataacacaaaacacaataaactaaacaatactataattaattttattaagaggattgtcaaacgtcatatatataaaagtaaataataacatcatatgtttaaaaagatgcagtaatataagtatatataccatgaaattaatttgcacatcagatgggggccctggtgtttgatgtattttattattatctaaaagccaaatttctagaaattaagcttgaccaagatctaaatcggttagttgggtgaaaaaatcacatatacacacgcgagctggtgtgttgaattcacgcgatgatgacttggctcatgctttcaaatttcaaattaaatcgcaatagactagtagcctgttcaagcgtcggttcaaattaaattagttgttagtggaaaatatcagaactaagggcatgtttagatctatttggaatggcaaatggcaaatggcaaatggcaaaagttttggtggtaaaagttttggcattgcaaaagtactagttggtgtttagatgcgtgttaaagttttgccattctagcactaaagtgagagagagaaagagagagggagtggtcccaaagcactttttggcacaatatgctactatggactagcaaatgataaatgccaaattgacaacttttgctactagtgtttagatctaaaatggcaaaaagtgctacaaaatggcaaaacttttgccattttagaggatctagactaggcctaaagacttttccatgccattggttcccacgtatacgcattctgcacatatatcaaattaaccattcaagcatggatatatgattagttatgcaaatatgagctttattcggaaagcacttccgtcaacaaaaagaaaaatgctacatacgtgttcaaacttcaaatacagaacttgacaaaatatagtaattaaagtgttgtgagaactgactttgtcaaatctcctcatgtctctacttttatctatttcagaaaacatgcatgggcccaacttagaccatgtgggtttctaaaaacaaatttaaaaatacgtttggataaaacaaaaatacaaagggacaataattatgtttaacaatattgatgtgtataaactttatacattatgtgtagaaactttttatatagcatcattctatctatataatatttgaatctgaatccaaattcaaattcgaatcggacatataaattttcaatgtataaactttgggtatacaaactttaggtgtacaaacattgggtgtataaactttaagagtataaagtttagttgtacaaacttacttaaaaaggaaagttatgtggtgaaaaaatgaaaagaaaggcggagggcaccgatatccaattacgattttcgcaccattatactacatgcacaattccatcatgcatgtatactacatacacaattctgacatgtccatgcatccctttgtaacacaaaggatggataaatccatataatatttgatatagagaaagctgattaattaatactttcccacaaagctactactacatccacgtcatcaacaaaacatgggtggtctaatttttttccttaggatattgtaggcggttgaattcctcaattcgcaaaatattttattgatccttcaataaacttcttttgcaaaaaaagggtccttccacacccctacctttagggaaaaacatatttcacttgattatgtatatgtggataatcttgttggtgtggttatgcaactattactcgacaccactatatatacatgtctctttaaaaataaagtagaaaccccaacaaagtggttgatttgtttgaccaatgatggttggattagaactatgaaatgaatgttgcatcgactaggtggctaggttagagatattttgcttagaggttgctaagttgaattaatcgagggtagtggagaggtaggtgttggaagaggcaacactagtgcgggagtttgagggatatcttcatggtttggataccccctctctatatatagctcaaccgatacaggggtatcttggtcccttcacctgcaagagagacaacaaatctgtaaaagggaagaagatgaatctggcatgaatcctctatttgataatagtgttttggtgaaactcaattgaaggatggcattatagtgtaactcacttttgatgatagcataatctgaaatttcttgtttgatgggggcggaaaagatggagcactgggattagggtggacaactggatatatgtacatattgattgtcaagatattattaaaataattcatttatgttagtactatttatttacatgttctagaaggtaaagctttaggtatggtctacggtttctatgttgttgtgttgtttaattcctattgatttgtttctatctagctacaatagggttatagatatttatgccacaggcttttgagatggaattgtccccccccttttgtttaatttcaatggattaaggaaagttttaggtgaaatgacaaaattgaagtcaaacgctagtcatgatgggccaaaacacatatataacaatagaatcaaatcataattaatgagctgatgaattacatataacaaaaaatatattacatataaataacaatatgagccggactctaccagagaaaatactcaaagcaatcaatatatacgaacacaatcaatcgatcgccttcgaagagatacacaaagtatcttcttactctaatttagaaggccatgagaccaacaactatggcacccaaactaagaccaactagagatgcaacaccagcgggctggcttgctgagttagatggaggcacgggccggccaccagccgttggcggcattgcgttcggtgccattgctgtcggtgtgcgtggacgaggggtcatcggtgatggggccgggttgctgccggtggcggcctcaaccttgacagcgaccttcatccctccggtgcaatggccattgaagccacatatgaagtagcgggtgccggtagcggtgagagggatggtgtcatcgccggagttgaaggtggcgatagggctggagctggagcatgagtcgtagtcggccttgttcacctccaccacatcatgcgccgctggagaatacttgaacactgcacattacacatgcatatcattagctcggttagatattatactaaagttgccacatgtatcgatcagttcaactcaaacatttaagctggtgagcaaacacggacaatcacctatctgatctccggcacgaaagttgatgttggaaacccactggtcatagttagtcctcaagtcccatgagccgctcggagctccgacggtgtaggtggcgccgagcgccgttccgagcaccgctgctgccatggcgacgacgagtagagctctggctgccatgatcgccatggaatatggtccaattagctatatatcgacttcgaggatcgatggagatgatggtcgatcaatctccaagcaattggcagtagaagctaagctagaaatcgatggatgattgaatgaaatgagatgtgctgggaaggtgtgtatatataggcgttggttggaggtgtgaaattgtgaactgaagcagtagaagtagaacgcgtagaaggtcaaagactctgaagagtaggtcggtcaaatgtatgtaacgttgactcattctctcatagtaagaaaagtactatgtgttgactcactcgttggatgcattgcagacgtgtatggtgagatctagctgctactgatcttgcctggtcagttcttaaaaaaaaggaaaaaaaatgtttggtcgaccaagtctgttgcgttagattaattaatgaaaaaaacacacctgtgaaatgatccaacatgcaaaggacatctatactaatataaaaaggaggagttgtcttcttgcaatcctacagatgaaatcaacatagttaatcccatccgtccatctgcatatctgatctaatctcatccgtccatcgctatctcatcaatcccacctgattcctctcccatgctacagtcaaatcatcaataccccacaccctaacgtcgctcggcattccctcggtcccactcccacctcccaccaaaatcaatcgcgtgatttcctcccaacccccaccacgcgattttctgatttcctccgccttcatcgccgcctccttcccactccgccactccgggtggtgcctccctcacatcggctcctgtggccgctcccgtcttcgccgccgccgcccgccggtgcctccctccaccaccacctgggccccgcctccttgccattcacgaacaggagtttcggcaggttcgtgcgggcgccgtcacgccgccacatatcgagactcgctgtccgttcgccgggtagcccgcctcctccacggccgtccagtctgccgccctcaacgccgatcgcgccgtccagtccgcccgcaccctctgccgccatcttcaaaaggtatagatcccctcctcctaccccttctctctcttcctccatctctaatatgttctctctatccattagtagccctgccgccgccacgagatccaggcgagcatgatggaagacgtggatgcggctccagtggttgattgggtggcaacgaggatgaaccgcagctgactgcacccatgcacaaccgcaaccaactagctaaaggtacgactacgagtccttcgagcagctaaccaccatgacgcaattccgtttgagcggtgctccatgtggctttccagtagatttgacccccaaatcgatatgatgtagcatcaaatgatgtgaatacacttcatgagttttgcctttgatcaagacgaactcctgattatagcgtcctaagctccatatggtgcgtgtcagcatccctttgtctgttctaggccagaaattggtgaaaggtttgtcaagcggtctacttttgattgaaaacatggctacttaattacttatattaatgttgtttatatgtatgactgatgttctacagctacattttgtgttatctaatataactattttttcttttagtttggatagatttggagatgaagcttattaatttttatattttggttccgaaaaagaaatagaaataatacatgttgtttttcacgatcattttacattgaaacagtaataaattgacgacatcctttgtttacatcagatggcatctttctaaaagattatgtgtttatgctgttattgcacttgtcatacatgttagaataagactaaaatcaggcctcaaattttgacatccaactatttgttttgtctgtatagcaacgaagcctattctcttcaaaaaaaaaaaaaatggcataaatatgctgaaaatgagcttatgctaatcctgagataaaaaggggctgcagggatgttggggctttggtccttgagatcatgcatattgcaagagaaacctaatctgagtttcaaaagtggatggtgcagctgttccgtttgattgcaaaatgcccgaatagctttgactttcaagtaagtttctttccaaattcagaactctaatttgatatatgccttgattaatatttgttcatgatcctctatgtatcatgctctgcatttatgtttgcaactatccagtattcgcttcatgatttaacaaagggtttgattatgattggttactatcaggtgtttggggtcaagtctgtagtttgcaaggagtgaacctcattgtccgttcgttggggagacctcctcctccaccgctgtccagtccgctgcccccagttcgcacgttcgagggggaacattgatttgttctttagaaattcaataaataggcattcgtacatgtggcatccgatggttatatgctatggtcatttttcattaaatgttgactcaactttgtggtatgttttcagtttcatttagccattaaactctggaggaactacagaataaacttgtagatgcagaggccagaatggatttgtaagaggcaatggattttagtattcagtaatctttgatttcaggtaaattaaagatcattgcacaatcaagaaatatattttgtgaatgtttgcaataacttgcatggtggtaaccttctgtttcagcttgtcaatttgatgcgtaaccttctgtttcaatttgtcaattttttgttcatccttgtttttattatgatcccaaagatcaccactttgtctggcatttgagatggaataaagttaacattaggattatcattttgtatgttgtcctaaactgagcacaatggctgatttcagatagaaacaacaccttttgtcagttgccaagctgaagcattagaaggggtttgtcttatttttaatattgaagcccaacgggtagatcctggaagattatttggggctttccaaaaagaactgtttgaaaaatattttgatttttagattagagacatgaagctgtcttgatcagaggcaattctccaagcagtttagattaagatgctttgataacctgcctgcaaatctctaataccgaagccaccttcagaaattggctctagctaccaatgtcattccaatatttaatatgcatacctccatccttttgaatgccagtccagaattttctaacgatagctgtgagctttgaaataagggttttggaatgaagaaatgtcaacatgttataggtaggaatggaggaaaagacatattttctgagagctaaccttccaatacgacgtctagagcatgttgttctataaggacttattggtggattgctataaagttgtacattacaaactaggttactgggcgggtgatgtactccctccgtttcccaatgtaagtcattctagtattttccacatccatattgatgctaatgaatctagacatggaggaagtatatacttatgtcgtgagcattaatatgaagaaaaaatgtgttatttgaaactttccaaactcttaatttggcatattccaaacattttttacttccaccagtgtatatataaaaattttacatgatataaacacaaaatatttgaaaacacttgtgctaaaagtaaaaaaaaatcagaaaaaagagaaaaaaaaagaaaaaaatcacgaaaaaaccaaaaaaccaaaaaaaaggctccccgccagctggcgcgtgcacgccaattagctctcacggtaagatgcagggtcaatccacaatcccattttatccgtccggttactcacttatttaactatttaattaaacatggacttacggatctatccatttatacctagatgattaatacctgaattgcaattcgaataatgaaccatgatatgcatccatatataatttaatcaagtgagatgtgatatatatgtatcgatgcctgaattgcaaatcgaataacaggctgtgatatgcatccatatataattaatcagccgatagatgtgatatatatgtgccatattggtggctgatttccaattaattaaagcactgtcgtctgatatgttgtggtgtcaattctcaattcaagcctatttagtactctctccatttcgaaatatttgacgccgttgactttttagcacatgtttgaccgttcgtcttattcaaaaaatttaagtaattattaattcttttcctatcatttgattcattgttaaatatatttttatgtaggcatataattttacatatttcacacaagattttgaataagacgaacggtcaaacatgtgctaaaaaatcaacggtgtcaaacatttcgaatcggagggagtagcagataacatcaaacagtaatgcttgatactatttcatcaaccgtccgattcacatgcagcactccggccgccacgagtcaaattaacacgcatggattgtgctgcctccggtttttaaatagaagacgctattgattttttttttgagtggagattgctattgattttcgatcataggtttgaacacacgtcttattaagaaattatataattattatttattttgttgtgatttagtttattattaaattaatggtacttgcactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctc

SEQ ID NO: 37599 - DNA, 42704 bp, Oryza sativa
  unsure (1)..(42704): unsure at all n locations
gcccgtcaaaggtatgagcattacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtacagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctattaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccaaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagtgcatgaagagaatgtttgcgaacaaggaacaagctaagcttgtgcgctggcatgccgaagaacggaaagtcgatactatgctgaggcacccagcagattcagtgcagtgaaggacaatcgataggatttaccaggaattctcaaatgacccaagaaacatgcgtttcgcaatgtgtacggacggcattaatcctttcggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttatggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatctaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgttgtggtccagcattcatgacgcagatgtatccttgcgaaaggtacctggggatccttaagggttatgtacggaaccgttcacaccccgaggggagtatcatcgagagttacaccaccgaagaggccatcgaattttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttcttttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccgaacggctctgtcacatttgagaacaaaagtgatgccgtcgtctatcaggaactggtgagttcactacttaacctaactaatttccgttcgtataaagtacaagttcgtataaatgactatcttcttttctagttgggcttggttactgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctaggtatgccaaggtgtccatcgatacagtaaaggacacctggtcaggctatctgctgcccgtgcccccaaatgatgaaatcatgactttcggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttcttaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcttttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgttgtttgtaaatttttagtaagacaaatagttgaacatatgtttaaaagtgaataacatcatgtattaaaaaccagaaaggtacgttaattagaacgtcatcaaatagaccatatatgaatgagcttcatgcatcttgcatattgtaatacgttatggttagtttgagagcaattctgaacttcataaaaatccttgaaaaaattgaccagtcgaacttcaaaaaaaatccttgaacaattgaacttcataaaaatccttgaaaaaaaaatcctagctttgtagaagagaacaatcatttctctctccatgcaagtcgtaacacaaacctcagtcaaatgaaaccaaattaaggcatgcatgcatatctaaaatccgatcaataaccacaaattaaaaccagaagtacaaaatattaactaaatcaaagcatatacgtgtacttaaacttacaattacaaaaatatacacacaagagactaattaattaatgctaccacaatggcagaagagcatacaagagcacgaggactaggcggcttccggcgacggcggcggtcacggacgacgtcgacggcagcggcgcggcggcggctgcggggccggaggaggcggcggcgacgacgtcgatgcggatcttcatgccgctgccgcagtggccggtgaggccgcagaggaagtagcgggtgccgacggcggtgagggcgacgaggtcgttgccggagcggaaggcggagatgttgttggcgttggagcaggcgtcgtaccccgccttcgtcacctccaccacgtcgtgcagctcacgcgagtacgtgaacgctgcacttgcattgatccaaatcaagaacaggattaagctcatcgcaagaatttgttttaatttttagaacatttttaatcttcaatttaaaaaataattaaactcttccaaaacttatatgtaattaagatttgaagcttttaccaagacaacaccgacgcaggtctaactagcgtggcagtgctattatttgcccactccgatcgatatggttggtatgatagtacaaaactaaactatgacgccggctacggctggcgtgttgacgttattttgtcaagtctggtgggtttggtgtgccaaaaatgttcagattctggaaatagatttagaatggtttatttttgaaattaaaaattcaaatggttaaaaagtacaaaagaaaacccaagaaaacagagataactaaaactcgatttggatttggattactgactgagcttgtcgccggggtggaatgtccggcgagcgacccactctttgtagtcggtctccatgtcccacagcccatccggcgcgcccaccgtgtacgtcgtcgcgccggcggccatcgcctggccggccagaacggcggcgaccatcaccaccgctgccgctgccgctgccgccatggctggacctcgagcccactccatggaagaggcaagcagaagagaacaatcagagagagagagagagagagagagagagagagagagattgtatatctatctatagctatagctaggctgatcgagagctcgtggtcgatctcttatactatctatcgatcgatctcaattagtcatcaatggcgcggcggttgttgctgcgtcgtctcgagcacattaattgtggtggatcatatcagtgtaggtagctcatccatatatatatatgatcgatcgatcgatcgaatggcctagcaagctgctgctgcatgcaatgtaagacccagctagctagtggtcctccattaatggtactgggggttgatgatatatactctatccgtttctaaatatttaacaccattaacttttaaaacatgtttgaccattcgtcttattcaaaaaattaaataattattaattcttttcctatcatttgattcattgttaaatatactttcatttatacatatagttttatatatttcataatttttttaaataagacgaacggttaaacatgtacttaaaaaaatcaacggtgtcaaacgtttagaaacggagggagtagctagcaagcgtaacagcaggagcagctacagatcgaccgatcgaaagagatgttgacaatgtcgggaagatgtcgatcgaggaggaagatcaggatcaggatcatcatcatcatcatcaccctggactgaatcctgaccatcggatcgcccgattcaacggtcaggatcggatggcccgcaatattagtaattagttgatcggatgaattattgttggatccagatatatataattgttgcttaattcggtgcatcaataagctgctattgctgggccgggtcgttgaattcttgcctatgtgttcagaccggctgttaactaccactactgtggagtacgacgctagcttaattagctgcttgttcctgtcacaaggatgaagagtcagaaagagatcgccgtgttcagatctgcacaagtatctgctggttttaattaattttgatgaaaatatctttgtcgttttactgctttatctcacccctttcgggcatcctcaatgtttacgatccaactaggcagtaaggtgaaccgtgtcaagtggcgttagcaggttggaaagaccacgatgtgcccatgagaagcaaatcctttgatgttaccattcatcgtgacgttactattcacttcatcactctcggaccccatatgttagtcaccacgtcagaggaaagttacgttagaggatttcaatccatatgcatgtgtagagtggaaaataaggtgggcccatcttttaaaaaaaaagttcaacctatgtctaacatgagaattgccacaataaaataaacaaggtgagactcaacttaaattgcttatatcctaataataagcctatgacttggcactagctatttaccactttcacaatgcagtagtaaggatgtcttaatgcctattatttcctacttttccattacattatggatagccttagattgagagcacttttaggagtacaagttttactgcttcggaagatatatatttatagttgcgacatgtattattcttcacgatagagttacaagtacagggtatacttccaccgtttcatatcacgtgttaggtttgttctaaactaaacttcttcaagtttaactaattaatttatattaaaaaacatagtaatatttcaaacacaaaatggatatatgctataaaattatatacaaacagtggctttattaatgaaagtaatttgaagttagatgttactacgttatctataaacatagcaaaacttaaataaatttgacaatcgacaaacccaaaacatgatatcgtataacggaaggaatattagctaaaactgtttgtcaccaaaggctatctatgatctgaaaagcacactcggatgagcacactctgatgaaccgataaggactcaataataatctctagcttgtactatatgttggtcccggcacagtatatggttggtagatgaggagatcttgatttcagaaaactcacaaacacatcttaatatatcttggccagcgtcactttaccgttctggcaaaaaaaaaagagagagaatttggaaaataccatcagaaagatatatataagttataaaataccatcaagaatgacatgtggaacctagacctacgtacgtatcaatggtacatacaaccgtattttttaactccgtaattttttaatggtactaagcaaattgggaaaaaaaaatctgcaaacacacatatcatatggggaggactaaactgtactattatattcgagacacaaatttaaaacatgttatagactgagataaacattgattgtgagtgtagttaaccttaggctccattaaattttatccattattccaaaatacatggcggcatgtacgtacatgtacttgatgggaaaagagagctcaactgccgatatataaatgttggagacattgccatgaatagttgaatggagacacattagacaccaatggatgaacagaccattaggtcaactggtcgaacagcaaaagtttgcgttaggtacacagagattagtactagtaccaaatttgatgggccacatgcggctgcatttgtcaattggaaggacaaagttagccactctgcatcgcctactagcgcaagtgttcatgcctacttgcctagctatatgaaaagtatcttgtctgctggataacacgacataatcatcactgtttacatgacaaatatcgaagaaagtagctatacaacaattttattactagtttagaaccttttagatattattactgattaaagtatacttatattgtaattataccgacccaaaacataagcattttagacttcgacacagttttcaagatattgttactttaaaagagttacatattatgatagtttgtttaatgataaatctagcaacattaattttacatgattgatctttttattttttctattaatagtcaaagttaaaaatatttgacttggcactattttaaaaatatttatattttaaaatggagggagtattgaaattactactcaggttccgatcaaccatttagtttatctttttatttaagtcttatatgtatgaatactacaaagatgactatcttaattggagcaagttgattgaccgttcacattaccatacttggggcttatggtaacgtgaacctaaggctgagttcgtttggattaccattattataaatatatgactcttatttggagcaggccgagtatgttgaacctaagggtcttatatgtgtgaagactacagttggtatggtaatgtgaaccaccgtaccgccacataaataagagcgatgcatcagcgcatgattaattaaatattagctaaaaatcttacaaataatctagatttcaattgccccagtagattaatatattttctaaagaaatttttctatattttttttaaaaacacacatttaacagtttagaaggcaggcgcgcggcaaacgatgaatagaatctaaaaaaatattcaaaagaaacacagccaaaagggcccaacatagaccaagaaccagccaagtttagccagcataagattacattgacacttcagaagaggcccaatccaacaaacgtcccttctttggataggccgaaatcctgccacatccaaggtcaaaaaaccggcccatacatacggatgggccaggatggaggcccaaaaaccatgcatatcagaagcagttcaacagaacaggattgcaatgtaatcctaagcaggacctgaaattatttctcctgctgtatgagatattgagatgtacagacagtcccaatgtacactcaaagttccacaacaaaaagtgctcaaggtaaaatatcatatataaatatgagcatttgctaggtaaagttaaaaaataataataatgaagtgtgttgttcaacatctcaactacttcctccgtttcataatataagtcattttagcattttccacattcatattgatgctaatgaatctagataaatatatatgtctagattcattagcatcaatataaatctgggaaatgctagaatgacttacattgtgaaacggaggaagtatctatctatgtatccatgctgttctagtttcagtagtactactgtcaccagaagtcgtcttgatcaccaaaaggagggccgcactcaagtccactatgcatttttcttcaagctaaaaaggtcattgtatagcacaaacagattatggtgcctccactcctttgtaaaggagattccagttgaccaaagtaaacggcagaatgtgagacttcatggagaatctattacaatgctagtctgcttaacttgtcttgtcactttctgtactaggaagctagtacaatggaattactgcaaagatcatacgaaaattataaattgctacgagaaaagttatgtcagacctggtgggacccaaaataaaatggaaacgcatgtttcatgtgataaaacattgaggcgtgtgtccaggaaaattctgtgaaaatacaaagggatgtgaggaggaacttactacagaggaagagcattgcatccagttcgattgaagatgtgactaagaatgcatcgcaatcagttcgtcttctttgcatttcctgatgttaacatccatgttggtttcagatgaggaagacacaacatcacagcaatgccgtcttaaagcctaaaaacacacaacagtaaaagaacaatcacaaaatcttaattcgagcactgaaatttgtgtcacaattgatgaaggcaaccatcatagccataccttcccaggaaccagatgtaatggctcagatgccacttttatttggtgaagattcctcaatggaatcaagttaggtgagcattttctaggcagctgcctagtgtaatcgcttttgatcttgccttcacctgaagaaatacttttgaggaagaaaagagcagctcttttgcactcatccctcgggtaatgcttggtatcaaacataaaaacatcagtagcattgcgaccccttttccacggcacaaacgttttctgcacagcaaggaggtcaggaagcagcacattgcctttgtacacctgaactgaatacccccaagctattgacactgtaattgctttcgaatggtcatagcacactgtctgctgaaggatccttgctggatcagcattggcagctctgaagaaatgcttcaccgctgttgcacggtccatacccgggtaaagaggatatacatgatcaaggtggtgcagtgaaactaaaggagtaagcggatgcgctcttaggagtccagatatgtccccatgaaggtcgatctggatataacaaatgcaacacaacacacaagttaagaatcaagattttttttgttgcataatattaagtaaagccatgggaatgtttcgcgtctaaagagtcgtcaagaagaagacatctcatagttttcagtggctgaaaatgaggaagaaagcaataccttgcagtttatatagtgtaagtcatacaattcagtaagtgaaacacataggtggagcaaaaggaaatattttctgctgccatatttaactgtcagacagcgacccactgcactacttatttcagcaacagccaacagttctagttgacaacatcattatcttggaagatgcccattttgacagcattaagatagtgatggcgaagcttaagataatctgaaagggatgtgtggcatgcggaccaaagcacccactttcaagtgccctcacatcaaaatcagtcgatgcacaagcatggatcactaaatccagtgggcagtagcaaagatttcgtattggttccgcaattcgtagttgtagttgttagccagtacccatcgcttatgttctgtaatcagtatggttccatgtgtacacaacttagcaacattctacaggattggtgtggtgtggttctgcattccttgagagcattctaaaggataagctttttcttgaaaagtctaatgtacggcacaaatgtatgcagaattgcagacaacaatgtacactaaaaatttatagtggaagcaaaaaaaaaaaaagtttagagtgctgacagcttaagattttctaccattaacaacataatcccttcatactaggcaatgattttgcaagctcaatactatttttttttcttttgacctgatacaatccaaaatttcacccaacgattctcttccataactgataacttaatatcaaagactagctatgcctctgaactacggtgtgactaagcaaggctgaatagattacaacaattttttttttgtgaggaacaacatggttgtactacataatgatttaattattacagtaatacaatcattgttatacaaaccgcccgtgatggtggttacgcggcacaaaatacaattatcaaatatggtcagatatatcctgagacaattcctgctctactcaccagtcaggtgtcaagagtaccaaattttgattttaaaaagttcattctttatcaatccaccagtatctatctatctatcattctatctatcaacacaattgaattaatgagcaatcagcaatctaacctaacattccattagggcagtagcatgttgatgagaaaatgtaaacaataagaagcaaaggttacctggtggaatcctggctcgtgggtgagctcgacgccgagctcggcgaggcaggcgtggatcctggcgtcgctgccgtagagatgcgggtacctgaggaggcaggagtcgaggacgcgggcgaggcgcgcggcgagcggccagctcacggcgatgccgccgccgccgtaggccatggcgaagccgtgccaggcgttctgcgccgcggactcggagcgcgcgccgaggtaccacggctcgcgccagtcgtacctggagagcgtgtgcaggaggttcgggaggacgaacgcggtgtcgtcgtcggcgagcacgagccaccgcggcgggggcggcgtcgcgtggtggtggtcgtcgagctgcaggagctccttggcgatgcgcgcgacgcggacggcggaggggagcccgcgcgggtgcgtgtacgggaagcgggaggcgtcggtggaggagacgcagaagcggaggttgggcggcaatggctcggacgcggcggcggcggccggcgccgggccgtcgaggaagaggaacgcgcgcgcgggcgggcggagccagaggcggagcagcgggaggcggagcggcagcgtgcggcgggaggaggcgatgccgaacaccacgtgcgccagcgtcgtcgtcgtcgtcgccttgggcgccaaagacgacgccgctcgccgcggcgccggctcgtcgtcgcgccgcgtggcggtggcggtggcgaggaggggaggcggcggggaggggtggggacggtggatgaggaggaggaggaggagcgagaggagagggagggagaggaggagtgggcggagagggaggcgcgggcgagacggcggcgtcggcgccatggcgcgccgcggcgagcggaggcgggggttgaggttgagcgtgggaatgtgtatttggactttttggagtgaggttgggaagaaaaccaaccgtctcagcttctaatcaaaccatacattagtagttttaaaagagggtaataaagtcatttaacaatctcttttgttcttgtgcacaaatctaaaacaatttagattgcctcccttcctaaatatatgtctcctttgcaacgtaggattcgataatatgatttcatgtcttcttgaattctggaggaaatgaatatataggaatttacaacaaaaattgtttaacaacacgtaacaaaaaaacatacggattcaaaccagaaaaatgagtctagatcttttttcctccaagttctaaaggattgtaaggagaccggtcatttgtcccaatgaccttaaacgttttacttatcgaagactaggtgaagtaatatgattgttttatgtaggatttcaatcctctatatttgctccatttttcttttattttaatgaatccctaagtaattttagggtctaagtttgagtaaaaaagacaatgatgtccgttattaaataatgtaataaagtcattttaacaatctctttaattcttgtacagtttttataaatggctttctttttaaaaccagatgatcagataaaccataaatcttaacatagtattccctatatttttttaaaaaaaagacctcttttttcttaaaaatagttacaagttcttaaaaaaaagtaccatattaccaaagtgaattttatactaaacataagcacaaaacttatagcctgactattattaagacttattcgttgacaatttgaaatagtactagatacagtcaatagctatttgaaaatagagggagtagagtagtagactccatgaaagttagtcaaatctctaaaagaaaagagttcccgggtgaattgtgatcgctaccgtgcttcagcatttgtgttcccatgtgaattgccgcaactgctgtctggcacccaaatccggtggattgctgtaacgctccgcttttcgtgaggcgttaaaaactaattcggcaaaatcctaattgtgaaaattttcgttctttgtgtgagagtctaagttgtgccaaggatctcaatttaatcccgttgttccctctcatcgaaatcaaaatcctccacctcgaaaattcctccttcgactcaaatctccaaatcaaattccgaaattcaatccctctctttgaatccttgccaaatattcgccctgactccaaaaataaccaaattcctattttgaattccttcccccaaattcaaattctctccaaatctatctccttaaaaaaaggtctactttacctccctgtatttttggatggaccgattttcctcccccggcccatctcccctcccagcccatcatcttctccccccacctcgcacgtgcgttgcacgcatgcgagccgagagagagccgtcgctcgctctctcagttctctcgctctctcgtcttcttcctctctctctctatgtttctctctctctctcccacgccagcgctgccgccatcgccgatttttcccgctgccgccattcgattttcggccgtgccgctcgttcccgcgcgcgcgcgctcgctcgaggccagccgctcggtcgccgccgcgtcagccctgacgccgagccgctcggtcgccgccgcgtcagccctgacgccgcccgtgaccgcgcgtcgcccagccccgcctgtgcgcatgcgtccaagggagggagacagagccctcggcctcgctccctctccctttcctttatcccgaaacagcaaggagcagagctccctttcttctccacctttttccttttgcccgaccaccatcggcgtcaccgcctgccaccaccttgaccacaccagctcgtcgtccttgcacccttgaccgcctatgtcagttccccctcccaaaccgcctcttttccatctataaagcctaggccgagcctccctatctcattctctctcggcatctctcttccaccgccgccgcgcctttgttgccgccttgcagctgccgacctcgcctcccttcgccgtcgcgcgtgctggtgaagccggcgtgtgcgcgaggagccgaagaggactccggccacccttcttcttccccttccccggcccaaggccgaagaactcgccccgcgccgtcgaccgcccatcactgcccgcctagctcggtagtgcctcctcccgttccccttcctcgctctccctcgccccctctagtctgcgcgatagctcggtggcactcccgaacacgcgtagacgccgcccctagacccgccgccgcccggcatggcctcaccgccgttgccgcccgctcccggaggccgccgctcgtcaccagccctccttggtgctcttccgccccatccgacgccggaaacggactccttgaaccccggagatgcttccaccgcctcgaattgaatcctcgtcgcccctctaccgtttgccccttttctcacctccggcgagggctgccgcgattcgtcgtcgccggtctcccttccgtgaatccgagccggtggcgcactctatctcctccgtctcattattccggtgtgctccctccctctcgaatcgtcgcgacaacctccggtgaactcggccgccgtccgccgtccattcggccgcgccccctttcttcctcctctcgccggcccgcgtggccgctgcgtaggcgccacaccggtgccaactcggctagaccgagtcaaaccggccagcctcgcttccccctacgtgcgcgcgcagaccacgatgagccatgcggctgcacgtgggcccatcgcgcctcgctccacccggcgcacgcgcccaaaccacgtccaccaaaccctatcgctgcccttcccgtgagcccttccctcagtgaacccagtcaccgacaagcgggccccacccgggaccccgcgaggtgcacccgatccaccggtcggcctccccctgccgcgcgcccctaatgggccgaccacccgcgcccgcgctggccaatggcctgaccgcgctgcgcatgaccccttgggccgcgcctaagccgccgagtaagtctaaatgacatccctccttccttttcttttccaaaggatttgataaatccttttcctttagacagaaaatccaaataatcttaggaaatccatatctccccaaccgctcgtccgattgactccgttcaacttccagtattcacataaaattgagatctatttaatggcactactaattagtctaaataggatctttcttttggtcttttgtttaggttttcgattgtttgcgtatagttgcggttatcggattttcgtcgatcgcgggttttctcgaagattcgtgaagctttgtgaagaccttgagcaaggcaagtcacccttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtctctccacccttgtggtacctcggtattcgtgctctctgagcgcgtatacaaataacccacatacaccgttgtttgtcgaaaacttgggaaatgggttgtgaagccttcaaaacccgacatgtggtgtcggtgtgtttgaaaataaaatgaattgtgaaaactcgcgatgcgggggttgtgcctatgtggcactgtcccgtattcacatataaggaccgattcctgtgggaaactcatcgaacataatcaaagtgcaaccacaaggtggaatgggacaccctggctaagtaactagtcggttcagggaaacctcgcatgccaatagttgggaacgccagggcggggtcggttggagccaaaccaggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaagcggattgctttgctgctgggcagctggactctgggagtccgagaaaatgaaaaaggctctgggagccgattaatcaagtggaatggctctgggagccgagaagtaatgatctgacccgggaggtcagtacattaccaaatgagctgttgaaaaacatctcttaaagtcgaatcgagacgcaagtctcttttcggcccaaacttaaaaagaaataaatcacttagtgatttcaaaatgatttcaaacaaaagatttgcaaaacaaccttgcctctcttccaagcttgcattaaacacctaaattcccgtgacttgctgagtacgaaagtactcacccttgctatatatatatatatatatatatatatatatatatatatatatatatatatatatatatatatagntcctccaccctgaagagaagataaagtgaagtgaagattagggtttcgtcctggttcccagccgtcgcctgtggtgttgggtgttagaccgttggttccgctgctgctgctgctgttggtgtttcctcgtccgcgtcgtcggttgtattctcgggctgtctgagctgcaacctaagttaaggtaaataagtcctctatttattttaaagattgctatgattcatatttgtcaccgtggggaccagcactatgtcctgggactggtaccgagatcgcggtttcgtaggaagctgttcgcgccgttttcttacgacacgctcctgtcaggtgccgttgtacgcgggtatcagattgaggtgtgacaattgccggcctacgccttttagagccaaagggggtccgcgccctagggatgtcgtgcgtggccaggtcatcggtgttgtcgacgacatcatagtcgtagatgtaacaccccaggtattcacttacctaccgagttaatagtttggattataaggatggatcgctccgtgggaatgatattattattagtttaacttcaattacctgttgtggatgtccgaatttacatgtgagactctgtcgaaattcttaatgaatttaggacttggtggtttctgtaccgtagtgtgtagcattctaggtaagtaaacctggggtgttacagaagaggcaggtgagcatcttcgcccgaaaacagtgcaaccacgagtgatcgatcgaaggtgcgggcggtggtgtccctcatggcgagtgtgtgatgtaggcgtgcagtggtttgtatctcttggcgacggcactgatcacttttaggcgaagatcctgtgcggctggcgtccgcggtgcacgcgcagtgatgagcggggcacgacctcccccgccttgcagtcgccgattgtgatgtggcaaaagagttggacgttgacacatggctctcactcaccatgttagccaaaactggccgctatactgtcgaaggagtattgtgagttgggagatgggcgttcgatttgggatgtaaagtgaacttatttcttctatttattgggtattaattgacccagttgaaaaggtaggcccaatatgcaagcactggactcatgcgagcggcgtgtgcggtagggtgaaaacgggtcgggttcggttggatatcacccttcccatatcctaacccatattttataatcgaaatcgggtcgaacacggatagtgccgaatacggatacaaacttggataatggcgggaaaaaatatggaacaaatacgtaccaaaatggatacgtacactatcggttacaaatatttattcggatatcaagtcgaagcaacaatcttacatatcacatagacaataaccatttaaccattctatatatctataatacgattatattaggccattaggaccttagaaaacaaatagggtacaatacatcatagtagaaccaatacatagtaccaaaaagtgtctcacaaaaacataatatatgaggctagatcgcatgtttgttttcctccaaaattaccattaaatgagccaaaggattttaaggaggttaatcatttatccaaatgacctaacaggattgttttatgtaggatttcaatcctctgtatctgtatcaaatgagtctaagtaattttagggatctaagtttgagtaaaaaggataatgatgttcctcgttaaaaaatgtaatgtagtcattcaacaatttctttaattcttgtacattttttttatagatgacttgtattttaaactagatgatcaggaaaagcataaaccttaacatagtattccctatatttttaataatttgacctcttttttcttaaaagatatttactagttcttaagaaaaacgatatatattatcaaagtgaaatgtatactaaacataaccacaaaacttctattcaccatagcctaactattattaagagtttattagtggacaatttgaaataacaatagataccgccgatagctatttgaaaacagagggagtagagtagtagactccacgaaaattagtcaaatctcaaaaaagaaaaaagacaaagagttcccatgtgaactgtgatcgctgccgtgcttcagcagtgtattcccttgtgtatcatcttttaccaataaagcatcatgtgtccagtgtccctcaaaagaaaaaaaaaagaagagagaaacaaagtatcatgtgaatctagttgcttttcataattttttttctctcttttttgcacacgtatatatgctttggctgttcaaacaatacgtctccttcaagtcaccatgaaaatggcgcgaggaagaagccgacggccatgaaaacgccatcgttttggcgccaaacggcaaccacatcccccatcgctgccgtcaccgtctacattttccatggctggtcttggtcttcctcatacgactctttacagaaccggaggtcagcttaaatctaattaattgcagtggcttcatgttcagaagcttataattaattacgataaaatgatttggactgatgatgaatcgtttattttggacatttggaataaattaattaccaataaaacgtacaaggcatcaggtaattaaaatgtaggcatgctttgctggtgctttagagtgttaacgagaatgcaggataaacaattcttttttttattactccataagggaaatgcacacccgtgactcaaagagactaagccaacaacaaatccctaatctcactaataattttttttattgatagcacaacacatgtgtttgatatttttgaacactaggatttttttgatatttttggacactaggatttaaatcatagtggtgaatcatgcatgactccaacaccaaatcacccgtgcttacattgaaaaaatgataaacacttttttacgacgatttcacagagaaacaaattatgagattaagtactatattcccagcaaattattgataaaaccaagtcaccgaccaacatcctgaatatcttgcgataataaatcttacatccagctatagagttttctgaatgttggaaaatcaaatggcagttttgatgaacgctaaggcaaagtagtataacaaagtataccaagaacaaatcgccaattcagccttattaatttcaattaatataatccttgcttcacttttgtttcttgcttgggactggggcggttgggtgatccacttcatcccaacgccatatgttgccatcctctgtgcaggcaaggattgtgctgaagaaaatggaaacacaataaaacatttttttaatcttccaagaagaaaacaaacaacaaaaataaaaaataaaacagaagcataaacacagtgcaaatgataggctagctccatcagaatgaataagcagggataaatttatagtatgaacaggatgaatgtagtaatgtaccttccatcaaaggacactgcagtctgccttatggctgatttcacttgtggattattgagcctgtagatgatcatgatgatgataagcacacatgtagaagacatgagaattggtagaaattaacacccaacaggcaacacctatataccaaattaaatgcagacgatgaaacttaataagttgagttcttgaggttaacattaccgagcaattagaacaggagggctggtctgtactttccagacatagactttaccatcacggtttcctgtttgaataagcacatggttatccttcagcacttcacattttgttttaaagaatatcaaaatcaatattgcatatccattatctaaagaaatactagcatattcattgtcttccaagaaaaaggtatattgtgtaataatttagaacgataacaacaaaatgattcgtcaagccttacaaaaaaaatgattcttgagagaacagtgcaacattagttattacctattgccaactgattgtggtgaaaatcacatgagaatttcatgaaccagatgttacattctggcacagggtacttctgaagaacatcaatgtgaccctacaaatcaaaagaaccattttccttagaggaagacatagtatgtattgtagtatgtatagggacatggagaaagaaagtaacatggtttctttaagaaaataaacatagccagattagtttggatataagtagacgagtaagattttgtaattctagagataaattaaattatattacctcgccagggttttcttcttttgtgatcgattcccacagcaagatttcattttcaacactctgaaaattcaagtttagcagacatcagatgtattcatccttcagaaataaccgaattttcactagaaaacccaatttgtagcactagtctaaggattggaaaacttgcactagcagtagaaaataaatttgtcctttatgactagcataaaaacacagtataataattttttaagcactagaaatattggcttcaaaagagtaataaaaattttactctaatgaatttgtcctttttgtaacccaattgtcatgggaaaaccaatctgtaacactaatctaatgattgaaaaggctgttcctggtacagcctggaaatttgcagtatcagtaattcagtatgtatagccctttatgaataggataaaaccaagatataataatttgtaagcactataaatattgacttcaaaagagcaataacaattttacctttgacaggacaaagtccccaagccatttagtacagtctacatagttagaatgtatttcagcacacaggacctgaaaggagagagatgataccatattggttatacatactaataaattacagattaaagaacagattcagatatgattggcagatactataagcataccggaaattggacaaattttgttggaaattttgatgtagcatcagtccatgaataggatttctcaacatattcccagaattctacagcattcacacactttcaccgataagcatcatgcaattgccttttctttttatcatgagatggttcactaacctttcattgaccagattctcacagtgttgtccattccacaacttaaaaagcggtagatatcagatgtgtggaagtcctgaagcaataatattaattaattatgattaatatttgcactcgtaatgtaaagaaagaatgcgcaaaatttcagtgactaaggattatttcactcctggtgaaatgaataaaattgaatctgctcaataaaaaaagtgacatcagaagctggatgagtcctatttttaaggacaatttcaagttaattagtagcattacaattttttttataaaaaatgctacagtggagcttaagcaacttacaacaccaagtacttcgtgtcggtgacctcctactccaccaaaaaccaaaattaagatccctgtctgcacattccacagcttaatagattcatcctacacaatgccgtatgaaagaacatcagtaaaaatgaaatagatgtagatatcagattaggcaatgtaatcttctaaccttgcttgcagaaatgatgagtgaaggattcgatggttgagactttatttcgtttactgaaccaccatggccaacaagactctgtaattttattttatttttcataaacagaaataaaacactggccgcacatcagttatgtacttgatatagaatggttcataatttatatgccaattttctgactagacatgctaaagacccactgaaaccacaaatgtttagaagagaaaaggcacaatttagtagctatatagaaagtcaaaagattgctatagttcttaatcgaagcgaattacatgtgacctcctggaatggataacacagataaatcagaatctatcaaataagaaattattttccaatatataagcaacagaaccatagcttggcatatattactgaaaaaaaaacatatatagactgatacagagcaaagtttatccaaggttgcagtagtggcaaagaagaaaaaatggcactagcactactagaccttatatatcttctcagtggcacagttgatgactcgaatgattccagtgcttcctgcagctactaacaatggattgccatcaatgtcgcaagcccagctcacagtgaagaatgactcattcatctgcaaggcaatggagaccccaccatggttagaaaaaggcatgccatcaaacccttcttcatctaaaataaatcaattcctgactacggatctggacagctctgaacataggctatctctagatccatagcaaggaattggtttattttggaacagagggtgtagataataaactgaacactcaaaattattggcagagcttacatcgtcatcaagatagctttgcagaagagcaaatttgccattcatgaggcagcggtaggttgaaagctgcaaaggtcacgagggcgcaacgtgttagcataaacacattgaaaataacatatgtgcataactccatccttaaaatttaattttatgatcaatgaaatctatgatcttataattccttcccctaattatatttttatcaaaatattcaacaaaattatattttttaatgcacttttaaagtgtaaagcgcattcgcaaagtgtcgggaccccaactaggatccctctgtgtataatgtgttagtcccagatcaactctagcacacacaataacaaaaggtaatatcataaccacatcacgattacattaataaatataaaacaaaaataattttgaggaatatttctagattgataataattcacagagttgagctccacttccaaactcgaataaaaaaccataactccaattaacaaacaataaaataaatggcagcatgattattttatttagtcaaattttaaacaaaaatatttatgaaattttcattaagctattttaggtgaatgaacacgaatgtgaattttcaaaataggcaaattaagaaacatgaaaaaagggacgtgacacaaagtcagattaaaaacatctaatgcgaataggataataaggtaaatactagattttgatctatttatagaaacatgaagcgctactacttccctagtaagatcaatatggcgcctcgtaagaaatcttacacgagggccacaggcggtggcgaagatgtcgtagtagcgaacatcgaggaaattgaagacaatggcgtagacagggcgccttccctcagtgtgcttgttggtcaccttgtattctcgctcccgactcggtgttagcgatcccaccgctgcctcgcatcccaacccctctaatggcaccaactttgccatccgtgcaggaagtgttgggatgcttggaagctttagcaccgtttcctgtggttcaccttcaccagcagttgatgaagatggcctttccttggcaactctggagttggcaacagcgggagaggcaaaggcagaggcagaggcagaggcagtgatggagcggttgcgctgtggatatcggggtggtttggcttcattcggtgccacacttcaattcaaatgttgtcggatttaaatatatcactatatgtgtttgaaacatttgtgggaaacatgtatatatccttaaaaaatgtgtgctatataagaataccacttactctttttgagatgatttatggttcctactagtggggcccatctttgctcacgtcttgtccggcttgaggttgcgtacttcctatcacaagtgacgataatctcaatgataaacttattctcaaacatcttcaaaaaagaacttatgaccaatgatagtaaaacgaagcaaagatttcaaatccgaaacaaaaagtgcgtacctcttgcctggagagaggagagcggtgatgaggaagagagatgggattaaataggaatagggagcggcggcgggcggggtggaaaagcaacaataacctaggtatcttttatagggaaaaaaccctagggtttctcatgttggatgggctaaatgggctttttaatagcatagatgggccacacaacttgaaagagttttgggttgtggagtttgtgtgtatcatacatatatatagtaagccttgtgagtagcacactttatctatataaaaatgtcatcttttaagtatgatggaaacaaaggctctaggttatattctaattgtgtacttagcatacctagttaacttagcaatgtcattgtgaacaatgaggatgaattcactaaggtgggaggtagtaatagtgaagaagaagaagattcgctaagataggaggtagtaatagtgaagaaaaagaagaagaagaatggcaattaagtagacgtggatgaaagctagaagggtggttggcacatcgcaaaagcaattgcaactagacatctctctcttctatgtatagaaaaaatttagggtttccaaaatcgattgcacccaaagggacttctctaattaacatataagtcccacgacttgatgatttttggtggatgaatatttgaaacttttatttattatataatattgtgaatagtgtgactagccatttctagaaatggcataaacgaaataagtttttttcttaatagcatagataaatgaagcaacttaatgagtttttggtggtaaggtttataagtggaagggtttgtagatcttgatctatatggagagcatggtgtgtagtacacattatttattaaaaagacgatcatcttctaagtgtgattgacataaaggttgtctaggtcatcctatagtgttaggttgtttttacaaatattgtgtaagtaagaattgatatggatgcaccacaagtgaactgttaagtagtaaaattttaacaagttaatatgaatatataccgtgtctagtctacttgtgccatgtgtagttgcaagtcgctccactgatcaatattctctcttaggcttcatcagatcattgaaggcattttagtgtcctagggactatggtagtaaagtatcgaacttgatataaatacctcctgcataagcaaatattcagtgcttatatgtttatatgttcaaacatttgtccatcaatcaactttagaaaaaaaaaattgtgaacatctatagtgtgtttgtaccgtccttgagaatgtgtagacaaaactcaaaataaattttgagaaacaagcggttgtattaagagagccgatatatgcctccttagtaattattcagaatatgtatccgttgaatttatggagccgtgcaaattaaatagatgttaaatttcaaaagaacgaaacatgaaaaccatattagaaaagtttttttttaaaatgctgaaaacaaaacattccttgatgaaaagagtcatttgtggtttaggataaatattcgtttgagtggtaaagatttatgatacaacccaatttcgattcaagttcatttattttttagttgagctacactacaatttctaggattaaatgctttccaaaacttacagaaattaaaactcttctatacaaaaaaaaaactttatactaccagatatgctacaactggatttatgttcaaatatgaattttgttgtttgtgtaatcgagttatagctgtacgcacatgatttgttatgttgactttgattcgtgattagcacttaccaagtaactgggattgttttaataataataaaggagtacaccgagaatagaaccgtatatatcaaaaggcagaagtgtgcagccacaacacactcctaaaaagggagtagtaagctggattttttatgaaattgacaacttaccacaagatttgcatgaattcattttcctaaatttaatttaaactttatagatataaataattaatttgaccaagaattatagtattgattaactcagagtaacatttcggatgcatttcgtgttccttgcgattggcacacacgtctgatgaagatttattacagaggatgatctgacggtggctgataaagatccagcatacaatgtctacgaataaaatgtgattatcaactacaatcaggccactcttaacttaaccagtgctcaagtttaattgttgacatgactaatcaggtggcgtataagtagtacaacaatcagctgactccaaatgattgaaaaggtattctaaaagtacagagtagagagcagcaactcgatacattctacagcagggagaacagattcaacacatgaactagaatctaccatcaagaacataacaggttaagctggattgcttcttatgttgccctctcaaaatctacaaactaactagtcataatataatgataaatatcgtcggataatagtcgatatagatcaacaacagggtggctgtaatacgattgcccacatgcaccaaatttggtcacaaatcgtagcgatgctccacaacttcatgggcacttcctttggatgtaggatactccatgttcttcgtatctatagtgagataaatcacattaacttgtgagctgtccgtgacgagataggggaaacataacctaaaatactgtgttgtgcttactctgctttggagaaccacatttgctggaacgacccaagggatgctagaatgctccctccaatccaaacactgcagaataaaatgacttaaggtatgtatgactagaacaaagtgatcagtatattttggtagttcatgtgttaagcttttcaagcaataaaaacaagcaacagagttgcactttgcagagccaaaaggcactcattcaaacttctccagtgagcagtagagcaaaatgttcaattgaatttgggaaggataaagactacaaagataaaagggaatacctgaatcgcctctctactgaatttccacttgccaaaacctttacacgagtattaccagaagattcctgcaatattttgaggtatatataagaacaagccttgcacaaggtctaaggaaacattttcaatagcctgaaaacagaatagagttctattaacttgcactctggcccgttattaactatcccaagaaaaaaaatgagattcatttattcttgtatttccatattggacaagaacaaagaaaaagatcataggcttgactcctatatgttgtttcctctgtttgaaaacagatggcattagagacatcaaaggactccaaccacaaatctttaactgtttctaagttctgcatttataattatatgttattcatataatgataaaatatactttttcatgaaaaaggcaaacctaccactacttctccatgtagcaaccccggaatattttcaatgtactttagtagttaaaaatttaaaagtttggctgcacaggctataaaatggtgcacatttaaaaatgggaagtataaacaggatgaggccagggcagtcctagtttgttctgaagaaaaaatatacctcaagtacttctttttctagcctctccttcaactgcagaattgatgatgaaccacctgaaagctatccacaatgcatgtttgcagatgttagaattgtattaacagaacttcacaagagaattttgggaaagatatcactaagctcatggatggcaacaccaagagagctagtaaaatgtggttgaagaatttataggcatttaccagaatactgcttagcagttccttgcgaatgtcaacatcgcacctatttacactatcaatgacctgagaaagtaacagcaatagcaacttcagtaatatgaagaactgccagggatgcgcaacagtaaatgcaagtctagctctcatttaactcaccattcgtggaaggccacgaactgacattgaatctgcaaatccatcaactccaggaatagtctatgcatcacaaaattcgtgtgcatgtgagagtcagcaattcaacatggttcaaaagaatttttcaagccatcaacagcatctactgaagaagaaaacagcaagctggttttgttctggaacaaggtaatctagtaccagcaccagttacaaatcctgcctgaaatacaagtgtacagcaagtattattctcttcatcaaacctcacctgagaaagagatggattaaacagaatatcaggaatcttgaatctgtctgcaccaacttcaatggttctgtccagatatcagacagcaagttaaagatgcttgaaaggtacattgcacaaacaaaatcttaaccataatgttgtagaaaatagcaaggaaaagttcagctatatcggtgcatctcaacaccctcttggtgcatcatgcgccactctcaaaataacatgcaaatgaccatgacaatttaaagaagttgggttcatgagatgacctaccaatctgcaaagtcacaacatatagaagctgaaggtacatgggaaggttaaaggacaataaatcttagtgctgcactcaagttctcccttctatttgacttccatttcactgaactagttcaaattgtggtatactccctctgtagtctgtcccaaattataggacgcccttatttttaaggaaaatcaaactcggtaactttttactaataataatactaaccatatcaatgctaagtattatgcatgttatatcaccagattcatattttgaagtactttcatgtgatgctaatttcatattcattgggaagatgacatggaataaattaatggtcaaagtatgtcattgaagaccatgtaaaaaatatatatgccttataatttgggatggagggagtattaattttatgtcaatatattgttgattttcattgtggtatatcaattttataaacaatcattgtggtgtactgaggtatcatgcacagatgcagcagatgcacatgcagaaaagtagctcataatctaactgtattggaacacgtcaataagccattacaaaattaaaccactaaacctactggaaaaaaaatatgcgcataaataattttgatatacaacttactgtccatctggaagctcatatgaagttgtaggaacgtttgcatatgccacttctgcatgaaaataaaacagggaaaagtaaacagcagaacataaaaaaaagaacataaaaggacaggttaaaacagtccctgcaacaaagataatttatgttacaggacttcagataataataaaaaatagccaactagtgcgtgtacggcagggacaattgcaaatttaccactactttgaatcgttattgcaagactgccactagaaaattgcaaaaatgccactagaactgtcactcgagtggcatccttgcaaaattgaaaaaaccggtggcaaatttgcaaatgccccattcataaattaaatgtgtttatattataccatcgaaggcagtatctggaaccctgcaaactgactccttgatatcactagcaatagctctctgtgaacatatgaagcatcaccattgaaggcattcagacaaaattaaacaacagagaacaaaaataaatgatctgtcaatgaaaataccatgcagtataacttgtaactctccgttgtgtttggaagatcaagatctacaacctgaaaagacaagcatgccgtcaaataatccatatggtgttggttcccttacaatcatacagtgtaatggcagcaaaatcttgtagaagccagggattagcaaaaatcatggtatccacatgtatcaaagtggaaccataatcatgatcaagtaacacaataatgcagacccttaataatagactaaatgagtttgaccaccaagaaataggcccccacataaatgctaagaaataatgaccatagtattcctctccatgaatagacatagacatactcaaggtaactcacagtgtgtgtgtggatttggttttgataggagtttgtggagagtagctatccatgtgccaaaagcatgcacttttaagtggtacattggtttgggtgcttcagtttgaatttcatctctagcctaccccaacttgtttgagactaaaggtgttgtagtagttgactaatttcactttttggatgctttggatgccatccacacttggggatacaaggaattggtgattaaatttatctttcagaggaaggacacgaaagtatattttgagagatgtggcatggagaagacttaattcggtgccgaaaacaaggtcagcaaaaaaacagactgcccctcaggatcttccaccttttctgccagtaatcaaatgccaatgtgtggactgtgaagtcactccataggtagttaactatttttgtagtttatgtttgctgctttcactgtttcatatttttatcaagtgaactaatttcgaacataccaatagctaagcatatattgttatagttgattttcaacaaaaaggtaagcttaaacagtcaactttgtagctctcagggaaaaaatatgaatatcaacgaagtgttaaataaactagaccttatattcgccagggccgacttccttcttcttgaatgaatacctgggccttatctgcaaattgaacattgaacaaattggatatgaacatacaagaagactagtatgctatcttaagcaagagagatgcttacaacaacgcccttgctctccaagcttttcatcatacagtcagttaaaaattcaccaccaattggagaagtcgccacagactgcaacatgaaataagttagcaacaagtaggggaaaaaaagtatacttcctgagaggcaaggtgagagtgctgtccatgttatgtgagcaagcgtccatgtaaaacaagaaaaagaaacttattgtcttaaaagaagattcccttattcccagttttcagatgagaaagtagagaataaaaagggtaaaaataactaattagacacatgcaagtagtgcattatgcactttgccttgacaatcagtattaaatagtagatcataccttttgcaatacataaccatcgtgaacagcagcaaccacagtagacccaccaccgctgcacaaaaaatgacaacattgtctcattccagtaatgtttctcataacaaagcccaaaagccatgagaacaaaaatgaaataagtcataaaatgcttgacaccattaaagtccaatagagacatcggtggacatgtcaggcatcaaatttgagacaatcagatactatggcttaaaacatgctgaaagaatttagatggttatgcttacaccctataccaagatgatgttaggaatttatgatacagtaaagggggaaagaagagcatcaatcaactcaagtacaatattgatgaccagtaaagaaaatattgatgtcctgattcttgaatggtgtgggaagtgggattgacagaacagacaaggatagtgtttctcgctttccacccttggatgcaagcgcatccttcataaaaaatgatgcagatggtcattaaaaattgctttttgatttctaagttcagtttcaacaggatttgtcttgtttgtctatgtgtagtttggttttatatttgaaatactgtgcatgacagattgactttgatataacagccattttctacttccatggacatttgtcatcatattctaaggaggattgacaaggtaagatacacccaatatttgtgcactgtgcctaacgccctaacacttactggtggaaaaatatttcagaattcaaaagttataatgcatttgtttataagttaaggctaaatgaaacattttatctacaaggagacagtaagttacagctgcagaaataaaatttaattaaggacatgctcacctgtcaactaccaacgatgtagcacgtccagatgcaaaagatgtgagaacctgacaaccaaatcaacaattagaactaataaactaattacacgaattatcacttttgacaaatacatactgcatttttcgctaggaacagtgccggcactttgtacttctcaaacataagttctgctgctctatggaacatgagaaaaacagtcaggtctttttcatagaaccatacaaaaataataggcaatgaatagatataactcggattcatatcatctcagcttgtgcttattggtatttataagttttacagggtgatcaacaattccatatttgtccattcctgaagtacagaaacacagaaaaactaacatttctgacattaaatggagaagtagaaaagcatgcagtaaatcctggtaccaatacagttctcatgactgataagagtcatggaagataaatgtgctataaatcagctagttcatataacaagcaatgtttttcaggtttgacgcaacttagcaacacaattaatttaaatacagaacatataggcatacttctctctttgctgtcctgtgtttgtagatggttcagctatcaacataggatgctcctcaggattgatcaatagccgctgcctgaaatgtagagcaagtcagtgtgaagataaaagctaacaaagcagaaacttcaatagttgcatatccacaccatatagaggaaatcctagtatttaatcaatgttagctaatagagatgccacagaatccaataaaagtaaataacccaagaaggaaagccttatccagtttgtacacgtaagaaggaatttcactatcagtatatttgaaaagcacaatattaatatgtaaggtaaaaagatggtgggcaatggcataaagcagtaaccatgttgacatccaaaagatgccctagaggcctagaagatgaactttgttgcagattctaagcaaactatgttaaatagagagtatggttcatcccaaacttccccagaatcaaggaaggcatgtttggccttttgcagcaactggcaagtgtttggcaaaccacacaagcaatgtgccaaaccttgttactcaagtgccccgcatgtcagatatttattttctagtcaagttttgccacaagtgtggccagctctttcagcgcgcacttttggcacgacattactcagatctacatcaaatagatagttaaactcacctgaaagcatgattccatatattgtcaacaatatcccaatcagtaactgttccatctttcattggtgaaatcacctattgggtaggaagagaatcagtaaacaatagttaacaaaatcatgagcatcaatattgatacttgagaatctgcataaactaacctccatatgatccctcctgaactccaattcttgaccaacatacaatttgcgctttgtcttggctttgtccacatccataggtttggctccattcttagaatctgatgcagcttcagcctccttgtctgcctttgcttcatcagtttctcccgtttgctcaattgaaccaacaaccttaacacaacagaatgtgcaccaaccacagtaagaacttctaaaaccaaattacccattaggtagctcagatgcataatcccatgaaccaatgacatatcttgcaactactgccacgttatgtagaaaaaggagaagaaaatatgctaatctattagcagcgacatcaaatagtgaaactcaaaaacactttttctgtgtgattcacacaccactttttagtaccttacagctgattgttttgctatatgtcactaaattatatgttttctcacttcctcggcaacaaagagaaattagcaatctactccaagaattcaaattaccccaatataagtctgttaactaaaggaagaaaaaaattttaaaaaataatactgtagaacctaagacaaaaaaataccgcatcccaaaatatagtaacttcaccccctacttcctcatctcaaccaatcaaaaaaatcatatcccccatttaattccacctacttccttaatacccgtgcaaaactctagaaatacttatattttgggacagaaagagtacaatcctatttgacataatacacaagaaaagtacttcccgttacaaacacagtaaccagaagttcacctgtcatagcatttgaagttaacgtctagtaccaacatgtagcaattccacagaaaccacaatgcagattcttttagcactttaaaaattcagtttggcatttgactctcagtgcacatatgcaacactgctaactactacctatgcgagcaatggcacaggtttgcagctaagacaaagctgaaaggtaaactaacaatgcagtcaatacatcataattttgcacgcatatgtcaaaatcaaaaggtaagtgcaggtcttatctgtggtactatccaatatctgagttagcctgctactaacattttttttaaaaaaaaaactgctgttattcatgttcccagactaagatccagtgctcgaataaaaccattaatcaggtggctggggacctaggaggaactaatgcacgcagcaaaattcacagcttgacctaaataataaacatatgtctgtatatcatgacgccacacactaacacatcattcttttttttttcaaatcagaattcaaagtcaacgacctaaaacagctcaaaattatggggagaaaacacacaaaattgccagtgggattgcattgcgcacagagccctatcatttccatgacaccacccgcacgaactctcaccaacaaaacacagaccacacagttccaactccgagacagaattacagcgagccaacccaggaggggagaagaagaagaagaagaagaagcattctgcctcaccgaggggaagacggccttgggggtgtcatcaccggcgtaccccgccttgcagctgtaggaccccacgtcgatgacgatggccgagacctcatctgcgaaaaaaaccaagcagcgccagtgccacagatctctagggtttagggtttagctcggggatggacgggggcgagagaggggggaacttaccgccgccgtacatggctggggagatccgggtggccgccggcgagggggattcggcggcggtggttcgtcggcggcgcggaggagagaggtcggcggcggcggggtcggggggaggagacgacggccaagtgaaagggaagagaggaggagagaaaatgaaggatttttttttcttgtaccgaaattgccccccgcgtcggatcgtcttaactggagcttatcctagccgtccgatacggccctcagacctcaaccaatgttccctccgtttcacaaccttcatcacagttttcttttcttctttgaaacatagttaaaatgcatacgccgacaacacgcacacaaactacctctacgagcacctctagtaaactgagctagcaaatcttgagaattgagattgatgaaatcaccacaggtgcctcgctatcaactggtatgtcgcttaccactaaaagaatgattaggcgtaaatacgaacacacatgtcacatttaggatttgaacccgagtgtgctggtttcatcacaaggaacttaaccagttgagctacgttcattctagattttcactaaactacagtctccaccgtcctaacaaaaatcaacttctgcataaaaacaagtacaatttagctcttttttatttatcgtaatctaaaagtaaattacacacgatacaacaacttagcgggtaggtgcaatatagtgcaagaactcgagaattgaacgctcgagtgcaacaatttgacaagtggttgcgttttagtacaagaatagctaggcatatgctaggtaagtttttctcacgatgttaatatgtcattacatagcaatcctatggatatcaccttataatattgaatttaatcttttaagaattatactgcacatccaattacctttaagaatttttgttttctttatatccaaatccacgctagtatattgtcaacataagtacttaaaaattgtatgtataaaaaaatgctctcaataattaaactgccacataacttcttaatttattttattaaaatcgtacatatcttgcaagttgttgcatttatacgatcacttataaagttcttatactaaattgcacctacatgccaagttgttatactagaacgctcatttctcaagttcttacactaaattacacccacctgccaagctgatgcactgtgggtgcaatttactcgtaatctaatcattaaaatgttaccgatggtcaaaattagaacaataatggtcaatacaagcaaatacatagaggcatagggcatatagggtttgtttggtttacagccaaactgaaccattctagtaggttttttttttttttttgatagaaaccattctagtagttggcacttggcaataccaaaaaataaaaagtggcacccatttgtttgaagccaaaatatttggcaactcatttataactatagaaatttgagctgggccaatctttgccatgcaactttggtaacaaagcaaatggcaacttttccaaaaatctggcatagccgaatcttcccatttacaaaaaggccctaacttgaaacattcagcatataacagaagcagtatcctatttgcaacattcaagttggtaaccccagcattcagctgtcaatccttctaatttcagagtatcagattgcactttttttcaacagtaagactgattactataacccccacaacaaagtacacatgcaggaattcccaagtcaatcttaatctggcattgccatggtctgtctataagggtacttttcatgcttttggatggtccacttcatcccatcgccatatgctgccatcctcgctgcaggcaaggattgtgctgaacaagagagaaaaaatgtcacacatgtcggggcattgaagaccaaacaaggacacaagcagaaaacgatgcatccacttaatgcacaggatcttcaccaaaatgaattgtgggcaagtaaaagctggaatatgcactttatgaggattggatattagaatttagtgaagcaccttccatcaaatgacacggcagtctgccttatcgcagatttgcattgcggattagtcagcctgtaaaaataatgtgttggcatgcagaaatacaagatttagtggcgtccaaaaccaagtgcatataaaggatgggaaacaactgaagttcttggaacttaccgagcagttaaaacaggaggactggactgtacttcccagacaaagacttttccttcacggttgcctgtttaaataagcacatggttatctttgagtattcagtgtagtatttgtttaaaaataataatctaaacccaatgagtttaaatatgtgaattagtttcttttttgtcacaacattaagggtgctgggcaacattccacaattctttttattgaatgtaatcttttgacttgtgagtactgagtatgaccgtttcccacaaacaaaacattttcaatattgtcacaaattttccaaagtaacaacacaatttgggagatattacctattgccaattgattgaagtgaaaatcgcatgagaatttgataaaccagatatcacattctggcacaggatacttctgaagaatatcaatgctaccctacatttgaaaaaaaaaaagtaattttacttgagagggagacgtatggaaagggatagtgaaaactaaag

SEQ ID NO: 37600 - DNA, 5017 bp, Oryza sativa
catcagtagtatggatgcattatgagcactgtatctctaccaatccataaatccattcaaagaagatgaagtttgacctttgacagaatgaagtcaccaagccatctagtacaatcaacatagttagaatgtactacagcaaccaagacctggaagcagagaaagattggtatgatgccacatggatgaaataacaaaatcttgcaaaataatagttcaaagatgatcaaaagatatttagcataccggaaattgcacatattttgttggaaattttgatggaaggtcagtccatgtaaaggattgctcaacatatggccagaattctatgataatattaactaacagtgtcaatgataagcataaagtgaatgcaaataaaaaagctatgttgagatggcttgctaacccttcattgaccatattttaacagtgttatccatgccacaacttgctatgcggtagatatcagatgggtggaagtcctgcagcaaagcatagttgatcaacatttctcctaatgtaatcggactacaaataaaatgactgtcattgtggaacctaatttttattttattactgatggaatcaactaaaacatgttcagctcaatgaaaaagatgatatcagaagctggaagtgtggtttgtagtgagtattattctaaataacatcatactgggaaatagaatcaacttacaacactcaatacttcattccggtgacctcctgctccagcaaaaatcaaaatgcagatccctgtgtgaacattccacagcctaacagattcatcctatgcaatgccatgtgaaacagaatcagaaataattaaacatagaaagatccagctccagaaaaggctatcttcaaaccttgcttgcagaaatgatgagcgaaggctttaatgcttgagttcttatctcgtttattgaatcgccatggccaacaaaagtctgaacaaatatacagaaataagacattcaccctaaatccctcacaccagtatatgacagtaaataattgatatgcccaattttctgactgtcccactggaaaagatccactaggttctacatcttccaccattcttctctcctatataagactacaaagcaaaccttgtggacaaaagccaattcagcagattaatctcattcatagccaaatgaaaggccataaaatacacgcacaagagtcaatgagcacaaaatagatctgaactatagtaattttatgcctaagagtaaattgttgatgtgccctattttgtggtgttctaaatatgtatcatagtattatcaaaactttccacgtataatgcataatcaacagatagtgtcatatcagccacgtagcaagcaggagtgtacccaaaaattacacttttgtagacccaaaaagaaaaacaattctatagcaatgcaactcttaatcaacgcaaatatcaagtgaccttcttaaatggataagatagacagatcaacatttaccaaagaagcaactattatctgaagcatagcttcaatcatgggtatgtcggataacaaaagagcatagattctcaaaaatgaattttcattgaagtttgccaagaactatagaagcatatgagaatatggcactatcgaaccttgagtaacttctcagtggcacagttgatgacccgaatgatcccattgcttcctgcagccactaacagcggtgtgccatcaagatcacaagcccaactcagtgtgtagaacgattcatccttctgagaaaagaatgcagacctcaagagttagaagtgtcacacaatgtcacaatcaaagttttttttaaaaagagttagaagtgtcacacaatgtcacaatcaaagtttttttttttttaaaaaaaaagtaactgcacacactggagattgttgcggagcttacatcctcatcaatatatgcttgcaggatagcaaaattaccatccttgaggcagctgtaggttgtcacctgcaagatcaagaaaacacaattggtcacacgagcccactaaagacaaccatctttcatcatatttgccattaaaagagtttgtctagtatatgattgatcccagaaaaaccacaattttcatcaaatctgccgaaatgtatgccaaatcgcagattgttcgatgcaaaaggaaaatggtagaaacctcaaattccaaggaaattttactagcttttgatttccatcaaatgtcgaaccaaaatctgcgtaatcttccccaaatccacaatcttctaaaacaaaaccctagtttctctctctcttatcatttactacacttatcatttactatcattcattcacaagaacaactccaaatggcaaagaccaccctaaaaacaagatgggatgcttagcgcggtttccaccaaatttcaaaccaaaatccgttgttcccccaaaatccacagcctgctaaatcaaaaccctatttcctctctctctctatatatatcattattcatcactaataagaacaactctaaacggggaaaagaaaagaaaaacaaaacaagaaggggatgcttacgcggttgccgccgacggtggcgaagacctcgtagtagtggaagtcgaggaagttgaatccgatggcgtagagcggccgcttcccctcggtgagcttgttgcacgccttgtactccctcttcctgcttggcgccagcaaccccaccgccgcctcgcaccccagcccctgccccggccccagcttcgccatgcgcctctcctctccccccctcccgacgacggcctgacctgcccttgcttccgtcggcggcggtggcggattccggcggcggcgtcgttcggattttgggcgatttgtgaggggggttagtagggcgagcaaaagttcagagtttggaaccaaatttggaagttcataacggctgcagattttcatggatcagatttgtgagaatttgggaccggttcacacacgtctttttagcaaatctgcatttatttctcgatttgatttcgagttatctttgttagtcagatttgcttgagttacatggtctcatgagtctgtggtttagagttgaatgttttttttttgtccggaaaatggtttggagttggggacttggggtgccatcatctccgaattctcgttttttatggtttatttatgtgtttacatctcatctaagccagtgaaatttatggtcagttgtagcttttaggttgtcgatcaatggcttaacgttgtggttacttgtcgatattaaggtttattgatagagcgatcaattatatagactagtaaaatgcccgtgcattgtaacggatgaaaacaatataattttaataattaatctgttacatggtaaatcatccatttcaatcattgacacttaataaataatacgtgaaaatatttagaaatacatcaacatcattgtttattaataatatttttcctttaataattttaacttgcattttattatgttctcacttatatataaatttatatttttctttaattttatgtatgaatcgtacttaaaatttataaaaatattgaattcatattgtttctaacattctattgttattagattgtacttggcatatattattttgtttttttattctaaactatagttgatttgaatttattaattacctaatttaaatatctatattattagtctaaattatttttaaacttaaaaatattaaaatattatagatatatcacaatgttttagagacgggaagacaaagtacattcaatggtttcaatttataacctgataaagaaagaatgttaaattagattcatgccaagtggcacaaatgtcttagaaaatttataacctgataaagaaaaaaagttaaattagattaatgccaagtgtcacagtatgtcctttagaaaattttgtggaataaaaattacttataagaatataccttgataaaaagatattttgtgtgactatgggtagtttgtggtctagattcttcttaagaaatttatgtgagtttggatgagtacaaattatgtgagcttacatttttcgttctaagggtgtttggatgagattcagtaaccaaattacatctgctaaaaacggaaatcaaaattaacaacttgaaagtaggtggagctaggcagagggagatctaaccctgtttcggttgaacccccaaactttttgagggataacgcagaataactgatgaggtgtgggtagggagggatgctcaccggcgagcgacgatgcggtggaagaaggaggacgccgggcgccacctctgctcgcaggatggggatcggcgcaagcggcgggcgaggagacgaaattcgaggccgaggccgagaccgagaccggatgggatggattaggatgctcaccggtgagcgaatgcggcgggagcaggaggacgccggcgccacctctgctagcaggatggagatcggcgccagcggcaggcgaggagacgggagtcgagggcggcgggcgaggagacgggacggattgggggaggcggaggtcgtgcagcgctctgctgccgcggtgtcgcctgcctatgggtcatatgcacaggcccatgaggctggagttttttcatctcccaaaaaagttcatctaaggtcccttttcttgtcgttgaattttaaacggccttgaacccctaatcttgcaaaacggatcacttttaatcccaaggtagaattgctttccggttttgttgacgtggtggctgagtcagtgtagggccccacgtggaccctacaagccaaccagcaatcttattccacctcactcccctctactcccatctcaacccaaacctccagggcattcgtcgatgggtggggagaagggtgtcggtcggcggggaaaagctcgacggcggaggccgccagctgacgtggctcccaatgaccaggagcgctcacgtcatggacttgcgcacgtgcggggtgtggcaccggtcccaactacaactgcaatgtcgtcttcacgggcacg

SEQ ID NO: 37601 - DNA, 15076 bp, Oryza sativa
cccaagctcatagtcgcccccatcgagctgctcaaaagccgatgtgttcacgtgtccccgagcttcgcctctcctccgcagaggcaaacacgcggctccgccgcatcgtcttcgatgtcaactccatctactcacgttgcggtagcatcgtcctcgatgcatgcgcccttttccccaacgctcgccatcgccaagctttttgttcgttgctagccttctccccacccatcgccaagcgccgtcgtcgggcttctatctaccgccgccgcccaacaaccaccaccattctccctgctggtcaccggccaccacacacctctcccgcgattcagcgtctggcgtcctcttcgcttgcatgcacgggcactcatgcagtcagtggtgctcgcgagtatgctcaggcgtcgcaacgtactccatctcccaactcttggagatcctcccgccaatcccgacggtgtggctgatatgcaaccatgatgcggacgcggcgcagatgcgcggcgagctgccacgcaacgatgtggtggtgtaacccgaggggacgacgtgtcgggagcccttcctacttcgcttcttcgcgctctttgccgtgtaggtccatgacgcagccgtcagtcgccactcttctccccacctgttgctgactgccctggaggtttgggttgagacgggaagaaaggggagataggtgggagaagattatcggctggcatgtgggacccacatgggtcccacgctgactcagccaccacgtcaccaaaaccgaggagcaatactgccttgggacctaacgtgacccggtattgtaagattagggatttgttatatctggtattttagttcagggacaattaagaaactcgatgacaagataagggacctcaagtgaaccttttcctttcatctctctcatttctctttttttaaaaaaaaatagcaaagatgctcgtgcattgtgataggaaatccaaattacatatgttattttttttcgtggacgttggcggagagttagatgatggatatttggggggctttcttatgaacctgggtgggtctcaggcatgtcgtggatggaacatatgatagagatgtgggtttcacgtagagataatcaatagttgaaggtgtaattatttattagtgtggtataaagattttattttttgctgcaagggcacttatcactataaaaaatgattttcgcctttggctaaaacctgttcttgcaggctgctaggtctaaatattttttttttgctataacgacgcttatcactataaaaaatattttttagtatctttccatatgggcagcacaaaccacatgcgaaaaccctactccctccgtattttaatgtatgacacatatggatgatatggtagcaattttttaagaaaatgaactactccctccgtattttaatgtatgacgccgttgactttttaaccaacgtttgaccattcattttattcaaaaattttgtgcaaatatgaaaatatttatgttatgcttaaagaacatttgatgatgaatcaagtcacaataaaataaatgataattacataatttttttgaataagacgaatggtcaaacgatggataaaaagtcaacggcgtcatacattaaaatatggaggtagtattatatatgcaactggtgaatccgtgaaacaaaaataattaggtaaaatttgccacaggacatacaaaaaagcatgtaatcggctgagagacaccgttaaaatgtggcacggctgatagacactaaaaaaaacgtgtaattggctatagaacactggttgcattattttcttatttctggttcaaaagaggtgagatatttttctaaatgcccagattgccccttctctttccttctttaaacaccagtgggtcccaaatgtcatagacagtgtatgtttaatctaatttttaataggtatttaaccacctggccccacgcgtcatggactaatttgtacctaattagtagggtgattactatttgctaatcataagtgggcccctgttaacagtgaaatttggtaagcctaaagtcatcatcggcttagagtcattatcggctacatcatttcggaatcggtcgatggaagttatcaagtcaccaatagttggattcctactatattcggttaaggaaatcaatctactaaaggaagcttatccataaacgaccgagttcaaagaggatgcggcatggcaatttatctattaattaggaatagtttgttagtttccttttatctttaggaaagtgtgtttagtgtccgataaggactttatgttttccttttatcttttagaaagtttgtttcttgttcgacaaggactctatagacccaagggtataaattgtgtaccaggggtccctgtaatttttatctatcgatcaatacaactactctcggcgcatcgccaccctctttaccgaggtttttacttatctttcagcggaatttgggcacctgacgcggggctgcatcggttcagttcgatctccggcgaaggagtaagtcctacgttccgtcgggccctggtgaatctgtcatctacgtcggtgtcgttcaaggctgcatcagtacattcgacctcttggattgctctggtttggatgatatatttgcctacctatttatcatatgtctctattaatctaatcttagcatattaatttagctctatcggctgcttctcgctttagggtttctgccgatatcggctaaatcgtgttgctagattagattagcttaggcatctaccatcctcaaaatcagtcaagggcttgattgtctagatattgtgtttcttttcatacttagtgctgcatcagttaagtttgatctactaagtcgtgcttagaaccataatccctagcctgcttgttgactgccaataagggtttcatcggggtttcagccaatgaattatctggacgttgcatcggcttataagaattgtatatataagttagatttagccgatgacaacgaaggtttcactgtttaatctaatcttgtggattttatgacatcggacctccagccgatgtatgttttaaccttcggatcagtgctaattctaccatgttattattagccgattggtttctattggattatattattgttagtttattacatcatcatcagctgattgcctttatatcatcatctacattggacatatagccgattgcttaaaccctatcgctatcggctggtatcggaatcggctgggattgctccattggctgtttagccgatcggctatttgatctactgtttacaaatcttgtcggttgcaggatcaaactgactgacacgcccgcatctcaccaacctttggacctgcacaggagctaagcagatctcccaggccggtgtgttcgattttttttgtcaacaggcccacattgctctcatatccttcttcttcctcacacacgcggcggagcggaggaacgacgcgcgggcagcgcgacggcccgagtgggacggtcggtgtcgacgggttcctcagcggcggcggcttcagcctgatgctgcggaagcatggcctcacctccgacctcgtcgtcgtgccaccatggtgaacgccgagggggaggctcctcgatagggccgccatgggggaggacctcttctgggccatccgaggcggcggcggcaggaacttctccgcgtcgtagtgcagaaccagaacgcgtagttcgagtccctgtacctcggtagtcggcacacgccatggcctcgtcgccgcgatggccgacaccttcctggagctcggtgtgacggcgagcgactgcatcgagatgatgtggatctagtccgtgctctacttcacgttctacggcacggggaagccattggagatgctcctggacatggacaccagcaagccggacaagtacttgaaggccaagtccgactccgtacgtccaagaacatgcccagccaagtctgggagaccacctggagctggctcctcaaggacggtgctgggctgctcatcctcgacccctacggtggcgagatggtccgcgtcgtgccggcggtgacgccgttcccgcaccggcaggcgctctacaacatccagtactatgggttctggtcgaagagcgggcggcagcggcggagaagtacatgggctggatcagagggctctacggtaagatggagccgtacgtgtccaaaaccccaggggcggggcagcagccatcgccgccatcacaggatctctcgccgtctgccgctcctggcgcgggggaatatggctccaggggcaatcttgtcattttgaaaattttctcacctcttttgacccggaaataataaaataatgcgaccggtgtcctacggccaattacacatttttttgtagtgtccatcagccgtgtcacgttttcacggtgtctctcagctaattacacgttttttgcgtgtcctgtagcaaattttgccaaataattaatagctaaaactggttgagtgaaaaaaataatatgaaacgaagggagtaaagtatattctatgaactgttggcggtcacaagatttctatacacttgaagacagattcgtgagacccaccagcaaaaaatctctatcagctcaaaagacaactgaccgccatgagtctcgtttttgtgataggggaggcacatgtcactgcttgaggctacatgcagcgggtgcgtgatgttgtcgtgctcggattggaaactgaatttttatatgtgattgtttccgtttcacgtgggcgaaagagtcggacgtttgcgggggacatggaaacggaccaacaattcacatgtcggatgaaaaattgtgtgagacacactattctacgatgcacggcaaaaacactatgaatgttttaagtagataaagatatacaactatatacgtcgtattttgcaagcaaatttggtaggattgatatatagatacattataacctacctctcaacatttttcatattttttttaccaccgtatacatatatttcaaagcagtaagcatgatttaaacatcgtggttttaaatttcaaacaatagtcatgaaaatttttaaaaatattttagagctttgataatggtgttatgtctggccctacaaaatatcagctttagaatatgactcgtataaaaagagacgaagaagataaatgctcgagcaaaccaattttagtagttcaaggggtacaatgaggcaaaacatatgttagtgggttaagggtgtgctttttactccatcttccttacttatactcacttctttttatacgcacgcttttccgatctgtgtattttatgtaaaaaaatataaagaaaagttgctttaaaaaatcatattaatttgttatatgacctagtctcaacgatttattatggcgtgcccccacctaaatctctgaacaaatcaatttgctgctaggaaactcagaacgtttatttgttcagagatcatagtagcaccttgcaagtttcagacattaaacacattttttgtttcagttttgagtttagataaatatctgttaaacttatatagatggtgtttagctgaaatcatttgtgatccaaggtgagagttatatttgccagcaataccaaaatatacatgatcctaactaatatatatgtactgcatatacaaaattttaggtgcaatagatgctacttacaaattaggatcttgtattgatcagttcaacaatcaaacttctatttatcactaatcaaaagtaggattgtaccacactgatctgaaaaaatatccgtcgcatgaacataaggaggtcaatagtgcagatgatgcgtcaatagtgtagatgatgccatctaagattagtgagtcctttttgttcagaaatgaggaaggaatcaataagggagtactgcactgaacagaaacaagatgaatttcatgaacataaacgggaatataatattgaccaaatgtaaacctcactctaataacacaaacggttccattcatacaaaagtttttatactcactgtttgtattccgatttaatattgcaagctatcattatgtcagtcaataacaagcatccaaactcatgtgctagaaggctggcaatacataagcatttttttggaaaatctgagtatataataagcaatgtcagaattttttccagacggtaaatttcagaaacatgcccccctaaggccctaaaaaaaccagaaacacggttatccaagtagatgaaattcatatacaatatatgccaaaatcgaaaaacataatccaattgtagaagttatatcatgcagatagtgcaattcagtttatatttcatttataatggctatgatcaaaggataattcatcagctgaatgaaatacataactgaataaaattgtcacaagagaaaggttttcaatactcatctaaatgaatgaaaccaaatcagcgagagagatttaaaaagaaaatacctatgacatcctaaatgcagcaaccaaattcagtttgaatgttttcatcagtaacttcacaactcgggtactaccataatgagatggttttgatttttcacaaaaaaaaggattctgaaaaaaaaggcgggttcatgagatatttgaccatatttattcaatagttgccatcaattcacatatatacagtctaaatgtctgatcttaagaaaataatattggttttgaattagttcgtgaattagtttcgatatctttagacaaccttgatgacctggaccactttcagaaatatataaatatatgaatgatccaaatatatgttgtagctaaagggcagtggcggccaccagatcatgtaatggcatgtttacatgtaacacataaaaatttaagatgttcaatcccaattcagtaattgctgtatgtgcagcacaatagtgcaattaattttagaaaaaaaaatgttaccctaaaagccatgaacacatctattacccatgaacatatgctccatgtactacatgatttcttgcagtgtatgtgtacgagcatttcatcgaacaacatgagggtatccggagatagagctcaaatacaatcagaaattatgaaggccgtgatgcacgatcaaacataagccaaaacaacgacatgacctgtaatcaggagaaaaggaacacatgaacatgaagatttcctttcccatctgagggtagaggccggtgatgatgaagatggctgcagcggcgccgttagtcagcacgggctgcgcctcgatcgagccgaggatccctcacaccaaccccgcgttattcctgctctcgggcggcacgaagccgacggctagatctcgatgaaacgaatcagcgatggcgctagggcgaggcagggtggcgcggcacgacagtcggcgggggctcggtcaccgcgacgacgaacccaaggtgggggatcggtggcaatcgcgacgatgacggctgtgagggaattcggcggtggtggttgaaagagaggggtggaatcagcgggcgtggaggaagatcgcgagcaatgtggaacgtggagcggactgtgggcgtttgacgcgtaagcagatacaggggtgggaggtggagacgaccttgcgttggatttcgcatatgcaatctagaccgttgcgtgaggaacgagagaatgagtgatgagtaaaatcatttgttgaactatagggtatagggtagatgtggctgataggatgaagacgaatcgagatgataacaataaaaggccatgcattatgtagataaaacttagatatgaaatgaagggatgtgttgaagagagtttaaaaggataaagtcataggtctataaacaacaatggcatgtaataaactaattaatatatcaagattatgatggactagtggtggattactggtgaataatttatggaggtatagagcttgtcgtagtggttgtcgtagattagcctgtcattggcttcggactattaattactagttagtcattaactaattgttaagagaggatagcgctcatccctaattagtgtcttgaaatatttatcatattatagggtttgcaggagcactgtataaacctaattagtatccgattggaattgagtttgattgacgttgttttcgctgaatctggttggatggaaggcaaatatttatttttacactgaaaaaaggcatattaaatactctatccaataattatgtgaatttggtcatttcagtagtactccctccatcccaaaataagctagcattgtactaaaacgtgacacatcctagtacaacgaatctggatatactgtccaaatttactgtattagaatatatcacatcctaatatgaggttggtttattttagaacggagggagtactcctaggcaaaaagaccatcaggaagggacaatctccgatttctgcagctagcagcccaaaacccggctggtagcccgtcaagaatcgtattgcgcgaacattcgcaccaaatgcccgtgcgaatctggcattcacattctaacacaacaacaaacattctcattcacctccacctccaccttcacctctatattcacatccatggatggatcccacgtactctctctgtcccatattcctggctagatttattgtactatcacattttattctataggttgtttttttatgtgatggggggagtaggtcctgagtactcccaagaatacccatttttcatgaaaaaataaattatatatagatatattgttatttatgtatgctttttttgtctcctgttcttgagtttgttctcaagattgggccattttgttattttatagtgtgctcaaattctcgagatttttataatatattattcctatatgatttatgtcactattgtaatttaatatgtattatcctcctcaacatttgtgttttgtataaaacatttttttaaagtgtgaatatccggccatgaattcctacgtccgtcactgttcacatctatatcaaattaactcgaccaaatattcccattcacactattgcggcgctcattatgaatggttgacgaacttggccaattaatatattgtggcaaaataatgataaagagatattcgattcacttaagtgtacaacatactcagtacacatctttattcattccaaacaaactgcagctagtgcatattcgtgaaattaaagtgctacgcgatgtatgtacgcatgcttaccgtactatatgcgtagcatatgtatgctagatttattcagtgcatggtaactttagtgtacttgttcatatcaatagtggcacggccgttggcttcgagtgggaaatagaaggggtagatttcgtagcgtgcccaacagctgctatagtcgatttggcacccctgcgcagcgccacaagccttgtcaaacttggacactgtcgaagataggcactgagcacacgcaggcggtgcaaggtctcgtgtgcactgggccagcgcgtagacgctcacgaacggcgtgtactgctccttcgccctgcccagaccgttgccacccaccgagacagcctgtgttgttgcttttaccatcgccttccccaccaccttctggaacgcctttgggttgtccatgtccggccatctcctcaaggtcacgcttgcgtcctccctcgtgtccacatccccgatgaagttgtagctgctgtagtaccgcatgaagcagtactcgtacctacatgccacaagcacacataaacgaaagaaatatattaaacaaccggcctgaaatctactagaatgatacagtgtcactcatgtgtgtagatgacatgtagaattagaatccatagataccaaattctggagtctgatgtgtagttgcagttggagaccatctgcttggcggcttgggcgaggcaggcgtcgcagtcgccgccggagacgtcgccgcggcactgcgcgaggccgtagaagacctcggagcccctgccggccttggaggtggcgaatccgccgccggtgcgcgccttggcgacgaggtcggagacgacgaagttgacggcgcgccgcctggtgacggcctcgctgctgttgagatcgccgtagttcatccacgtctccgagcagaagctgccgatgggatcatacgtcgtcgccgccatgcccagtgggagcaaggcaaccaatgagacgacggcgaccagtaccagctggcttaatgccgccatggatggcgccaattatgtactctcacactctcacttcacctagattcaattcttgctagctactggagtagtagagatcgatcgatgtcgatcagcagatgtaggtggctatagctgggttgtgtgttcgatcgggagcaatggctggagcttataaaggcgaggattggaagggaaggagagagagatcgatgtgcttgcagtatattgcaggggaacatagtagacagacatagtatcacaacccttgttcttgcttgcagatttgttttgactgttctaatggtttgcatgcagtgatgatcagatcgagtcagactgtgggcaaagctattgcatttgcacctatgaatgaatgatactcttgcggatatcacggactagctagctggctagtggctaactacctgctttctaccatttcttgtgggcttccggggggctatgactagttttgagggatgaggtgatcgataggtgatggacagggtttacgatttcggttcgaaatttccgcaatttcaccccctccaacaagcaaatgtatcgaccgaaaattcagtttttccaaaattttggttaatttggtaaaaaattatttaaattcagtttattttctaaataatttcatgcaaaaagtatgaaaattcctgaaattttcggaaattacagtgacaccaaaatcccgaaactttcggtctaaaccagagttttaaatctcccgctctagttgtttgagaagggttctagctatttgttcacatgtacaatttagtcgctatagctctatttagcccgctatagctgccgctatagctgtttgagaagctaaccgctaaatgccttggcccgctatttaaaatattggtccaaacgaaattgaaaaccctggtgatggacggaaaccaagcaagccatcatggattaagtggtcaattcattattacgacattgctcaatccaaacaaaacagcacattagtgatgagtgaagatgaaaagctattcggttgcaggagcactgcatatatagtttgattgagtttgcgttcgctgaatctggttggatatgaagggcaaataaactatccaataattttgccaattagcaaatactaattgattcattcctaggcaaaaaccagcaggaatgtagtcgatctcctgtttctgcagccaaacagcccagaaactagtagccggccgagaatcatatctatatatacttcgtataaagttcatccactaataatagttagtacatatttaacctcatacaagcatgcaatatcatgcaaaaaaaatatggctccaattttattagccttatcttaggctgcgttcttttcagattctccccactctcaacagtgttcacggaaaacggagcggtccattagcacataattaattaagtatctgttaatttttttttttcaaaaatggatcaatatgattttttaagcaactttcgtatagaaacttttcgtaaaaaaatataccgtttagtagtttgaaaaacgtgctaacggaaaacgaggagaatctaatcctactagcctggaaagaacgagcaagaaatttgaagtactcaactggacgtacggccccctttttctacactgcatggaatagtttgcccatagtctgatcactgcatgcaaaccactagaatagtcaaaatagtctgcaagcaagaacaaggattttgatactctgttcccctgaaatgcatgcaagcacatcgatcgatctcactctccttcccatcaaattctcgtctttataagctccaaccattcttcccgattaaacacacatctcctatagctcatcacatctctacatacaagtgaccagtgagagtaatttggcgccatccatggcggcattaagccagctggtactagttacagcctttttggccgctgcattgctcccactgggcatggcggcgacgacgtatcccatcggcagcttctgctcggagtccgggatgaactacggcgatctcaacagcagcgaggccgtcgtcaggcggcgcagcgtcaacttcgtcgtctccgacctcgtcgccaaggcgcgcaccggcggcggattcgccacctccagagccggcagggggtacgacgccttctacggcctcgcgcagtgccgcggcgacgtctccggcggcgactgcgacgcctgcctcgctcaagccgccaagcagattgtctccaactgcaactacacatcagactccagaatatggtatgctattattatggatcctaattctacatgctagtatattgtatctcgatctagttccaacggtttgacaagctaataattgaaactttaactatctatgatttttataatatttagtttgaaagcaaatattagaacatgatatatacattattctttaaaattacttttaaaaaaattaaaattttacttttttttatattataatatgtaaaaatcattgtagaagtcgtattaaggaccatattattgtcccaaacattaagaatgatggaacataagagagtacacatgatttcacgtcgattgtttaattttctccttatttatgtgcttgtgcgcgcgggtgatgtgcatatgtacttacaggtacgaatactgcttcatgcggtactacaactacgacttcatcggggaagtggatacgagggaggatgcaagcgtgaccatgataaattggcagaacatggacaaccccaaggcattccagaaggcagcggggaaagctatgggaaaggcgacagcacaagctgttgcagtgggtaggagtgggctaggcagggcgaaggagcagtacacgccgtttgtgagtgtttacgcgttagcacagtgcacgcgagacctagcgccgccagcgtgcgcacggtgcctatcggagatagtgtccaagtttgacaaaacttgcaacagcgctcaaggatgccagattgattacagcagctgttgggcgcgctacgagatctaccccttctacttcccactcgaggcaggcagtcgtgccactatcgacatgtccaagtacaccaaggtcaccatgcactaaataaatctagcatatacataggctatgcgtacaatgcgataatgcatacatacatatatacgtcgtaccgtgtagcagtatatgcaatgtgagatcaatcccaataatagtatttatgtttatgtttaatttcaggaatatgtatgcaacgaataaatcatatgtaaaaggttatatatgtataaagttgtatcacccttatttatcatgctagctgcagtttgtttggaataaattaataaagatgtgtattgggcatgttgtacaatatcagaaacttatgttctcatattttctcgcaataaattaattgggcaagtttagcggccattcttaatgagcgccacagtaatgtgaatgtgtatgtttgagtttgacatagatgtggatgtgaatatggaggtggaggtggaggtgtggatgaaaataattctatttggggagcttaaaattttaagaaacaactgattggtagccaacttctgggttctagtttatcttctagattctacaactacatcttcttctcagaatctggatcaaaagttgattgtttgagggagcttctgattttgggagaagctgcagcagctagaagctcccccaaacaagcccaatgcttgcacggggcattgggtacttggttgcacgtttgcacaatacgattctcatgggctaccgggttttgggcacttggttgcggaaacatgagattaattgtaccttccttctatgttttgccttaggagtaccactaaaatgactaactggcaaaattttggatagtgcatttgcctttcatccaaccaaattcaccgaaaacaacttcaataaaactcaattccaatcggatctcgaaggcaagaaggttatacggtactcctgtgcaaaccgaatagatttttagcttttcaactttattcactaataggttgttttgtttggatagattgagtactgtaataggcaattgagcacttaattctagatggttagtctgatttaataaggataggcttcatccacccatcacctcatctatatggtggataacaagtcagcttggctcgctaagacttggttcatttgatcttcttatctcgacgagccatcttgactcggctcattgagcataatgagctgaaatcgtagcttagctttgctcgtgagttgactcgttaactttgttaagtctagcttagctttgtaattttaaatttactattttattatattatatgttaacataataattaaaactaacttatgaataacttactatacatacaaatgtacaaatagtttggatataactagaagtttaaacactcgtaaagatgcactaagtatataaaaatatgacgatctcttctactaacgagttaaacaagacgatcgtgaactgactgattaactcatgagcctaaaaatatagcatggtttgaatcataaatcattagagtttgagttcaagccgatcggaactaagctcgttccactaactttgagctttcttactacccctaattaacctcatccctcaatagtatgtacccggggctagggtgagccgagggcaagggggacagcataagtgaggtgatatgcataagcttagtcaaaatattcctattctagatggagcaggcatcaactggtgttggtcctatggaccgtgaatggatttgtctctggcctccgggtacatctgaacatggatgaaaatttcggttcaaaattttagaaattttcgccccccacccccccccc

SEQ ID NO: 37602 - DNA, 9946 bp, Oryza sativa
caaatattcaatttttttcaaatattgtgagaatttgatcataatttattcaaattcagtaaaaatgtattaatttttttaaaaaataatcgttagaaatatccgaaatttctattcaaaaccctgtggcaaaagtagtccctgaaaagcaggtcggcagcgagctagtccacgatatccgcgacgcaagtctgcaagagtaacattcgtgcccacacgctgccagtgcatggacgagcatggctcatggctgactcgacattagaaaccattagaatagtcaaaacaagtctgcaataaggattatgatactatgtcctgtactattccctgcatcgcaagcacatgatatcgatctctcttaattaatttcccatccaatccagtgcgcgcgcttgatcgatcgtcttaatttataagctccaaccactgctcccgattgaacccaagccagccacacacatctgctcacatctctagctactactccagtagctggcaagaaggtgaagtgagagtgtgagaagtaattggagctagcatccatggcgtcaccaagcagaagatcgcaccattgctgcctggtactagttgctctctcgttggctgcaatgttgctcccaatggccatggctactacgatatcgatgtctcccattggcaccttctgctggaatccgagctacaacgagatgagcagcggcgaggccatcgccaggcggcgcagcatcaactccgtcgtctccgacctcgccgccaaggcgcgcgccggcggcggattcgccacctcctccgccggcaggggcatcgacgccttctacggcctcgcgcagtgccgcggcgacgtctccggcggcgactgcgacgcctgcctcgcccaagccgccaaacagatggtcaccaactgcaactatacattagactccagaatatggtatgcgtgtgtcataattctacatgtcatatagtctcttcggttctataattttcaacgttttggataaaattaaggtcaaacaatttaaactttaactattagtgatctttaaaatatttagtttgagaacactagaacataatgtatagatcggtttttaagaagtgcttaaataaaattaaaagtttacttatattttgggtatattataataaaataaattatagttgaaagatatgttttttagaccgtgttattatccaaaacatcaaaattgaaggaaccggagagcaaacttgagtggcaaaaattatagattttacatgctggttgtttaacgttcttttgtttatgtgcttgtgcgggcaatgtacatatgtacttgcaggtatgagtactgcttcatgcggtacgttgacttcaacttctttggggagatggacacgaggacagacgcaagtgtgaccctgaggcaatggccggatatggacaaccccatggcgttccagaaggcagtaggaaaggcgacggggaaagcggtagcgcatgctgtcacgatgggtagcggtgggctgggcagagcgaaggagcagtgcacatcattcgtgaacgtctatgcgttggcacaatgcacgcgggatctggcaccaccactgtgcgcacaatgcctgtcaacgacggtttccaagtttgccgaggcctgcggcagtgggcaggggtgccagattgactatagtagctgttgggtgcgctacgagatctacccgttctattttccactcgaggccaacaggcaggcccccaccgacttgacaaagtacaccaaggtcacgatgcattgaataaatctcgcatatatataggctgcgtgtatagtacaatacgatattgcatacatgcaagcatacacacgttgtaacgcatagcagtatagttatgttatgcgtacctgagatctgtcccggaacaagtatttctaatgatgttttatttcaataataaatcatgtgttgtaggctatatatttataagctgtattgattcttaattagtatgctgctagtttggaataaataaagatgtgtactgaggtatgatgtacgcgcgtgtgaacaaatagttttttttttagaaaaaaaggtcatgccattgccgacatttatataaagaagtatttgtctcattttaagaagaaaacgagaccaaactttatattacattgttaattaggaaaaactatgtgaaaaccacaactattgtaccaaacagaaaatggcaaatcttaactacaaggctatgaaaaacagaaaagccaggttcaacaaatgctattcaccacaaaccttgcaaaatgaagtagcaagttggaagattaaacaaggctcctcgcaaaggcagatacgcaacgttattgtcatcacaccatcacaggcgactccaacttcgctaggaaacgctaaggccaggaaaggcttgccgaccaacaagcttgcattgctaccccacactagagcgaaaactcaaagggcgaggtcctacttgggtcatcattgccaaattcgcacctgcacagcagctccaacttccgatttatattgttgccaaactcatcaaccacctcgacgcagcagctccgacttctcaaaggccgtccataacaaagtggagcatgattatgaaattgccaaggattaatatgccttcaggaggcacgacgtcaagctatacgccaccatcatcttgggctaggtttacacccacaaaatccaaacacggcatgacgaggagacaaaaaggacgcctccaacgagtaaacgacgatgcccgtagcgtccatgctttcgccttggcctccaccaatgtgctgtgaggacagttccaccaccgatgttgcgcccgctctcaagtgtgcaagcaagcacttttaaccacatcgtgccaagttgtccttctatcctaaattgtagccaccatcgtcccctaagaaatggagccgccattaccaccggttcgccagcaggtcatggggaacctcgcggctcccattgctgaccagcacgacaaaagccccatcaccatcatcgtcctccaaacgccattgccgacatctcaccaaaagagctccccacaatcgaaaggagtcgaccatagccggggaggtgtttcctggagaaggagatggaaatggctagctagcaagaacgaactgactccggaagctcacatatttgccacggcattgctactagcccccgctgtcggtaggggtgggcagaaaaagaccgaaccgaaaagaccgagatcgagaccaagaaattcggtcatcaattcggtcctaggcagtgaaagaccgaattttgttcagttaattcggttagtctcctcgggtaaccgaatagactgaattatcaaaaaaaatatctaaatacaacctacaatccactatgtttaataggattaaactctaattttcacatccctacttcttctaggcatgaaacctaataagagtctttactcataagtgcttacgattttttttttgtgatttttgtgttgaaaatttctattatttcttttcatatatgaaaatgttgttgaatttcggtcaggaccgagaccgagaccgaaaagactgagaccgaatttgtcggtcctgacattttttcgctgaaattcagtcttcacttttcaaagaccaaaagaccgaagaccgagaccgaaattttcggttagaccgaatgcccatccctagctgtcggtgcgggcggtaagcgctcaccgtcgtcctcactaacctccacaatcgcaaccgcgccacgccatgcccgcggccgccctcctgccgccaccggccagacgcaccgctccacgccatgcccgcggcctccctcctatcgctgttggccgtgccgaccgcgacctcgcccgtgatcggcctcttgctgccgttagccagtgcccgaggccgacatcctgcagctgccagccgcgacacacctcctactcgacctcggctagatccggccactaccgcattgcataaccagatccggccgtgaaggcccaatccagtcgtgaagcgccgccccttgccatgtggctgcagcgagaggttaaatttaacttctacaagttgcaatgaaaaaaaaaacaaatttgagtacaagttagcaatagtttaatttgttttttcgttgcaacttgtaaaagttaaattttaactatgtttgtggagtgatttatcacatattaatctatcttgttttatttttttcataattatttggatgacatgtaaacaacgaggggatgtctcgtcgagagttagaatccactcccttgaacaactagcatttcacgcgattgaacccatcacgcttaattatgcattcgttttcaaaaggaatatttggtatataatcatctaaacaccagggaaatttccacagaaatagcagactttctacttgatcagaatacattatgtatatagatagtaaatgtttcactcaaaaactttgtgtaagcagtaaacttcccacctagataatttatgaataataaagaaactttctacttacaaactttgcaaaggactttaagaaaaaaaacttctattataatacattttatagatgttttacattgaattgaaaaaacaagttagaaaggaaaaagaaatattctatgcactttctgtttactgggcctaaattggcaattgaaataggcccaatatgcaagcgcaggattcgtgcaagctgagtgtacggatgcatgtatatcatttaggagataaatcatcattagcgttagacaaaaacggtatggcgccaaattcgcacgaggtttggaattggatcgatgcacgtgttcgcaattagattctctttttttttttgcgggggcaattagattctcgatcggtgggctactgggttttgggctgtttggctgcagaaacaggagactatatacagtggattttgcctaagaatcaactagtatttgcaaattggcaaaatcattggatagtgtatttgcttttcatccaaccagattcagcgaaaacaaactcaatcaaactatacagtgtcctgcaacgctgcaaccgaatagtttttcagctttttcatcttcactcatcactaatatatatatatatatatgggctcttcagtgaagtgagagtataactcaactggttagatttcttatgctggaactaagctatctggattcaaattctcgatttgacgtgggtgctcgcacttacagctaattattctttcagtatagacgattaacccgtcgacaacaatagctagttttttagagcatgtgcgtgtgtatctttataagggtgagcgtgcgaactaattgtgagtgcttacatttatgttgtgtttctcaatatatatgggctgtttagttttggattgattgagcaatgtaatataagtaaattgaccacttaatcctaaatatatgcatggtttgtttggttgaagaagagtgaagagacatgataggtttatccaatccatcacctcatccctcaaaagtcaaaactagtgacagccagcccacaagaaatggtactagcaagcaagcaggcagccagcagccagctcagccagctagcttagctagtccgcgatatctgcaagagtgtcatccgtacgtgcaataatatagcttcgcgcccacagttctaatcactgcatgtctgcatgcaaacctttagaacagtagtagtcaaaaacaagtttgcaaacaattagaacaaggattttgaaacctgttcgcctgcagttaacatactgcaactctgcaagcacattgatcaatcgatcaatccctccttccccatccaatcctccctctatataaactccaaccattcgatcccaatcaaacacaagctaaagccatcctcctctactgaaatctctagctactactactgctactccagtagcaacaagaggctgaattgagagcaattggcgccatccatggcggcattaagccagctgctacttacagtcttcttggccgctgcattgctcccactggccatggcggcgacgacgacgacgtatcccatcggcagcttctgctgggagccggggatgaactacggcgatctcaacggcagcgatgccgtcgtcaggcggcggagcatcaacttcgtcgtctccgaccttgtcgccaaggcgcgcaccggcggcggattcgccacctccaaggccggcagggggtacgacgccttctacggcctcgcgcagtgccgcggcgacgtctccggcggcgactgcgacgcctgcctcgcccaagccgccaagcagatggtctcctactgcaactatacatcagactccaggctatggtacacatgtatactctgtggatcctaattctgcatgttatgtaatctcttcggttacataattcttaacatttgaaaacagtttaaactttgaccgtcattcttttcaaaatatttagtttaatttgagaatgctagctagaacgcaacacatagattagtcttagaaaatactttaataatattaaaattttacttatttgtgtgtactgacttcgttttaaaatataaatatttttagctataagttgggataagttttgtttagatttataagtaaaagttgttatattttaggatggagataatatgctataataaaaatcatagctaaacatatgtttttgagaccgtgttattatccaaagcgacaaaataatggaaccagagagtacacatgggtgataaattatagatttcacattggttgtttaattttctagttgtttatgtacttatgcgggatgtatatatgtacatgtaggtatgagtattgcttcatgcggtacgacaactataactttcttggggaggtggacacgagggaggatgcaagcgtgacaatgagacaatggccggacatggacaaccccaaggctttccagaaagcagcggggaaggcaatgggaaaagcaacagcgcaagccgttgcggtgggcagcagcgggctaggtagggcgaaggagcaatacaccccattcgtgagtgtctacgcattggcgcagtgcacacgagacttatcgccgccgtcgtgcgcgcaatgcctgtcggcagcagtgtccaagtttgataaggcctgtggtagcggaccagggtgccagatcgactatagcagctgctgggcgcgttacgagatctaccccttctacttcccccttgctgctgccggtcgcgccaccatcgatatgaccaaatacactaaggtcaccgtgcattgataagaatataagatcattgtgagacctcctcaaataagtacttgtgttgacgtttaatttcagtaatatgataaatttgtatcgatccttagcatgctagcttcagctagcttggaataaataaacaaataaagatgtgtactgagggcacgttgtatgagcaagtgaattgaatagtattgaaatcctttgttactatacaattatctcccactaatttacgttaactattttctaactctttgattgagcggtactatattacctagtgttattacttgtacagttataccccaactaggatatttggggtatttaactaattgctatttataagatgtgttaattaagaatttatcgctagtagtctacaacatctgaacccttgtgtttatatgatatatggttcggtggaaaatccttaattataatatctctgtattttggtttgacagcaacgaacttcatgggcttcaccggcagtgactcttgaggcctgtacgtggtccagttgagtatatttggcaggaataagttcatctaaggtcccttaacttatcaacgaatccgattttcatccttcaatcacaaaaccagatacaacgagtctctcaactatcaaaaccggtgcgaattaggtccctcggcagtttcgatagcagttttgactgacgtggcgcctacgtggctaatttgactcggtctcgatctgacgtggcactgacgtggcgcttacgtggtaattcaattcggaaaattaataaaccctgtgggacccacatgtcagtttcacacacaagttaataaaaaatggcggggccctgggccccacatgtcatttcacccctcttcttcctcctctctctccccatctcccatctcttcatctctctcccctttcctctctcgcttcggcgctcgcgccgctctcctcatccctaggcctctccgaccgcctcctcgccacccgccatgagctccacgagcggcaggagcacctcaccgctgcctcctcatagccgacctcaccgctcgacttcgtgctgcccgcgcctcacccgtccccctcgccgccgctgccgagctcaagcctctcttggtggatcccaagggatctggatctagtcaggacgaacccgacacggttcatgatgagtgtcacgccccgaactagtcccgaccggaactagcccgtgacgctccaaattaacctgttaatcgataccagtcccaggaaacagtgctggtatcacagggagacagaatatcacagcaacaaaggtctctttattatagagtagatgtacagtcatgttgggctgcggacagatcccgagctcacaactgcactacaaaagggaaacggaagctaggagttggaccaaacgacacaggcgcgacttgggaactaggccgaaaccctaaaactcatcgtagccggcttgctcctggaagacctcctcatcagcaggatccgcttcatcttcttcagcaactgggggggattatttatatagagcaagggtgagtacgggagtactcagcaagccatgggaaataagtgtttaatgcaggcttcaaagaaaggctgttgttttagcaattgattttatttgaacccttttctgaaaacaactaagtgagtgcttctcaaacgacacggatgagacagtgcgtcttgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaatcatcgaacccctttccacaacagcaatttcacaagcagtagtcaaacaaaactacgctaggaaccacctcacatccgcccatgaccgtgggcacggttgttcgaacagtttgttaacctctgcagagggggtacactttacccacacgacattactaacccggatcacccagcccgtggggatcagccacatcgggagacctccaagctttcatgacaaggcatttccaaagccgacacaggtttaccatatgccgacgagaggagtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaatccatttagttcgcaagcaccgacccaggtgtcgggttttccaagtcttttgtaaaacccaatttttacccaagaaatttttttcagattttaagtttgaaggcaaccgtcgatactcgcacagggtgcacgaatatcgaggcgcaatctagatggttacaaggggacatgatatatcaattaacataggaaggatcaaatgcaacaaactaggtaggtccgccaatctgccttgcagacgggacttaacagattaagtgcggtcctatcaatgcataatattttgcaagcaatataattaaatttcaaatataggctc

SEQ ID NO: 37603 - DNA, 1440 bp, Oryza sativa
ggcgaaaataaggccctattaatgacctctaagcatgccattagatagatctagagatttgaggaattttggaagttgaacggagtcaaacggatttcggttgggaagatattgaatttctaagattattggatttttgtctaaaggaaaaggatttaattaaatcctttttgaaaaagaaaagaaagagggaggagaagtagacttctctcgggcggctagggcgcggcccgagagaaaaagcgcggctcggccgagctaatgggccggccggcccaaaaggattcggcccagtagggcgcgcgggaggagaggagagagggagccggtggaccgggctcaccgtgcgcggtcccgtgtgggacccgcttgtcagcggctcggctcaccgtgcggagggagcacgcggctcacgcgcgcgggcgggggagggacgcagtgcacgcgcgcggttcgcggaggaacggatgcggcgggcccacgcgcagcctcacggctcaccgcggaccatgcgtacgggggaaaaacggagggagctgctggccgggtcggatgatccggtcgcggccgaggtggcgccgacgtggcgtctacgtggcagccatgcgggccggcgggaggtagacgacgacgccggccggaacggacggcggacgacagcggcgagcggcggagcgaaccacggcgataccggcgaaagcgagcacaccgggatgacgaggaagaaggagagggagcgagccaacggcttggattcgccggagggagcccgtctacggcggatttcggcggcggcaaccggcggagagcaaagggggaaatggcgacgaggccacgagggaccaactcccggcggtgagagcatctacgcggctacgggaatccgttgctagcgtcggattgggcggagctacgccgagcgaggccggcgacgagcgggtgctacagagctcgggtggcgacggcggcgagcacacggcgagcgacggcaacggtcggggcggcgccggctagctacggggaggctacttgtgctactaccgaaaactaagggggagagatggagcgaggaggaagaacggagggaggcactaccgagatgaggaggggcgctgtgacgagaggccgacggcgcgggagtgatctctccggcctcgggccggggaagaggaggaagacgagcgcccggagtccccttccgcgtcctcgaacgcaccggctctcccggcgcttggtgaagaacggcggaggcgagacagagctcggaaggcggcggcaatggcgcggacgagaaacggggaggaatgggggggaaaggggaagggagggcacccggggctttaagggcggcaatgtcggtttggaaaccgtctttgggcggtcaaggcgcgagctggcgctccgcggtcgcggccaaagcggcgacagggaggagggagg

SEQ ID NO: 37604 - DNA, 28597 bp, Oryza sativa
ttgccaacctttgcaggttctggcaattgcaagtatgcctgagttgagagtttgctccaagttagccagccaatctctggagcttgacaaataaagttttcaagggatgttttgtttgtccaagtgcccctagaaaatatggtgttctatatttcagtgtcagagttgctagaattcaagtcatgtttagcctcaatgtttgggtaatctttagagaggaatgctttataccgagataatattgttccatatcttcagtgcagttcttcaaagttcaaagagtatgaatcctaggcatgtcttaattgtatttgcatagcactatatggtcctgtgctgctgtgaacgaacagtggcccaactataataaataaacatgaagttatgctcaaattatttcagattaaacgaaccagcttgaaactattcaagttactgtaaattacagtgctaggtttaattcctaatccaacaagtactactggaatattgttgagcatcagctaacttgatactaaaactgagtctacatgtagcatcggcagctggcattcacatctccaccttcatctgttcatgactccaaaatgggttccgttacctgatatgacaggaaagcaaacataagtcattttagtgatactacgatcatacgtaacaacactgtgttggaattttctgatcaacagaaagacaagcccccagagggttttatgaaagcatcttgcgagggattaatataacaggtcaacatccaccataattatgttttgttcaggccatcatcgtacataaactacataaaccaataattgatcatggacatgatgccaacagccatctagtaaatggtgcatgtagaatattgtactgcaaaaagcaccataagaacaaaattgttatcagtatcctgacttcctgataatacagtgtaccaagtttgggaagtcaagcggattatacagctggtcacaaaataatcccatatcataagcgcaagcataattttttgcaagcacaaaaaaagctaaagatttattgagatagtgaagggagaaatccaaacttacattgataactattactctggcttcttcaagtttatacaatgatctgtagcttcattaaaaagagcctcaacttgcttcagctccagctctacaaaagcaacaagacatgtaaaacactggacttgtaaataatcagttgtaacatggtgaggaattatataatgaaggcaaaatattccaagaatgtaatagcaaagcataccagcagcttccagttgtttctgaagctctgtgcctacaacttcattctctgcctgcgcatttcaaattcataagcattttagctgcaggacacaagtatcatgaatactgatactatggcaggacatgctgccgagcgtctgctaaaccttcattcagaagaaagcaagcgactaaggaggacaaccttagtatgaaactccatccacaaggcgtaggaaaaaaaaaacagaaggaaacatgcacaaagataccatcttcacaagacactagcttaatgtcaccctttcacaatgtactgctcagagggcaaaactgagacatacctgtagctctttaattcttttcagctgatcctcttcagatgatagtggcaacgcagaaacaagagcatcaaactgcataaaaaaaccaaaaaaaaaagagaacggtattggaaacagtagctagtagcacatttcaagtgtactctcagatgcaaagtttgccctctggagacagaggttggtgtgctgcataccatcatcccacctacattttgcgaggaacagtacaaagattggtgtgatccacatcatcgtcaacccttctttgcgaggaataatatgagtgaagctcctattttgcagatccattcaaaattatctcgagagggctaaaaaacagcacaatgcaactaaagtactctaccacactacatgaacaatctcactatagaagatatgattctgtaagtagaagaattttcaaagaaccaggcaccctgaccgtggttgcaatcacacaaaaatgctaaggctggtcacaccaaaaattacagtccaagccctaaagcgtcagaccccaagaaccagcaggcactcaggcatttcatcgagcaggtggcaagcagagaagataagcgacggaagacgcgtaccttcttggcggcgaggacgagcgcgtggctcatggccttgggatgctcggcgaggtcgagcgcgggcggctgggcctgcgccggcggagcctgtgcctgcgcagccggagctcccgccgccgccgccgccgccgctccaggctgcggctgggcggggtcgtcggggttagggtttgctgctgcggcggcggcggggttgagcgggtccgggtagttgttggagaggcggaccggcggcgcgtcccgctgcagcgtcccgaaggtgttcaccgccaccatcgccatctcgttcagctgctcctgcagctgcgagatgatgtccatctccggcgatctcgtccccctcctcgccgccggcgacctcctcctcctcctcttctccctctccttctctctcctcctcctctctatccaccaaggcccaattacatctaggcccatcaaagaaaactggtgggcccagcacatcgacagtgcgcaagccactctctgactggcacgtgggcccatggctagcttgattacgaaggaaccaagggaccccacgcggaaaattgcatcacatcaccaccacgcgtccagatctgatccacacacaaatggatcggacggcccaggattaaaccaaactattactaacaattaactcacccgattagttaacactaattgaatcggacttggactctaatctagactaatataaaaagcacgagttgtttagtgtaattaacaccatgattgcaattagcgccggattaatcctgcggtacaattagcaccggattaacaccgcgtcttgctccgaaaaaagaaactgcacgccaaaaagaacgaaaaaaagaacgcacgccagccacgccgcccgcctcacctgccgcccgcgtgacttcccacctcgcctcacccgaccatgccaggcctcgccgccgccgacaatgtgacttcccacctcgcctcacccgaccatgccgggcctcgccgccgccgccgaccatgagcctcacccgccgcccgcgtgacttcccaccttgcctcacccgaccatgccgggcctcgccgccgccgaccatgagcgaactccacgagcagcgccagcgaccgacccacgctgcccggatcggaggcgaaggacaacagcccggggccgccttcatcgacgccgtgcgcgcccagtcgatccacgggagcgcggccgcggccgcagaggcggcgggggagcggtaggtgatgacgtggacgcggctcctcgtgctaccggcgagcgggacaggaggaggaggaggagcgcgagggcggacgcggcggccgcggccacggagggagcctatcatggaggaaatggtctgaggaggaggaggagctagggttgtcgcagcctcttcaatggtgatctcctgcaggaggcgaacgggagcaagtatcagcagcagaagctgggtggtgtgccctcgtcgcagccgcatcatctgaatgtgagtgactccacaagaacgagaaccctgaattgaatctgacatttaccattgttcttgcatcattcatccagtggtaacgttttacatgtcttggattgttggatgacattgatttcaacactggaaaattgttgttttttgcttcgggacagcagcaagttaccccagcattgacagcctgcagatcgaccacaagccggcgactgcggcgggacgccagttcggctcggcctcctctcctcctcctccgccgccgccgcctccgaaccatccccaacgtcatcccctccgagcacggccgcgccgccgaccacgcgggcttcctcgacgccgtcgaccctctcctgaatctctctctctctctctctctctctctctttctgaatcacccacatacgaatcaatttagagatttacccccattgttgcatctattaactgatgagttaggagatttactgaatctgatttctgcctgttcagtagataaggtattgatgaagcagcttggatgctaaggcagtgtttggcaaatgtctaagggaaataatttctcacccctctttaaatcttaaccattcattctccctcatacatttaatcctaactcttcattcatttcccaatcccaatctcacccctcatttcccattatccaaacacaccctaaagggttgaggcacacccatatattgcagtagtatatttttataatggaaatgtgttaaggggtaagtcaacatgtaccatacctttagataattttgtatcatttgcctgtacaatgcaaatcatggaagttttgctgtaatttttgtcattggtttttcatgaatttagggtgagttcagcaagttataaggttgatcagaattactgccacttatggcattaaactttaagtttgaatggcaaggggtgtgggctggcagcatgatttgaataattcctcctaaggccacaaaacaattggtcttcccagtttggttggttggtggtccgaggatgaaaatcaattagaattttgtgtatggagttttttctttgaattttgagtatttatcatttttcgttgttgatgagtgaatgttagtatcaagtattagtgatagcaagattaacaaaccgcgctaccagctcaacattgttcctcaatcactgtctgtgttgtcactgccttatcgacttggcaatggaaaacaatatatcaaaagtattttgtgttgtagatattttcttaatcattatagattatgaattactaggacttacatatatatatatatatatatatatatatatatatatatatatatatatatatatatatatatgtatgtatattctagacctaggtcatatttacacaatacacgtagataaatagattcttatacttataatatgctcaattcaatttatgttgagcacaacgtgccttgcacgtgcatattcactagttaatataaggaacgggtgggacccacgcggaacgaccacgcgtccagatcagatacacacagagcggatcggacggtccgagatttaaccaaattattaacaattattaattcacccgattaattagcgctaattgtaatcggattcggagtctaatctggcagcgcacgggtgggcgcgccagcctatataagggctcgccgcggggagcagatggacagatcgctcgatggacgcagccatggccgcctccgcctccggtgagaagaagcgtcaggctcagccgcagccgagctcgtcgtccggcgccggcgccgtcgtcgtcgccggcggcggggcggcgcagcagatcatcttgttgcaccggacgctgcacatggagttgctgaaggaggcgggcgagatggcggcggcgtgcggcggcgacgtccacgccatcgtgttcttccccggcgggtcgcgcgccgagtaccacacgttccgcggcgcgcccatcgcggcggcgcgggcgcgggcggtggctaggcggaggcgcgaggcggaggcggcggcggcggcgctgcggggggtggtcgcgatggacgtgtcggggatggcggcggaggaggtggaggcgcaccgccggaagctgctggcgctcaaggccgccgtggtccgcaagctgcaggagaaggccgccgcggcggtggcgaacgtcgccgccggcgacgacgacgacgccggccgcagcaacaagattaggaagatagagtgattcattagtggcggcggacataacaatgtaattagttactaataacttcaattggcatcatggatgatttttgtgcagtctattcgccaactttgtaattaccccgattcaattcattcaattcattgtgatcaattcgtcaaatttgtaattacttcatcctgaattttctctgaacccacaattataatcgcaagattaaaaaaaggagcgcccaattagttctccgtattacggcaagatcttgtgaatttcatgaattccaatttcattctgttaaaattctgcgaaatggagggccataccatccagtactggaggcccagcccatcaaacaatcggatccaactccaacccaattacaaacccaaactcgcttcgctttattaattaattaataataataataaaatattttccccctttttccagtgctttcgctgcgctattccgttattcgaagcgtgctctgctcgctgctgctcctccacctctcccaattagggttttcgctggctgcggcggcggcggcggcggcggacggcggcgaagtcaggcggcctctccggcatccgctccgtcgaggtgagcccctcccaccctcttcccctttcccctcccgtacggatcccgcgcctagggtttcctccctcccgtaggtgaacccttgcgattgggcgtgatttgggcggctgcttgctcgctcgcgagcttggttggtggctgctttggccgggatttgggtgcgttgggactctcgggtgtgggtctgcgacagattagcaccggttgattttgttagattaggggatttggaggggtttgggattgcatccccaaagctgagatcttttatggctgggtctaaggatggattgcaatctgttgggtctgtattctccattcttcgagttgactatgtggagttgctttctggttagattaggtatagctgcgtacgagttagatcttcatgttgctaggacagtttctcgtgtctggattggaaatttctgtcttgatgtgtatgttctctatacgggagccgcgttgggtttagggttcttttcacatttttttttcttcatgagattaatggataaatacctgggttgtgcctattattaatactaatcaaacacgatttattatgtggcgtactggcgaatgatgacaaacttcgttctttttttcagatgaaaagcaaatgcggtatggtcctgtgatttaagctggaagatccgatgctgtgttgtgaggcttggacacctttcacattctgagtctctcaggttggtttctatactacagtgccatcctgttcctgttgtttcttgatgtgtagagtatgtcaaccttgcttgcttgtcatgtttccttaagttctcgatgttccatgcattgacgtaatacagtctgtagaccatccttctgaaagaagggctcctagcaaaccatgtagatcccaagtgaagaacccctaattaacttgctgttgtggacttgtggttctcttttgtgtcatctttctgtttccttcatttgtggtgattgttggctgtttcccttgcttgtatgtgcttttccattcttagaattgcatgcaaatacactgttaatgcacccaaatttactgaccaatgttgtgcctattgtttaatcttgaaagttgaaaccaagaactgttgtgttcttttttgcttagataaccatcagatggaatatgacatgctagctatatggtccatgtaaaacgactctatatggttggcttcttggattctttagacaatgtagggttagcgttttgatgtgcttagcgctagaattgggagatgattgtggtaggtgaggggacataggaattcatgcgagctgatagaattatctttctcacatgcaggattatgtaaatgccactttttggagtgtctgcccttttggtttagtctccattcctcaagactatagctagcaattatataaagaaaaaaaattgaactgttaattgccaccaagtcggcaaaatcgctggaacacaacattcgagggagaaacttcagtggaatacgagtagtatcagtgccccaaggtctctgcaatcagagacagtaacaactgaaccttaagtatcgaccaagtctggcaaaacactggaacacagtaaatgaaggagaattttggtgcaatctgttgatgccccagataacagcaattactgcttgacattgttttcttggtaggttgtgtttgtagatttagccgtcctgtaagtgtagaaagcaaacattcttgtcatatatttacctgtaagttgtataggtttatttgagtggttataatgtatatgttgaatgaagtattccatggtttttgattgtgaactatgccagatgaataaaaaacactggtttgtacctgggtgtggaatttataagttcttcacaagtctgatgactcttacagtcctgctgtaaaaaagttattgcttcttatctctgcataaggttcattttccattgtgtgattgtgtgcaatcttgatgttgggcattttctccaccttttgactgtgccaaatccaatctccacagttctggccaattattcaaatcgcatgcttagttgtgctaaatctgctataataattattccattctacttttatgaagccgtgtgactaatcgtcagctagttgataaatcggatagggagcacgacttgagggatacgactttgacttggcaccagaggacgcattggagcaagggcagctacagggtgccgcttggcaggcctggtttatcgagcccattgagtgaaaagggggatgagaggattgtcgggtccattgggcacagcaagtagtagcagactagcagtagaagtaactggtatatatagtaataacagtctgaagtcaactaaatgacagtcacgactatccttggaagatgggcaatcgactttactgactaaaaaaacatctattctaatattccacaggacaaaactgtaggctatactttatacttattgcctttcttgggcattcaaatggacagtgaaatacgtactgatggaaattgcaggctatagtactatactttatactgttgcagtatggtgttaatatcccaacccgcttacgcacatgtacaaggaagcagatgggtgatgctgaagtttcagcaattgctggcaaaaatacgtgttcagtttggtacatgttgataagttgctaaattgttgagtgtcctgttgtttgatcttagaaataagcaagatagatgtgctgactgtagtctgatgtggggaaggtaatcaaagcgctctagaggataactactcacattcctgttgggacacgagggagttcctgaaaatcctcaaaaataattcatggaaatagtgcacactagggtttgagtgcttgtgaattcccttcaacaagtgttggtatacgtagttgcctacaaagaacaaatgaaacaaaaatacagagaaaagtatgtcctgagctttttggtgagggtatcaattaaacaaaaataccagagaaaagtatgtcctgagctttttggtgagggtatcaattatttgccacccctaaaattgattcttatgaggatttgccactcaaatgtccaagcaatgtaccgtatgactaaaatttggaaagtgtaggtggcatataacttgtacaataagaaatttttcttagttttttgggacatatcttatgttgtatctatataatgagagtggttagccacttaggcggttaccttgaatccttgatagtggaaggtctgtttcagtatacccctcctggctttagcgttcttttactagatatgtcttacttgatcctggatcctacttattatacagctgtcagtcagttgttaagtgtctcaactttgttgatgtttctgaatcatgtcctttgagaaagctatatcttttgcgcatactgcagcagtcacttttgttgttgaagtattctattcttccattgattataatatatgcaaacgatctttgattatttcagatagaccgacaagagtactttcggataagggaaaggaggttgtgcaccaggaactacttctttgttggactaataaagaagggttaaaatgactggtgaaacaaggaaagaacggtccaagtgggatacaaaaggacctcctgatatagtggagatcagtgaagatgagtctcttcctatgaatatggatgatcataaaaagggcaatgatgatcatagaaagggcagtgatttgctcccttctcaggattttggtcatggtaatgacaagcaaattggtgaatctctgaacctcaaatctactgtctctatgcaccatggtagcgctggacatgagcaggatcgagctgatggactcaacaaagatatcaaggaaaggtcatccaaggcatcctctgaaaggttgcctcttagaatgggtgatgaggatcataataaaaatgactggcacaacagaggctttgaaaaggcagctggtaaccaaggtatgagcagatatgcagatgacagaaggcgtggtgatgggtggggtacaactcttagccgtggttattcttctaggatatcatcatctggtccagatgcgtggaagagaagtcgcagtccactatctccaagaggtggttggaacaggtcacgcaggtgtgtttgaacaagtaattagtttaattaactgtgcaactggtaacttttttcttgtatattgtgtagcagctgttggagatgattttaaaatgaaatttatcaagaatgaaatatccaagatagattgtatggtttgtttgttctataaatgtcaaagatgatgctcacataagaagtttttacaatttctatggaatacatttatttgaaattctaatgaaaaattcaatttactagtttcttttccctgcctctttaatatatttgttttcttttacactttacaggaacagaagccgttctagaagtagaagcaggagcatagggcgaggtagaggtagaagcagaagcagaagcagaagtccttatttcagtgaccgtggatctgaatggagggttgagagaagcagatcatctggaggacctgctcttccctgtagggattttgtagctggtagatgcagaagaggctcaaattgcaggttccctcatgaagatggtgtgcgcaggcagtttgatgagcattatcctgtagattcaagggaaaagtatgggcatcagaatagggacttcatggatccacgagaacaagatgactatttaaggaataggccacctcgaggtggccattatgatgaaggaacttgggaaagatctgaacctcgaagggagtatcggtctacgatgccatgccatgattttgtcaaaggaagatgcagtaggggtgcgaattgccgatatgttcatgatgattccacccctcatggtggatggagagatgaggttagagataatgctattggtagaagtggccctgattcatcatatgggaacaggactgagcaccgtagaacaaataaaaacccctgcaaattttttgctaacggtggatgccgtcgtggccaaaattgcccatatctccacgaggaagcttcccagagccaaatgggactgggtgcacctgatgagcctggttacactggtgggcctacaacaagaggagattacttgagctggagtgaacaaaataattctgtgcaggcaagttctcatgttttgtcaagagatgacagagaaaaccctgttcctcagggtactggcagaaatgattctcgatatgagaacaaaaaccggcattccaaagatgctggaagtagtcagtaccagatattccctcaggatgattttggttcagtagggcaaaacaaacctgaaatagctgcttcacaactgccacagttcataccttctgtccaaacaggcacagagagcataaacattgacaaggtatctgacatgggtggtcagagtggacctggaaccgttggcaatttgagtatgcaaatcgggatgcattctgctaatcttttaggagggcataacttgggccaaaaagcagagagccaagatgcaatttctcaaatttctgctgcaccatctcttccgggcgccacccaattgcagaatactacatcctcagtgcctttgaatagccaagttcagcaaagtgacttttcattacatccaaataggcaggaccagtttgcagttcctcatgcaactacaaataactctgctcctagcatgcagagccagccagttgctccttatatggggcacagccaacacggctacattatgggggcacaatcattaccagatctctctgtgcataatggacaaattttcaatgttggtcaagttccacagaatcttccaacaatcgtgcatgctgggcagaatcaggcaacaagtgacacacccaacctgggccgagatagtggtgatcaaggcttgcaaaacacacataatttccagcctgttgctccaaatgagcaaactcagagtcaaaccttgcaagggttatcagtggtggccagttccagctcagttgatatggctggagctcctctttctcacaatgcagtgtcaagtcaggaagaagtccgtcgtgttactgcatctttggcccagtactttgttccttctctgactgctgatacctctgggctgcagtcgtctcagcctgatccaaattcgagtttgatgaacaattcgtctgctgcacctcaagcagttcaacctaatcactggccttggttacaacaagcaggaatggtccaaccttcacatattgttccacctgaacaaccagctccccagacatttcaggcaccaatggctgctggtagtagtaatggcaaccctctgcttttaccccattcggttgcaccgactgttcctgctgctgccttggcgaccaatgaaactacacctgcagaaaataagaaagaagaaccaaaggacactgatgctgaggctaatgaagatggtgagaacaagaagagcaaggattccaaggcgttgaagatgtttaagcttgcactggctgactttgtgaaggatgcacttaagcccacctggaaagagggtcaaatgagcagagaggttcataaaacaattgtgaagaaggttgtcgacaaagttacgaccacagttgaaaatactcctcaaacaaaagagaagattgatatttacatgtcctactccagagaaaagctaaacaaactcgtccaggtaacaatgagcttccactctcagcgctgtccacctggcatctcttgtcatttgagaaactaaactcacacatataggctaattgggctgtgtttgtgtgtaggcatatgttggcaagtatgccaagaaagattgaagacatggtgcctgttcttcctgcattgtattagaaagattgaagcagccttagctgtccccaagtttaggattcttcttttgtcttcaaagctagtttaggatcctgtaatttagggatttgattaaaatcacaaacatatttttcccctcccaatttcaatgttcactatggtggtttgacaggtagagtattttgctggtagggcaactgaaccaaatgttacctcaatgtaacttttgtagaatattcatccgagtcatgaagctttctgtatgagattgtacaatctttggatcatctgtatgagcataagctgagatacacccgatggttgtgtttgtgctaatctgtgctgtccctttcagtgtgcagcacaaacaagaagtgtaagctagctgctactaccagtctattttgtcacatgtcagggactcagggttaggaacatatttttaacctgaattttattcgctggatccatatgcgaggctacgatggctgcacgtatgtctgcttgacaaagtcggcaagacaacatgagctgcatgtatgacttccttgagcttcctggtgcctgccttctgatgcactgatgcttctgaacttctgaagttgttgtagtagtagcagtgtaccatatttcttccaattaaactggaaaatctagctagctagccaccgtgattcatcgtccatccaatgcaagatgccaggaaattttcactgattcggttgttggtctctggtcctgaccaaatctcatgtctgaataatttatttaatcaccacagaaaggaggacagcttagtacaaacaaaaagaaattttgctttgaacaccttgaccagttttaacagcggcgtagcaagaagggtgttttgtgttgtggttggtgaggagagatctctgaagatgtgattagtcaaagaggccaaagaacattagtaaaaacaagaaggctgccgctttgctacgtcgtctctcgcctgtgactctgaagaacatctcgcttgttcttcaattgatgacttggctactacagtagtaatgaatggtcagaatatgggacacatcagtgtcaatgtggagctttctgctgttttgatgtggtttgtgaagctgctgcttggaaatgcgaacctgcctagataaatggctggactgtgagtacaattcaattcttggtgaatatttaataggtttattttagaggcaatttggatctactagtatactgtattagtactatattgatctccttttggtcccttattagagaattcaatttggaatgcttgtctttgtgtaactgtgctttgaccactgtctagattccagacaggtaccctagtccaatttaaactcaaactaaatcaaccaaagcttatttgtttggactttggcttatgagctattacaaacatattgtaaaattaaattttcttcttttcatttttttcactcaactatgtctttggaccgctaaaaatatatgtataaaagtttttctactcaatcttaataagccaaacaacacagcctttgtcgtaccaaaatttttgggaaaagccaaaggaaaataataatcccaattaccgcacgataccagaaattatgcaaaagtccaattacaaccacgctgggaaaaaaaggtaccaagaacaatttattatcctatggaaaaaaaaaacctcgtgtcgatgttattaaaaacaaaaaacattatttgcctacctaatatttaattttggagagagataaggatgtggatggtataaatatctttgttttagataatggccgtgtttagttcatcgtcaaattcttttttacgtatacggactcacatttaaagtattaaacgtagactaataacaaaactaattacaaattacgcctgtaaactgcgagacgaatcttttaagcataattaatccatcattagtacatttggaatactgtagcacttatagctaatcatgacgtaattaggctaaaaagatttgtctcgtgatttacagtcagattgtgcaattagtttttctttttgtctacatttgatgctccatatatgtgtccaaacatttgacgtgacagaaaagttggaagtttaatgagaaaagttagaatctaaacacagccataaatatcttttctagttcattttttttttgtcacgatcaagctttacaactagccgtatcacagcaaaccattttccatctctttccatccactagtttcaactttcaaatactaaaaaaaacaacacaacgtgaccaatatcctgcctacgtggatcaacccaccctgaccccaatccgacccatccatcccccaatcaacggcctcgatgcacccaccgtccccacggatgaacggccgagaaccctccacgtctcacatccaaatctcactataagaccgctataaccacagaaaaaaatttgaaaatatacttttttttctttcaatttacaaaaatatacttgcacgacatatatttgcgaaaatatacctcgtccgtatattgggttagcgggagcggtacggtaggcacggtcgcgcgtagtggggatgcgggatcgagccggtcccgcacggcggttgcgcggaagcgatgcagcccgtggaacgggtatgcgggagcggcagggatgcgggagcaccttgggagcggcacggtcccgcggaacgggcgtgctggagcggctcggttccacaatttttactgtatcagtactgttttgacactatttggcactgttcaaacagcggtaccgcggatccaatgtgcggaaccggctcatgaacagtgtgaaaacagtgcgaaacagtgcagaacagtgtcaaacagtgctatatgcatgcatgtgcagcttggctgctcggtcacgcgcggccggcctgcgtgaccgcacggccggtccgcgggaccgacgcggtaccgtgcgtccgtgctgcaggaccaccggtcccgcggaatggtagtgcgggaccgcctcggtcccgcgtaaccacactgcgggataggtatatttgtgcaaattttcgtcacataggtatataaatgcaaaataataaaaaaagaagtatattttcaatttttttctataaccacgtatcgagaagaaaagagaagagagaagaaaacgggctacagatttatagctagttgcaacacggactctaagacgttatgtgtatatgagagataggaccggtattaatggtgtagtatatttttgtacttaactattgtatgaatagactattagattagctatagatgatttagagccagcagttagctatactgttaaaacttgctctgacgagaacgcccccgccacacgtgccgaatgacccgcccccacccctaccccgatccggtgggcccggtgcgaccccccctgcacccggtccacgaaacgccctcgcggacccggcgcctcgctgtgagtgggccggcccatgcaccgggtccatggaccacctacccccgcgtgggagaattcctaccgcgaccggtttatatacccgcctcgtgtacccgcttctcccccactcaacctcttctcctccctatccattaattactcgcttcgtggtcggaatccatggccgccgccgtcgggaaccctaacgcggccgccgctgcgtcgatctcggcgtcgagggtcggtgcgggggcgttgcgcgcggggggcttgagggtggcggcggggaggaggggagcgggggctgtggtggcggcggcaatgcggccggcgaaggcggtggcgtcgccggcgaaggaggcggccggggaggtgaacggggcggcgtcgggggggttcgcgaggcccgacgcgttcgggaggttcgggaagttcgggggcaagtacgtgcccgagacgctgatgcatgcgctcaccgagctcgaggccgcgttccatgccctcgccggcgacgaagatttccaggtaaccgccgcggtgctggatcccccctccccccactccgatttattggatttggtgctcgcttgtttcgatttgattcgcgaagtatatttcgtttgggttttattttcttcaacccccttggaaaacgccaccatttcatttcgtcgccgaattggttgatggtcggagatgttgatttgcaaggtttagtccgtcgattttgtttcttttgtggattaatgatgattgcttcgattatattcttatagtttgcttcttttattttgtgtggattaacgctagtaatacgtgatacttgtgtgtgtttgagatctctggtttgtggtagaggggagaagtcacatcaatttgcagaaccaatcaatcttcctttgagaccgattgatttttcgacgaagattcagttttcgtctgtgtccctttccgagaactgcagccacatatagtactttggagcccctattcttcaagcaccggtatcactgtatttgagctgtagctacatcgcctttcagagaccaaatgcatttcaatagtgtgaatagtttgtttcatttatcactgcaatgcctgcaacttcatatgattcctgaatcatgcgaaatgtttagaagtagtagtagtcattttgattgctagggagattatgaaataacaagagagttgtgtgcttgacaacaccttgctctttgcagaaagaacttgatggtattctcaaggattacgtcggccgggagaccccgctgtactttgcggagcgattgactgagcactacaagcgcgctgatggcacaggccccatgatttacctcaagagggaggatcttaaccacactggcgcccacaagatcaacaatgctgtcgctcaagtcttgcttgccaagcggcttgggaaggaacgtatcatcgccgagactggcgccggccagcacggtgttgccactgccacggtgtgcgcgaggtttgggctgcagtgcatcatctacatgggtgctcaggatatggagaggcaggcacttaatgttttcaggatgaagcttcttggagcagaggtatgacggaaacttgtgcatctttgtgcttgcaatcgtgtacactcgtttcgatatgaatgtacaattgttcctcaacatggtttgctgatctcttttgctgaaacaggtgagggcagtacattctgggacagcaactttgaaggatgccacctcggaggccatccgtgactgggtcaccaatgttgagaacactcactacattttgggatcagttgctggtccgcatccatacccgatgatggtgagagagttccataaggtgattggcaaggagacccgtagacaggccatggagaagtggggtggcaagcctgatgtcttggttgcttgtgttggtggtggatcaaacgccatgggtctcttccatgagttcgttgatgatcaagatataagaatgattggagtggaggctgctggctatggtgtagacactgacaaacatgctgccactttgacaaagggagaagtgggagttctccatggatcattgagctatgtgttgcaggatgatgatggacaagttattgaaccccactccattagtgctgggtgagtattctgttgttggcattgacagtaattcatttttacagcagttgggctaatcatctatgctgttttgaatggtaggctggactaccctggtgttgggcctgagcatagctttttgaaggatattggacgtgctgaatatgacagcgtgacagatcaggaggcactggatggtatgtgtttcagtgtcactatctacggttctcttctctgatattttccttccacttgattggtggaatatctactataaatgccaatagtatatctctttgatggtggggactgctaatgagtaagagtaggctaatagaaccaacaactgttaaaaactgttattcttagtagcatatattgtgaatgttctgaactttcttgatacgagtttaagcagggctaaggcaccaattttgttgtttggcccctctaccatcttaatgatatcagagcaactacgctttggttgtctgcaactctatctgattcacatgttagacaaaaactttagatttacactggaaattaagctttgctgttgagttagtagggtatccgaaagtgaccctgaattacagataagtaagaccaggcaaattcttaacatgctgagttgctgactcagtagtttgctagccgtcagtctgtcacatatgcatgttatgttaaacatttagttgatgttttgatcttgattgttgtttacttgttttaacataatcctgagtactaaaatattaccgagttgcgtaaagttatgttggaagtctttcacatcttcactgacataacgataaacatttactagttgatgtcccaatcgttgattaatgctgcaatatctaactctttaagtgctatgctcaaaatctaactattcccttttcgaatgctatcttcacatgcagctttcaagcgcgtctctcggctggagggcatcatccctgctctggagacgtcccatgcgctcgcctacctggagaagctctgcccaacgctgcccgacggcgtgagggtggtggtgaactgcagtggaagaggagacaaggatgtccacacagccagcaagtaccttgatgtctgaaaaaactctagaggggctaaaaaatgatagcttttccatgagcagttttgaaagggtgcaatacaacagcagcaattgattagagctttgttatttggataaaaaagtaccaataatgcttggaagttcatattagctacaagagtatctttgtttgtttgtctttgtatctgaatgatgttattggcggagttggtaaatataactaaataaacaccaatctttctccattctatcagcatatcttttcagctttgctccgtagtatgctgtgttctctctgaatcttcagttgtcttgttactttgtgaagaacatgatgaaaggaacaaagaggaggtgaattgtgacatttgtttagtggttgagtcactacgctacctttgctagtaattagttaaaagttttatcttttgctagtagtaaaaaatgtactaacatcatcttaaaaaaaatgtacaacctactactaccgctgctactgtctgtctgcagctgctgcattgcttgaacaacatctttccttgtacaggagtgagagatgtcgacaggtgacactgtgacagcagcctgctctgactaaaccaacaaatttgttgggtgttagggccttcatttaagttgagatggcttaactgtctttaaagctaagctgccgccgccatggttgttgattctcctgatctgttttgtttggaacacatgatttcctaggttttgacagtatccgatgatctgaataaaataaaagagacgtatccttttcttgcaagactaaccaataggtaatgtatgggtttttgagatacacatggtttcctatgctttgacagcatcatctgaaccaaaaaagagaaaatgtccttttcttgcaagactaaccatgggtgatgtgtcatgtgtaggtttttgagatgtagctttggaaaatatatactaggaaaacatcatttcatatctgactttgtgcaagaagcaacatcaaaatatcgcatcattcatatcacacacaaaaacatcattgaacacctgcagatatacaccaaaacaaaatgcatcaactcagccagactttagatatggatgcaaaaaggtagtccaattaatcgaactgtccatgagaatcacagagaggatacaagacagacttctgcaaatctccaaatgcatgcaaagtttaagcccaatctaatagacaaggagagcaaattaagcacaaacatgatacacactctttttgcaaactgaatttaaaggtactactatgcagtacacatatgcatgcattagtccagctgatgatgaaattaacaaatcttgcatcagaagaggagttctagagagagagtggcaacccggagagagaaagaggagtcaatacccgaaccaaccaaccaaccttgcaaagtgttgcttgcttccgaactaattaactctgatgaactgttgatgagccatgtaatgcaggtgacagatcattaataacttaactgaaactaacctaactgaaatcaaataagagggggcatatgcatggattggatgcaatgtgtttgtctgaactctgaagcaaatttaattttggatgatgagtaggaatttgttgagagcaacacaactcagagcctatgacatatcactgtataaatatatgtagtgtatatatatcagccatgatcacaggacctaagttgtgttgctgctgtgttggataattaaggtttttactcatgattaatttttctgggggttttttggtggtggtgatagtgattaaaaaaaatgataaatgaactagctaactgaagcagcaactacacttttgcaaggacagtagtctgcggtgcgttcttgactccccacattgctaaacctccgaattcgctcttgatccctcccttgatcccctgcacaaaattcgatcaaatttaaaccatcataaatgcgaattatgaaattaagtcagagaaaaccatttcaagaaattgatcacttagtaattttgctggaattttgtaggaatagttaaagcagagttcaatcttgctgaaataagaaaaggggtatttgcagatgaaaaaacactgaatagggctcaaaatttgactgaatttgaacaattttactaaattgagagaattttagaaatttcgttctgtaatgatcaggggatctcacttaccattgcacatgatggacagatagatgggcacgccggcgaggtcaccgtgggcatggcggcgcgacgccgttgtcgccggtgatggcggccttgatgcgctcgacggtgcaggcgatgaggctgttgacggtggcgacggagccgagcgacagcttggcggtgggcacggagtcgaccagtatctggaacgccaccgtcagcagcgacccgccgccgccgtccggcccgtcggggaggatggcgaaccccgacggcagcagcgccacgtagtccgggtcgccgccgttgagcaccacgttcatcgccaccacgtccaccggcgcgtatatcacgtacgaccccgtcgcgtccgtgcagcactcctgcagtatcagcatgttgctctggttcgagttcgcgttctgcaccaaattattttattcttctcttcatcagcaatggcgatggatcgattcatcatccattttataggaagaagagctatcttacgttgacgcggaggagggagacggcgttgccgtggtcgcggccattggcgatgtgagccatttcttggacgacgccgccattggagaggatgtcccactcgctgcgggtggagtcgtcgcggaggaagtcgaagacgcgggaaggcgggacggggagccagaaggaggtggcggcgttgaggatgatgccgggagggcggccggggtcgtcgacgctcttgcgcgtcatgacgcggacgtcctcggcgccgctgccggagagcgtcgtccactggtgcgtcgtcgacgccgtcacgccgccgcagaagctcgccaccatccgctccgccagcttcagcatgctccgcctcccctccgacgtcgtgatcacgccggcgtcgcccgaggacgccacgttgctcgccatggcgctagccaggcgctcgcactgccgctccagcgtcgccacccaccggcgagcgccgaacgccatgccggagttcaccaccggcttgtacaggttgtgcaccatctggtcgtcggcctccacgtgctccacccacgtcaccttggagtagccgttcggcatctcctggatgaggcagccggaggggcggcgccggtggccgcgcgccgccgccggctggcatccgcccccggcgccggcgcggagcccgtcgagggagacgtcgacgacggcccacgtgccgtcggggtgctgcttgcagtagcgcaggaactgggtctccctcgtcggcaccagcggcgacggcatctggaactcggcggacatgagctgcagcgcgccgttgtggttgccggcgacgcccgtcgagagcacctccagcgtcgccgcgcgcgacacgatgctcgagaagagcgccgtccactgcccgacgtccatgagcatctccacgaggctgacgtggttcatgatcaccaccgccgtctccctcgacgcctccgaccggagctccggcgacttgggccctagcccgcgcgggaacgtgcgcgcgtactcctcctcgccgagcgcctcgccgccgagcgccggcgcccagagcggctcgccgagctgcgccatcctgacgagctcctccatggcggccacggcgagctcgatgacgagcggcttgtcgaagtcggcgccgaacacgtcggcgccagcgccgggaatgcccatatgatcgagcggcgacctgttcgacggcggcagcggcgggtacgcggccgagacggccgcggcgggcttgccgacgtacttggcggcgatggcggagatcctgtcaatctcgtcgcggaggcgcgcgttctcgaggcggaggtggtgctcgtcgaaggacatctcgccgatggcggccggaccgccgcagttggggcaggacgcgttggcaagcgcctccttgtacctcatgttctctgcccgcagcttctcgttctctgcgcgcagcgcattgttctcgtgtctctcatgctgcgtctgcaacatacaaacccgtgcaaccacacataccattaacatttataaacacaacattatgaaccgatgcacgttcacatgacgtgtaagatatacgatggatgcacggattagtatattaccttcatctgggtgcgcttgttctggaaccagaacttgacctggaggggctcgaggccgagctcgcggctgagctccttgcgctgcttgtcatcagggtgggggcactccttgaagaaggcctcgagctcctggatctggtgctgggtgtggcggtggtagcgcttcttgcgggggcgctggttggggtcctgatcaccaccggagccacctccgccaccgccaccgccgctctccaggttgtcgctgccaccggacttgctcatctccagctcgtcgcgaggggcacggccgtcgctctcgctcgtcgtcgtcgcctgtgggggaagctgatgctgatgctgctggtgctgatcaagcagatggtgtccattgtggtgctgctgcagcagtgatggcagctgatggtggtgtccatccaacaagctctgcattgtgatttaacattcatgagctgtgcaacagtcaaggataatattgcagaaagagtagcaaataattgttcatatatagctagagttctagaaaatatgcactgtgtgcagtttcatgatatgatcgagcatatatatctgtaattcagcttaagtaagactaggtgtgaatataatttggattacattatatatgtattatattggagatgcagacaagtgattttgatctatatctagttgtggagtatgacattggtgacttcttgctgttctaattaacttgtactaaaaatctgataggtaaagtttattttctaaagattaaaaagaaactaactagggagacacacattatctctcctgcgcttgcacacatcaaaataaacaagctaatgcaagggagagttataattctggatatattatctagggaaaattgcttaataatttcactgtttagcttctgaagtaaaataaaaccggggaagtttgaaattgagcatttgaaatgagataggaccaagagaaattaacaacagcggtactagtgctgagtctgactaggaaacagtgtgcaaaaatccggttcatccaggggtagcaaagcaataaatgttttgcaaaataggattgagaaaaaggagcacctaaattagggaggaacacagcttgagaaataaaggatggcacaagttaatgctatgcacaagagagtagggtgcatatgtactactgaagctgtttaattttgcacatcatcactactcctttacaagtgcagcaagtgcagagagacacacaaagccaatattaatatgcatgctccatgtatacatttttctcatcaggtatgtagctcaagtagctcatgtatatgaatggatcccccttttggtatttattaatccctacttaaatgcattcgctttctgaaaactaaacactctctctggcctaactccatatatgtaaatggtatgtacaattgaatacattcatcataggaagtgagttaattagtgatagatgacagtgtgacagcctgcctgacaggcacacaccaaataacaagaggtacttagcacttactggtggagaacacttaagtgcaggaaatcagcacagcaaaggcagtaattaatttctaggatttaccacatatatgcaaaggattaattcagaaggatcatcacaaattaacaagaaagcaaagcattataagagctaagtaccaaacaaatcaaatcaaacggatttgaacacaaataatccttcaccaacacatctgacactactactatacctggccgagggagagcgccgaggaagaagaagcgtaggcgacgccgccgccgccgccgccgccgttgggccggccgatcatcgccggcgacatgttccggccagggatcatcatcctctccctctccctcagagcatatacaaatatatgcacacaccagtactagagagagagaaagatatagctatctagctagaccaacaaccctaaatagctagagatccaccatggacgaagcaacactcgcagagctcagatctaccaacaaatcaacaatcgatatacaaacacacaccccactcgaaacatatatatagctagcgctgcagttgtacggtctatctatatctggcggcacagccgatcacgcagtcgtcaagaacacacataaaaatctctctctctctgctgctgctcttgctactgtctgaaagagagagatcagagtggagtgatgtgaggaggaagaagagtgcggcggtggcggcggcgggaggaggaagaaggaagagggggaggaggtgaggagggtggagggtgcggggtattgaagagggggggagtaattgcggggagagtagcggagagggtgcaatgggcattcattgcgggcgtagcgtggagttattgcatgacacgcactgccccttcttgcatctctctactctctctcttctctcctgtactcgcagctagcagtggtagagagagattggtatacgatgtagactacgtgtctagtaggtgtgtacgtacatacgcgtagatgtatacggcagttcgtacgtcatgcatggcctggcgcgcgcgtgggaaaattggttcgttggtgcgtaatatgtatatctaccgatatatagtagtatactggttatagtcgttagatcgtagtgtaataatatatatggataagcggttttatcgtacgttttgctgaaagtcatcagtgacgtctgacaccggccctcttacactacacggatactagctcagtatttatcatacaccatgcaaagttttttgatctcttttttgtttcttctctagtttgtttggattcactacagatgaagattaagtatggacacgtaaaacaagaaggtcattaagttttaataattttaaacttaaaatggatttgttttatattttaaagcaacttctatatataaagttttttaagttaaaaaatgtacagtttagcagttaaaaaaataagtaaaatttagattttactacaaggagttgattaaattttagattttcgtggcacgcttttcaaactactaaacggtgtatttcgtgcgaaaactttttatatgaaagttgttctaaaatatcagattaattcatttttcaagtttgtaataattaaaagttaattaatcacacgttattatcacctcattttgcgtaaaatacttaatcttcatcttcatcttcatcttcattttcaggagattcaaacaccacctttgtatcttaataaaaaaagtttggaccatttttatggaattggataactttttaagttacgtgcatgcggtttagatcagaatgaagagtcgccaattaggacacttccaatacaagtttcgttctactattaaattaggtactactccatatcagtaatttggatgatgtgtaaaaaataataatgaagtgagagatgaaatgggtttgtatcttagatgaaaccttctatacgctgtttccttatatgtattgcctataaaaccacaaacatgaaacaatgtgttatcatattagctattttagtcatcaattaaaattaccttgttgcattggggatggctctagtatagtacagttgtgaaaaaaaagaagtgggttactaaaataaaataagaggcttgtacgaacgacagagactagccaataataacttaaaaagtttttagtcgaaactgaaatgtatataataaatataatttagttgtatacaactcacatgcatttatatctcgagcggtaggggcaactgcgtacaaaagattattatattaaagtaagactaaaagaaaccatagttctcatttgacggtacaagcgtacgttgacacatagttgatctaatcgactaggtcagacctgatccttatgaacgtataacttagagaaaatcccctacgtacacatgaaagttcacctaatcccttctatacctctgaattttgctcaatcccttacatacccctaaattttagtttggatctcttccatgccctttccgctagttgacagttagttgaccgttaaattcttttgaaaaagtccattttgccctttcctatgaagaaacataataaattaatgaagtacattgttggaatgtaaaaatttactggatgagactattatatttatgagtctgtgatgcaccatattatttgtgacaaatttacttttacatatgatataaaaatttaatacttatttattagttattaaaagttcttttatgtagcatatgtgttttcatagtaatataacatatttgtttattactatcagaacacatatgctaaaaaaataaataagaattaactttttatgtcatatctaaaagtatatttatcgcaaataatatggtgcataactatctcataaacataatagtctcatata

SEQ ID NO: 37605 - DNA, 6440 bp, Oryza sativa
gaaagggatggaagggatccaaactaaaattcaggggtatccaagggattgagcaaaattcaagggtatagaagagattaggtgaactttcaggggtacacaggggattttctccataacttaagatttatggagtcacaataaggtggtgtttggatcagggacttaactttagtctctgtatttagacactaatttagagtattaaatatagactacttacaaaactaattacataaatgaaagctaatttgcaagataaattttttaagcctaattaatctataattagagaatgtttactgtagcatcacatagactaatcatggattaattaggctcaatgattcgtctcgtgaattagtccaagattatggatgggttttattaataatctacgtttaatatttataattagtatccaaacatctgatgtgatagggatttaaaagttttagtcccatctaaacagggtctaagtacctcactgttgatgagtgtatcacctaccactgaaaaaatatagttgtaacacaagtacatatactgagttggatacttaaacccgaatgtgtgagttccatcaaataaaccataatttactttggagacataataattaccacatcgatggaagaagaagaaaaaccatatacaaggttggtggtgtgaaaatccatactacaacaaaatatgtaaatatattggtcacatgtataacaaacgacaccactagtacagaaatgattttcgcaagcggctaaaacctattttcacaagcagctgggtgggccgcctccccatacatgtctgtaaaaattggtattttcctagtcaggtagggcatccatgcacgaaaagcgattttcgtggcggtcagttaagccgtccacatgcgaaaagaaaagaactcacaaaaaatcccaaaattgaaaccctagatagcctcgattcacaagtgcagtcgtcgtggttaccgcagcccattgttgcctccgtcatcgttgtcacagagctcctgagcatcgttcgccatcattgccagaggtcctgcagctcccgaagccggcagcaccagctccgccgccactgatgtcccaagcactagatccgttgtcgctgaggtttcgagcactagatccaccaccaccgaggtcccagatccgcgcccgccatcgtcgctgccgccttcacaaacctccatcgttgagcacccagcgccgcacccgctatcgccgcctccagaagatcgtcatcgctgcctccgtctcttgtcgctgccactaagagaaatgaggagatcggagtggagaaaaatgaggataagggagaggagtggaagagaagcggagaggtacgtaggagagaaattaaaggagagggaagccgatgctatatttttgcccaggtatcaaaaaagtccgtgtgcgaagtaactatattttgcaggcggggctcttaaggagcccacctacgaaaatcattttttccaagcgggtcttttctcgacaccctaaaatcattttgcatatggatgttcttttggtctgcttgtaaaaataaaaggggtatctgcaaagatcatttatgtagtagtgggtaacatctagttgcatatataagatagagatatactttttcaatgaacataaaaatagaattagggatttacagtactaatttccaataatcccaatataacccctcgcaattgcatggcatgaacaggtgaggtggtggggtatgtcaaatttagaatttgcaagttaaattataacaatttaaaattctatattttctccaaaataggaacaaaactattcatgaaaatgtttatcaatatgatcacttctccaaattaaatatataaatccgtggaacagaaacactcaactctaaaaaaatattcaaaagatacacaactctaaaaaatattcgtaaatctagaactatgtcaaacacacgaccatatgtatatacacgtactgcacgtacgtgtcaacgtacgtagcatactgtaaagactaaacagattatagatggagggtgaacgtgtacgtacactagtagcaagctctttcagaactaattaaggccatgtttgtgtgtcacatcagatatacggatatatatttaaaagtattaaacatattctaacaacaaaaaatattacaaattctgcctgtaaactacgagataaatttataaagcctaattaatccgtcattagcaaaatatttaatatagcaccacattgtcaaattatggcgcaattagacttaaaatattcgtctcgtaatttacacgtaatttgtgtaattaatttttttatatttaatactatatatatgcatgtgtccaaacatttgatgtgatagggtgaaaaaattttgtttaggaactaaaccgggcctaaaggtaaatggacacatgtatatattatatatacaggagaagacagggtgaaaaaaaaagagggagaagaaacacacagccggtaagtggtgtgtttggtttttatcagcaacagcaggcagagcaacaggagcggccggtactgcacagagccgtttttgtgagctgttcatgacttgtggtgaaagaattaataggtggtttaggtccagaatttattgctttcgatctctctactacaccgattgatggagtacgtatacgtacgtatatactcctgtttatatgtatactgtataaaacatgcaaacttttacagttctacgtttatacaacacgcatcggtatatatgaaaaatatatagctagaataatcattattggtctatataaaccaactcggatgcagcaacggccgatttatgtattattaaaaaattacaaaccaaatcaacatgaactaattaattttaactattttatagttttgaaattgacaataaattcaaatgatctttttattatactgtttaaaaatgattgataaagcactttggaaactagtgttgaccaaatagtataatgaacagcaaaatggcatgcatatatctaagtgcgttatatacataatttaattgtaggagtacgtaactctaattttgaccagacatatggcgcgcatgcatatatctttgtagatggagaatctcaattcactacaagaaaacggaatatgcttgacggaatctagtttatttttttccaataaattgttcagaagttttagatttaccatgtagatagtagggttgcaataatctcatatttaatataattaatcttgtaatagtcacttatatttaaatatctaatcaatcttatttcagaaaaagtattttggtcgcttgatctgcatcgaaggatgacacaactatatttgtggatatctatggatatacaactccaccaccacaccacagtggtcgtgactaaaacatatatttattaattaccaggggtttttttaaaaggaatgttcaacaatggttttttccacgtattactatatatagggtactgttattatagagttttattgtatcaatatcggctccaacttaatatgcatgcaatatccagagttcaggtttgatacacactaacttcaattgaaatcatttataatttgatgggtgcaccgtgcactacatattatgcttttgtttgaaatgaaggtaggaaaggcgacatttcaagtcacatggcctatgtgttatgaaggtcagcttaaatcttaaatgctgtggtccacaccggccgcaagctgggtaacaactgattatgatggatggattaaaggatatattctactccggtagttacatgtattatcaaaactttaatgtcataagaaccttattattttcttgttcacttttgaggttggtgatttattgaatgaagtaaaaaaaggacaagcaattttcttacgtttatagtattacttttcacatctatgtggtttatttgttaaattttttattttacatgtagatttatttggagttggttccgtagctacatgcactaaaaatttatatatgaacctagctgtgaattgatctgttcacagagtaaaatgcgtcatcaatagcacaaaaaagtgaatacaattcaacctctcattatttgctctatagcttatatgccgttgtcaaaatttaagtgaacttgatttggagttgattttatgttctttttgtcgtagtttcttttttatattggcttttaataattaaacaactaagggcatagatataaaagtttacctataaattattcttttactaataagccgtttttaggccaaacaatgggacactttagtcacttattatcttgattcttgaattgctagcttaaatagtcacttatcctgaattgcttaaatatggaaaacagagagacttggccaaaaaaaaaaacagtgtgctatgcttaatttggactatatacatttgcacccagctctctatatgtacaagatgatgtgaaggacctaaaatctgaagtaaatatttattgcatgctgatcttctctacacaaaatttggttgggtccattatattggcaggtggtcatgcacgggatgggccggagacgttgcaatacaatagaatgcatgctagagactaaggctcctgcagcatccaattaattccggctggccacgtacatcaattgatcaatatcagatttattgatgaatggtcaaccaccttgcgtgcatgcgtcataattccggccctagcttgtattgtgaaatactatcaatatccctatgtgtccattattcccttcatacttataaagaaagttgtttaggacagcgacatagtctccaaaacacaactttaacttcttatttctataaaaatatttattgaaaagtgatatatgtatacttttataaaagtatttttcaagacaaatctatacatataatttttacattttcaaactcaacaacttaagagttattcataatttatattctcaaggtttgacttaaacattgtcctaaacgacttcctttatgagtatgaagagagtattttctttgtgtggagatagtggcattgttaatctagtactctctccgtcccaaaataaaataatctaatattgaataagacataaatctagacagaaagactaattagatttatagtactaagatgtgtcatattcagtaagtactatgttagtatattattataggacgaagatagtaataagtgatgagcggatattggacagtggtactggtggtaagtttgccaacaccctcactacaaactccatatgttttttttaaagaaaaacattgacattgtgagatcagagagttagcaacatgtgtcaacgatttccaccatcaactctctatttctatgaaaagaaaaaagaacactacgagagccaaagggttcacatatctctcggatttgctattttaacttccaacaaaaactttgggagaatatttgttaaatttctgatcgttagatgggcttgaagatgcgtgctagcagggatggggtaaatagtcaacgtggatgcagcacatggaacccttgcgcacgccaatccactaacctatgaccccttttgtgaattgtgatgtacacaccactgcttacatcttacttacattacatattagttgtagtatattgtaattgtactaccgttatattcgacaaatttttagaggcattttctgttgaatgttaaggagggtggcggtgaatctttaacaaatactcctttagaaaggagtagggtggtggtgaatctgttataacaccctcaccactaactctatttttttgaaaagaaaaaactaaattgtgaggcccatatgtcaatcaccccccactacatacctacttttctacttttgtgagaagaaaaaaatgataatatggggctaaagggtccacatctcaataataaatatatttacaaattaaaagatgacatgtacaatgatatttttttcaattaaaatcctatggcaacgaaccgacaatatgctactagttacaagtcacttatcttggacacgtgttattctgagattattagattacatagtgtttgtaagccttattggaccctctatgtcaagtcaaggtttcgtctaataagaaaaaaacagaaacagagtatgttcactttgtttacatttttaagcctaccaatatttgacattatcaattttcgatatgttttggtgttaccaatagagcttttaagagtggaagctttcgacttctacaaaatttggtatgatagtagtgacaagaatatgtttattttgttgtcttatcaaaatttagtaatactcaaatttggtagggttaaaaacgatgacaaagtgatcaaacacgcaatgactacctgtagttgcaaagtggggaatcgaaatgtagtttttttttaaaaaagaaaatgccaa

SEQ ID NO: 37606 - DNA, 1319 bp, Oryza sativa
acatggcactgatgtgggcgcttatatggcaatttgatccggaaaaataataaaccccgtgggacccatatgtcattttcacacaaattaataaaagaatggcgggcccacgtgggccccacatgtcagtctaactcacccccctcctcttctgcttcctctctccccatctcccctctttttctctctcttgcgacgacggcggcggcggaaatggagaagagtggccgccggccatctcgctcttgcacacgctcgccggtagagtagggagctcgcctagctccttcccaccggtcgtcgcccttgtccccgatggccgccgtctgccgcccttctccccgatgaccgccggcgggagaggagggagcggcgccaccaatttcaccagcgccccacagcgacggcttgccggcgccgctcgccgcggtgacgacgatgaccgtggatgtggcggcgccagcgctggcctcgacgtcctctgctggccggcgtcatcgtcgatgacgacgacgactcgtcggaggacgacgcgccgtcgacatacattccgatggcggccttcctgacctcgagcacgaacagcagcagcgtgaaccagacgatggcctggaagacagagagctggacaactgttagcattatttttgtgtggcagttagcttcgtgcatgcggctagctagtggctgccgaattaattggatcgcgcgcgtgctgcgtgcgcgtacgatgcgggcgaagtttgtttgcttagtggtgtgtctgttgggctataaaagtcatgtattctcatgagttaagtgccaagtgaatgagaaaaaactagataaggtgttcgttgtcgagaaattcttctgtgtttgtccacaaagattttcgctccagctagttgaagtgtgcgtgttgctgtaatccttggccagagctgacaacgacgagctgctgtgcccactcgccgtacatggcgcgcgccatgggcacgccgacgatgagcgagttggtcagcgtggacagcgagaagctggtgatggaccagcgacggcgcagccgcctttgctcattgtagcgcccgttctgtcgtggcgcctagtggaaaaattatctcttaaaaaccctaattgcgaaatttatttccttgcttgtggtctagtgtccgtgccatctcaagatctcaatccccgatctatcgtcgagttcaattccgaatccaaatccatccaaatcaaatttctccgcaaaagtctattttgcctcccccgaggtcgatgggccgaatctcgctcggcccatctcccccgggggtggcccgacgggctcc

SEQ ID NO: 37607 - DNA, 684 bp, Oryza sativa
ccttccagtgctgttgctcaagtgtcctggttttctttgcctcggtccagtagtttgggcatcattacttttactcaatgttgcatccctattcgactcatctcccaagaagactctcaatccagaatcagcacccagtttagatgccaaaacagttgctgcagcagcttttgcagcaggatcaagatcatatctctgcatgaccaaaacgaagtttcagcaatagttagaagatgtaaacctttcaaaggggaagagtaaaaaaatagcacacttgggtggccataacatagagcaagtaggcaacaagcccacctgtataagttgttgagtagtgtagtaattcgttctctccttcaactcatcaatcttagcctgtctttcagcacggaggttttcaagagtatgttgatctctgttgtcaactgcaagatagaatcagtattgcagtttaggcataaaggatagggtgtattaattggagcagtttactagacgtaactcggttgttccacaaaaccattcggcaaatgacaaaaaaataaagtgtggaagtaacatggtcaactcaaaaacatctggagaatctggcaggaaacatggcagtctcatagtttttttttgtctccctgacttctagggataggaaaaatagctactccctttgtcccataatataaggga

SEQ ID NO: 37608 - DNA, 3828 bp, Oryza sativa
gttgagtaaatgagagcagctaaagcaggaatcaggaacatgggcagcacccgggttgctctcatgtgccagctgaggtccggtgatcttgtagtcataatcgcatatccaacagccgcaatctgttccaaaaaggagaaataagcatttccttacacatacaaccctgtgaaaaaacacagttcgccctgatctaatctaacaacaggcatatgcctaatggtgtcactagaactagagcaatgcaatgcatcatacaatctctgacacgacatgaaaattgcagaataatacggcataatttatcttagcaggctgtatgtcatgataatcgatgcctaattagcttcccaaagctgtatcacatcaggattttcatatggaactggattttatcaatcctcgattttatcgacccaacctacaagcgatcgattcgtctggacgaacatgacatttatatttgctacaataaaggaagcagagcggaatgggattagccggatggggaacggcgggggagttgggaactagggatacctcgagcgcggcggcgatggcgaggacgttgtgggcggactggcgggaggcgcgggcgcggcggcggaggcgggagcgcacggcctcctcctccttggagagcgcctggagcagcttctcgacgtcctcgcgccgcccgaatatccccttccacacccgcgacacgagcccgcgctgcctcctcttctgcgtcgacggcgtctccggcggcgcgggggtccgcggcgacgccgcggaggccgcggccgaggcggcgtaggcgtcgccttctgccatggcagctcccgcgatcgggggcaggggaatccgatcggatcggagaagaagaaaacgctaagctgccctgcggatttcgtacgtgtttcttcgtggcgaattttcggaaacaaggaaggaaggatcgcttcgtgccgcgtttttggggaggaaaggcgagcggaaaggcgtcgtggtgaggtggtcggcgggcgtgcggacgtgttgcctttgcctctctctctccccccgtttttattctctttctcctcaccatctgcaaatgcaaatgttacgcgttcgtgtgtgttaccctatggctccacgacgacctggcccccggcagcctagttttgaattgcaatgggcggccagctcgtcggagttgacggccgcggtgccgcctacgacgttcgaatacggtgatggcgcctgaatttgcttactgcaaaagggttagcttagcttgtaagcaaaaatgttagcttggcttggaaccattcaacatgagagcagtttagggtgtgttattttcggatcaggatcctctgcaatcaactgcatcacgcctttgtgagatatagatcagatctggacccacatgtcatgcagcggatcttaatcctcccctcctctttaccgacttctatggttctaaagataaaacaatatagccctcatatgtattctatggagtacataccccgttagagagttgacataatacattagaaaacaacacaatagatttttcgacatttacaacaaatttctataagttgctttaaagtttaaaattttatattaatactttatcaagtttttgctaataattaattagtcatatgctaatccaccacttcattgcgttaaggattagttcctaacccacaataacaaaacacagcacaacttaatttcctcagcttgaggagcaatttccatccagcattcagtcgaaagtaaaccggattaccggaatcatcagctacagttgcttctattgcgatagaggtactagttcgctcgtcatggaatgaaagctacagaaactaataaacccaaaaaaaaaaagacttgtggcattcaatttacattttacaacaccattagatggccatgaactgcactcatccaacttatagttctcgctatctatgaggctaagatacagctatgagaaagatgggaacaacaggcacaacatagcacacaacatatgtgccaaccgcatatgcctccattatgtacctgaggattctactactagattggtgtcacagaatcacatgacaccttcaaagcttgaaacacgtgctgctgtagtcgccacgtttagatacgaacccccattatgctctggtttcatgagaagaactgctcaaggcttggagagttaaatacattacccgcaagttgtcctccttctattgaggaaacaaagagttggcaccgaatgaaccgctggtagcaaagaaacgaagataaacatgtagaacatgactatcagaaggcacctggtccaagaaaaaagaaatgaagatgcaagagtacatacagatagttgggaaattatatcgaggcttgtgtcaatgtgaaaatctgcctctaactgtcgaacaaatgaagttcgcccaacttcagagctgcagaagagtacctgcaatacccacctttttcactcaattatagatgtaggtgacagaagtaaataaattatttaacacctagatatttcagggttctgaatatacaggagaaatacttcttttctcagccagaacttggactgaaactcagctgggtatgcagaactgatatgagtgccagacaaagtcagctccatatgcagaactgatatgcaagcgccaatagcatttccatgcacatgtatcaattagtatcagttgcctctaccaaaagttcaatcatgtgaaacgtttactgtaactgctaacatctgtatcctcctatgaatttggtgaaaacaggccattcatgttctaccatccataaataaaatgagaataattactcaatgcagcattgaaatgacgtggggaatggagggaacatgagaggaacaaaaaaacaaacgcagtacaataactaaaagtaacgcaaacatttcaccttttctttcatcaagccaccagtcttgaaaagtccagcactctccagggccaatagagcattctcctactcaaaatcaaattccagaactattaatacggtatatatcaatatttccctcgataattctcataaaaaatctcacatgataaaactgcaaagaaatgaaaggatgcactatgaaattcatacctcactcttatcatcaagtacagtttccatcagatacaaatcacagtatttggctatttcgagtagtagttccaccactgaaggtctaacagtggcatgtgtctgcatcaagaagagtgcagatgattttagcatttcagcaattattggaggggcacataaccattggaagaggcattgctaaacaaacctgaagctcctgaggagttatctcctcaaagacaacaccaagcagttggcaagtcacctggataaaaaaaaaattatgaacttctgcaaattttaagaaaccaaatatgtatttcatttatttcaagtctgccagtatttatgattacaatttacagtgtcaagttaaatcactaaagcatttgctctttgtaactaagagtattatgtcagatcactatagccagaaagcacctaacagtttgatcttcgctctctagtggtaaacttatatcacaataaaattgtcctcattttttaattccttataccatttgctatggtcatcctcaaacaaagagaaactgacttgtttaggagtatatgtaagcctacaggcttaaatttcaaataaggtctgctctagatccttaaaatcaatcatggaaacacaggataaaattatgtttagggaattatttggtacagacaaagcatttaaaaaaacaaaataacccatcaaatcaccattcttcgtag

SEQ ID NO: 37609 - DNA, 46992 bp, Oryza sativa
cgatgtttaccttgtggtggaagaggaggccgacgaggtcggtgaggcggcggttgagggcgcgggagacgcggcgcaccagcgagacggtgtcctggtcggcggcgaggcccggcattgcgcggggtgggggtggggtgccgtacggcttggcttgacttgcttctgccgcgtggttgggcgaggtgggggaggtggtcgtcgggggggtgggtgaggaggtggtggaggattggggaatcgccggattgggaggtggagacgaggggaggaggaggaggaggagaccgcgaaattgcgggggcgacgagaggaagcgaggcggggcgtgatgagactgatgtgcttatcttcttggcacaggaagccacgaaaggactaatccaagaatttcttttttgtttatttggccttggccgtatttagatccaaacttcagtcctttttcatcatatcaacatatcatgcacacacaactttttagtcacatcatctctaattttaactaaaatccaaactttacgctgaactaaacacagcctagatccaaagtttttcttcaaactttcaactttttcatcacatcaaaactttcctacacacataaacttccaactttccatcacatcgttccaattccatttttgatatgaactaaacacactcgttccatgatgtttctttaataaatgttactttaaaagaaactattttcttcgttaatattatagcatcctatactacgtgtctacgtagaacacatcatactacaatctgaacggccgagtattagtttttttatattttgtgtcgggatagtattatttttttttctttggaaattcagaataaataaatacggtattgttttcatgatcaataagtgccgattcagatttttttttagtttgataaatattagctgtgtgctctgaagttgcatcaatgatgtagactttccggtttaactctgccctcttttagttgctggccaaaaacaaatctacattttagtgctcgtcagatcgaaactacgacgtatttgctgtacaaaaccagcttcagctgctttgaataaagtaagctgattgcttgacaatacctccaactcaagtgtggagttagcgtagaccacctggtagagtgtatgcaaataacatgaccattacaagctaagcacccaggctgaactgaaccaaccaacgaattgacctgtttttcattttaaaccagagctaccgatgggtttctgaacctgaatactcgctatgggtgactgaaatgagtgaaaacaaaacaatttatatttgttcatcagaaaagaaaatcattcccaaacaaaaaaaatccaactagaagaatgaaaacagtaacgtactacattaactgcgtaggcatatccgtcgaaacatgaaagtgaaactcagattgtaatacaatttcatttttttagataatgtgtaatcaattttctatttcacaaacatgataaacatccgattttaaactcaccaatcagtagaggactagaggaactgaactgaaacctttattaataccataccagcaggctcaatagtgtgactaataaacaagatgaacaagaacgtcttcagttttgcagtctctaaaatgaaactgggtcaagcatgtacgacagaacgatattgttgttagcagaggttactgctagttgcatcagtatagcacattcctctctgatcgtttgttcaattatttgataagataagccctaagaaaattaaccaaagcaaccaaatttaatatataagtaacatttttatatttgatttattaaagaactaaaagacacgtccaagtctagaaaccataggtttattttaaggatgaaataaatagtgctgaaaaataagctatgataaaaacaatcatcataatttatttaaaattgaattccgttgagcgagcaattgttgggaggcttgaaccatggtttaccaaaccattaagggtggtatatcatgattttaaaaactaaaatgtttaccacacgtgacaaccacgataaccctgtggttttgtaaatactgctcagccattagcaaagcgttcaagagggagagaggagcgtacactggttcgttgcatgcgagcgtgatcacgaatgccaccggactggtcgcgcctcggactggaggaggcgctcgccgcggcggcgctgctgctccgatcgtgctcccctcgccgcgctgtcctccgccgcgcgcgcgcggtccacgcgctcctcgtggtctcctccacgccctcgtcgcccgcgctgaccaccttcctcgccaaccagctgctctccctctacgcccgcctctccgccgtccccgacgccctcgcgctcctccgctccacgccgcgcccctccgtcgtctcctacaacaccgtcctctccgcgctctcccgcgccccgcgccacgcgcccgagggtctccgcctcttccgccgcctgcacgcgtcgggcctccgccccaccgcacctagcctctgcgccctcctgcgcaccgccggcgaactgcgcgaccgtcgcgcgggggccgccgcgcactcgcaggccgcgacgctcggcttcctcgcgagcgacatcgtgcccactgcgctgctgcagatgtactcccagtgcggcgcgccgagggacgccaaccaggtgttcgacgaaatggcgacgcgggatggggtggcgtggaactgcgtgatgcactgcaatgtgcggtatggctaccttgaccgcgctctaggtcagttttgccggatggtgaggggtggattgccacccaccgagagcacgctctcgtcagtgctgagtggttgtggacgagctggggattgcctccgagggcgtgtgctccatggatgggtggtgaagttggaggagcttgatcctgacatgccactacagaacgcgctgctcgacatgtactcaagctgtggtgatctggatactgcactgcgcgtgtttgagagaattgagacgccggacttggtgtcatggaatactctgattgctgggttttctggagttggggatgggtgcagcgctgtgcatgcctttgtgcagctgaaggctgtacagttcgatgaacgagttgtccctgatgagtacacgcttgcagctgtggtgtctgcttctgctactttgcctgcaatgtttggtgggaagccgcttcatgccgaagtgatcaaagctggactggagaacagcgtgtttgtagggaacacactgctcaacatgtattttacaaacgatgatccccattctgcacggattttgtttgattccattacccaggaggatgtaatcatgtggactgagatggttgcaggccactcctcattgggtgagggagaattggccttaaggtactttgttagcatgcttcaggaaggttacaaggtcgacagcttctctttgagcagtgctttaaactccacgaccgagcttgcaggccttaaacaaggagagatgctccatgctcaagtggtaaaaagtggttatgaaggcaatatttgtgcctccggaagcctagttgacatgtatgcaaaaaatggtgctctcccaggggcttatttggtgtttcgtaacatacaaagaccagatttgaagtgctggaattctataattggaggatacggtaaccatgggaattctgaaatggcatttaagttatttggtgagatgattcgggatgggctgcaacctgaccatgtaacttacatctccatcctctctgcatgtagccactgcggactagttgagaaaggaaaattctattggttctgtatgatgactgatggtattgtgcctgggttcaagcactacactagcatggtcagtttgttgggtagggcaggtttgttggatgaagcagttgatttaatgatgaaatcccctttcgccaagaaatgccctgaactatggagaattctgctaagctcctgtataacatttagaaatttatccattggtgttcatgctgctgaacaggcgctagagcaggacccagatgatatttcaacacacatattgctttcaaacctttacgcctctttaggtaaatgggactttgttgctgaaattaggaaaagaatgagagggctaatggctgataaggagcctgggctgagctgggtcgagatgaaaaatgtggttcatgtcttctctgcagacgatgaatgccactctcatatagatgattgccacagcgaattgcttagacttaaaggaaacatggaattattggatacttgtgaaaatgagttcatgtcaagtggctaagttgcatgaacagattagaggatttcatttgcttcctttggtcctatgacttatggcaacaaaatagacttatacaagattttgagcataagaaaggtattatctgtgaagggacaacctatcgatttaatggttccaactttcaaattagcgctcccggcagcattggaggcaggaaagagacactaaaggtatcaagctccatcaaacaagatatagatgtgcaaataacccaaaaaagggacagaattctgggtcagtgctctagtgtctttctccgttacatcaatgcaactgcttgctccttttttgtgtatatatgtgatcagcagcagcatttcttgctatggatatgttttgagtaaatttcagaaaaccctctgttttatggtcacagttacagaaaaccacaggtattatgacatgcggcacctaaccatataggtataacagttctaaagtttgacaaaaccctacccttatgcattttgagcacagattacttacaattctaaatcatagtgtgtacatgaaaattttaatttttaagttcttgactaaggttgataattaaaatttttactaattcaaaagaattgttcaagatatgcaaaattaggcctagttctatttttcaacttcaaacttcaactttctcgttttccgttagcacgcttttcaaaccgttaaatggtgcgttttttaaaaaagtttttatacataagttgtttaaaaaagcaaataaattcatttttgaaatttataatacttaatacttaattaatcatgtgctaatgagatttctcgttttgcgtcaaaaatctatctgccaaacggatgatcaaacggggccttaatcaagatttcaataaatgtggggttttatgaaatatttagaccataatacatgtggttgtgtgccacacatcataatatatgtggtttctgcaactttgatcataaaatgtgagattttctgagttagctaaatttccatgttgcccttttaatggtctcaataattttgttgttgcttgttgagtactatctgatattgtttctgacaagagcttcctcagtatatgggttacacatttttcagtcttgatatttgcttctatgggacattatgtcaaagttatctcggtaaatgttcagttttaactaacggcataaggaccccggacttcagagcaacctgtctcaatcaagccgttcataccatgcaaggtgcctgaaatctgaatcaatacttcctttgttggtgaagcatagcactttagagtttgatttattaattcattttcttttgtttcagaactttagacagctgatactccatcaatctgaagtttgaatatctcaagtttctctgattcggcaatcatccagatccatcattaatctcttaatatgcatagttaacttcgtctgctgctcatttttcaccatcaaattcctagccagtgcttcgtaaagatagtaagatggacagtgaagttcagggcatattgcttcttattaaaagcttgttttagtgtgatatggcaaatgaactaccctgaattctggtttcatgaatagattttacacaattatttttcttctagcctgcatatagtagttgtagcttcattaggcggttaaaagaaattttagaagcttgaactctgggtccttcacgtttatgatttgttcagatttagttattgcagtatatctctttttaaacttcgttagctaacgcctgtctaaattgcactgttcagtgtaccagttcagggttctgccgaaatcattctagggccgtgtttagttccaaaataattcttcaaacttcaacttttccatcatatcaaaactttcctacacacaaacttccaacttttctatcacatcattctaatttcaaccaaattttcaattttgatgtgaactaaacacatgcaagtcttacagtagcttctgggtgtattatagaaaactgtattgtttgatactagcacaatagctcaagtaaagtaacggctgtgcgaaagtgcgaaaccaaaaatccagtccacgctgcaaaacaggtcaatgccacctactagtacttatttttcccatgcaaccaccgtgattcaagaataggcagacaacccacgctgcgaccggcaaggttgtactagaatttaggctactcaacattcatcatgactactcgccgttgtttgtgcggtgccctgcaggaaatgagcctcctttcccatttctgcctctgcctccagcggaaggcgggaagctgctgccgttgcatccgcttcttacatgtgttcgtcttcgtgctccacatccatggcggccactcccagatgtgcgaccccgccgacctggcgtcgcttctggccttctccgatggcttggacaggatgggcgccgggctggtcggatggggtcccaacgacacctcctgctgctcgtggacgggcatttcatgcgatctcgggagggtggtggagctggatctctccaaccggagcctctcccggaactcttttcggggcgtggcggtggcgcagctcggccgcctgccgtgcctgcggcgcctcgacctcagcacgaacggcctcgttggcgcgttcccggcgagcggcttcccggcgatcgaggtggtgaacgtctcctccaacggattcaccgggccgcaccccgcgttccccggtgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaggacttgtacacgattccagagttgaggtggctaagcttacaggaaaatcagctctctggcagcctcgataaggccctcggtaacctctccaagcttaccctgattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacacgctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttcccccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggtcaatattgccatcctttggccgtctagtgaagcttcatgtgctggacttgggctttaacaatttttctgggccaattcctgatgagttatcaaatatgtcgagcttggaagtactggatttagctcacaatgatctcagtgggagcataccatcatctctaacgaagctgaactttctgtccaagtttgatgtttcgtacaacaatttgtctggagatgtcccggcaggaggccaattctccacgttcacagaagaggagttcgcgggcaatcctgcgctgtgtcgtagtcagagccagtcatgctacaagcgggcggtcacgactgaaatgagttctgagacacgttttacttttgggctttttttgaccgtggaagctggatttgcctttggactgttaaccgtctggaacgtactgttctttgcaagttcttggagggccgcgtattttcagatggttgataatttctttgataggttttatgtgataacaatggtgaacttgaacagactcagaaggaaatgggaacataaagatcatccttaaaacaaagtcagacggggttctccactagttctaactaggctcttcaatcgaattatgtactctgtatattgtatttctccagcttttggtgtcttgattgttttcaactcaggtgtcatttagcagtgctgctttcacatcgtattgtagacatgatttccatttggtacagatgtgccagtgttgatagctgcgtggtggatacttaagcttcaagttgttctctctctctgtaataactgtagctgaacaaagccgttttgttaatagagatgggagagctcttcttctcttttatatgactagtataatgtcggtgcgctgtaacggaattgaaattatgatgttcagttttttttgtctatgcgttttgtaggttcattttcatgttgaaatactggttttttggtggggtggtctactactctactcttggggatgctcttttagtaggaggacgacgactccgttggctctccgcaggcttgggccgtaaccttcaggcctcgttttgggcagttcttttctcggcctatctacgcctatgggccaatgagggccctattcaaacgaagtctgaaatggcctaataattctttgcttggttgggctgggacctggggagtctaggagtggactacttgaagccaggtgagtgaacggtaagcccgtgagaacgaaacacatgctcaagtatggttgcagctctggacggagaaggcacatgcgaatgcgattatacaggagtcaaaacctcatcaacttgcaggattattctgtccaatctttatttaatcatcacgacaggccagctgtagattagtgctgctaagtgctaactaaccgatcagcttgtactctagctcagcttcacatgaaaatatacacagactgcatgcaaatcaggcgaggtacgcacgcgacagataaacaatcagagaaacacatgcatataaatagccgcaagttgggacttcggctgcaacaatccaacgcagctgtttttatactagtatttctgtgtgccatcacagtagacaacaacctttgctttctgctccgccgaatttttccagttcacatgaacatactacttcgactgcagcagcatcgatacactgcacaagaaatttcctgcgtctataagcggtgcatgcatgatcagaaattcagaattcagagatgcagagaagaccaaaatggagcaggcccgtgagtgggagactggagagtacgagtaatgggcgtagctcaatcagccggaaatttaggttaggtcccactataatgaaccgactcattgagacaaaaacagaataatagaatggattattatactagtacagaacaattattcacatcggaagcaattatgcaatgcattttgtgatcttaagttcttaagttatgttgatttcggcgatttcagtgacccatctcacagctgagacagtgagcagcaaggtgattactgtagataacaggcagcttcatatctcgatcggttggctggctggttggctccagatcgacggcgatctcattaaagaaagtaatggtcacgcgttgctccaaactccatggctggcacgtacaggtgcacgaaaactgcaaacacacctacctgctacagtacgtacgcggtggacacacaagtgcagtacagacgatcgacgtgagctgagctctcccaagtccccaactataatcttttttataccgacaaattaaagcgtcggattagcggcgagtttgaacgtggtagccgcatgtagtagtagaatccaggcaaggacaacgccatctgatgggaggacccggaggagttggtgacgcgcacgcggctggagtcggacagccggagccggtggccattttttgctcggttggcgccgcgagcgcgcaaggcggatgcgtatgcgcggcgcgcgggaggagacgggacgggatgtggtggtaggggtaggtggatgaggtcggttggtggggcgcagacggctcggccatctcgtgcccgtggaagactgcagtgtgcaaccagtagggggtcgatagctacttaggccatccctaacctagaaaccatctgttagatttcatacttgtagaaactatctatcaaatggatggtgtcttcaaattaaattctcatccaatcatctatattctctctccttttatgcatctatcatcttgtttttattcttggttcctgtgtatagatgttttcttgtatgagaaatggtttcttcatctttttacatctctcctcattaactcttttgccacatcacatttttgcttatgtggcaatgtattaaatgctatggacactagatgatatagagggttggggatagccttaaccggaggcgactacgatccgaacatccgacaaaagacaaaacatcggacgacgtttttaccatctgtaatgtaaagaaatgttgttttattgttaggcaaaacatgttttgacaaaaaaaatgttaatatattgtatcacccagtcgaaaacatttcatcgttccataaaaaaatgtttcaatcaaatgcaacactaaaaaacaatgacgttaacacaaaaaatcaaataatgtaacgtctaaggaaaaatgactgctccattaagaactcatcgtaccatttacagaacaaaagagactgtgtttgtaatattgtaaacattatgtgtaacatcgaagaccatggtgtgatgtgcaacatcctcgcatatctagttgctcccatcggcctcacctttatctacatcagtgtcgctttttcaccttcttcttggtgacggtgagggacatgttagctataagaagtctcctacgcgaaaccatctctactgccttcctttgtctctccatggtagcctcattagggaaaatgagggatggtagaggatatagagggctagaaaagtagaaggatagagaggagccttgggaggagggggcgatagcggtggcttgatgacgaggggaaagcagatgttgactagacataagcttcattgcagtaagaatgagttcatcatggaggagagttagtgaaatatatggatgagtaatttacagatttttttactctcgtattggacgaccggttcgaagcatttttcgtaactaaccttattaatactcaactcatttgaacttattttcctaattgttgagttgtgatccaaattcatttgcacttaataaaggccagcttctgccgtagtggagcggaggtccgtcgccgggaggcccttttagggttccaccatatatatacctcttgtaaaccaccgtgcggcgttgtaaccttacctcagatataatgaagatattttgctggctggtgcccgtggttttttctctcctgttttgggagggttttctacgttaaatctcgtgtctttgatgattgatctattgttttttatcgtttgttcgcctatcgttttctaacactaataagccaacttggctcggctcgtgagcttgatcgataacaaagctatatttcattcactaaccaccaaagaattcaataaatacatataatttgaatataattaaatatcacatgctacctatatatacgatgatcttttgtactaaggctgactgacttgggaagctcaccaactaaaacctcagtatacataactcgactcgagtccgagttgaaatgagccaagtttgatgcgagcctttgtttttctcccccacaccctactgtgcaatgcaagtgcaaccgacgatcgctgtagttgtacgtgccagagggatctaaagcaaagatccatgcatgatacacgtacgacatggccgcttttctcgcgcacctttaccgtgcacccccagcaaacaccggtcacatccattccatgattctagcgctttagattgaatagaggtcaatggggtcatcctaacgtactccctccctcccaaaaagagacaaacactaatttatttgcccaacgtttgaccgttcgtcttatttgaaaaaaatatgaaaaaaattaaaaaaacaagtcacgcataaaatattaattatattttatcatctaacaacaatgaaaatacgaattataaactcagggtttgactttttttttgggacggatggagtagtatgaactgtcaaatccatgatcccccgttgttgggtaattccactgtagcctgtgacccggaccgacgcaaatttactccacaacaacggaggcgaccgagcgcgacgcggccgtgagccgtgacgagcttgttcccccacacggccacggctgccgctccccgtgacgacaacgagtgtagcggccgcgagagcgagagcgagaccgtggcgcggccgcgtcgtggcgctctcggcttgcagacgagacgacgtggggcgcgcagcgcaggtggtggacggacgcagccgcggaccatggactacgctgccgcggccacagcccacaggagaaagccgagcgctcctcgtctgaccgttcgtcaccgtctcggttaccgcgcacgcttggccccacctgtcaggcacacaccagttaccgatggctggacgctgtccatggcagtatgtaccaccggccgaggcaactggggtttctggctctgtggaccaggttcacgcctcttttggcttcaactgtggtgaggtacaggacaggtgggtcccggatcccccaaagcgcaacgacgcctcgtgaactaaacccacggaaaccaaaccagattaccagaaccgcttcttcttcttttgcttcctccggtatcattccagttttgctacctcctcacttcactcctctcatctcatcacatctcatctcaatcttttgcgccattccatcggagctagcacccagcaactcacgagcaagcaaatcaggtaataaagcagcatcctcattctctctctctctctctctcttgtgctttgttgtttgattgcatcttcttttgggggcggagaatcatacgcattccacgggccctttgattccagggctcggatccggctgttgtgcatggccaagctgggggcttgtgttcgtcgtgtgtgattgggctgcttgggttgtttgctgcaaaatctgtcactcgttttgtttgggttcttggcaatgtagctgctggttttctatgactggtctcaagttccgagtttaatgcaatgcgggagggatttgtgaaattacagcaatttcttaagctttttttccttcttggtaggcggtacatgccgtggttaacattcttgttagctgcaggctgcggctgatcggtgaggcgagcactaagagtatttttgacgtgtttaccggaatgtatttccgctattgctccgaaatggttggggttttcagtgttatctgtgagaaaagattagtcttttcttttatattttctaaaaaaaaggatcagtattttattgctcgcgtgaactgcatttgcatcagttctgctttttatttaaaaaatcgttgttagtcctgctctgccaaactaaagttttagttgctttgtacagagtattggtccaaattgcattgagcattttcagcacaaattgatactgataaactgctgcgacctacttctgcaggtttagatagcaaggaggccgcagagaagtggagaggactcacgaatcacgatccatttctatcttgagggaattggggatagcaaaagtcagtgaaaaggtactttttagttctgacccatttcttacatcgtcacttttattaagtgtgtgcttcagattcctagtggtaggaatgacccaacaaagaccatttccaactaggttatgcactgctttagttttagcattatgtgtggtgtagcttgagagcatgtgggccaattgggatgcatttgctgttgttaattttacctatccgtttgtcttatctgctttgcaacattgcatacatatggggatcttgcacggttggaaaagacttcacaatcttggcacggccctctcagatcctacttattggctgcaatattcgtatgaaatgctagcttgatgcttgttcttgtgtttcttactcctacctatctgttttttcccctttagtttgcatcagttagtcagtttcattcatttcatttgtcatttgcttgttttcctgtctgtagttggcgtgttgcacgtttcacattcgctgtggggtaagcttttcttatggaagaaggtttactgcaggttagtagcgctattgtatctgtgcatttttctttttggaagtatggctactttacttaatcgtattgcttagacattgaaaggttggattagcttgaggagattgtataagaaactaatgatagtgcgatactgaattgtgcgtgtactgcatcatgattgctgcagtaagataggtgcagcctttataattagttggtttggtctcaaagcttacaaatgaaagcttgtaagaaatcattatgttccgtacaattgttctggtgctttaataatgttgttttgttgtgctttgccaaatgatggtttgcttaccgttactaatagagagtatggagacgtcctactagtggttggtaaagcatgttagcacacttttccatttggtgctgtataagatgatagtacaataatataatcatattggcagatggggcatgttattagtactttgagatcttatggctactaaacgtgattttgcacatggcattgaagtgagagatttcttgcagggccagatgacaagcatggacaaggcagcaaatgtggtattggatattgaagggctgcctcagcaacctgataaatgctgcactggaagtccaaaaatgactgtatgttcaatgactcacataagaccaaaaagaaaaggatagtggttatctcactctcccacccttccattttttatgtgcagagagccctatctcgcaagggctcaaatcgcatggaaaggaggagcggtgaagagcaggaacaagatgacttggtgaagaaacttattattaagggtaacaagctactgttcttctctgaattctttttttcttaaaaaagttgtagtctctgtaattctaaatttttcattttgcatacttaaaaccaaacagcttatattttgtttggatcaactcaaaccataatctttgtgaagttccatttgatcttagccatcatcacattgtgtccgtgagctgtatgtagatgagaaaaaggtcaaaagcggctagctttcttttgtgtgattgcttgtatttccatccagcggattttttctatcatgttcctacgatatgtggcctgcagatcgaggagccttgtttctccaattccaactttacatttagctaaataagtattggcttggtattctcggactttagtagcttgtacttctgtttacatccaagcctaataatcttaattttagcatcatttttataagtaaggatatttgttttccttttttattgtactacactcatctggtatgccacagcatcaacactgacagctgtttttttttttgcccttttgttggatatttatctccacagttgtgccatctcagttggagcagcttagatgcccctggtgcagaacaaagccttggtcactccacaatcacaatgtgctgcctgtgcacctattctaactgactctggggaaggaaggaacaagaagtttaatcgacttacttcggttcacccccggaaatcctactgttctttgcaactctgtaagtcacttgcctttctgaaattgtaatatgtctatgctgttgaagcaactggtctgagacactgagtttggtttccaattggtaccatgccccccacaagtggtccatgttctggtgtgtgcttctctgtactgttcaactgcacttgaatagtgtggcgtggttttcttgtcagtcattatcatagtaatctgctacacaatttcctgaacatactgtactctatcccttgcttgcccatttgtctaggtttgaggccctagtcagtatgcacgttcacacattaactgtattgcatgctccaagagattatttgtgtattcatagcagaaacactgattgatggtacgcatttatgccattgatggtacaaatatcatttgcttgtgtttttagctgcttgttttctaagccacatcttccttctcttttacaaacctattatacccattttgatttctcttccttgtttctcgtcgcaggtcgagcgtgggcacaatgatactgatatacttcacgctcgcaatcaacggtggcaaagcggaggcgtagtcgtcaccggagcgaaacacgacaacggtttcagaagtgcatttcatagctggaattttcgcttctcgttatcagattttggtttgtttgggaggagagaactggaggaggaagcaacagtagcagcagcaatgatgcagccaggctctcatgcctgacacacaatgctgggagtgttgctcgatcagtgctccattgtcacctttgcctgacctgatctccctgaattcttttgatctgtacatgtaaattgctgtgaggcctttgttgagaggtagagagagagagaaagagagatccatggattgttgttggtgtaaatgagctggggcgaagctatccatttctgccatgcgagtcccagcttagctgtaaaagatctgaagcgaataattatgcctttgtggagttgcagtgcatctggggttcggttcttgaatgctcgttttctgctagtggcactggcaccgccaacgactcccatttacgatatgcgcgcaggctctgcattttctctgcactctgcattacacacgtgctatttgtcagtcagctatagcataaacctgtggaatactctgtatattgcaaattcaaggtaattagtttacatttatatttgcgtagtttcagccagatactgttttttttttctcctctgaactacccctccgtttcaggatataagactttctagcattgtccacatccatatatatatatatatatatatatatatatatatatatatatatatatatatatatatatatatatatattaatgaatctagacatacatgtgtgcctgaattcattaacatctatatgaatatgggcaatgctagaaagtcttataatatgaaagagaaagtagtatataattttgttcattcaataggatgcatcaaacacattttaggttggtttcgtgaactgagcggctcagacggaattgaaagttttagagttggcataggaaattgtattttttttcctgggatttttaatgtggatgcgctcagcatggtttgataaacaaggactacaatgttttatagtaactctaaaattaagttttaaaatttaaattctggctgcagctcataagctcaagagcgaactatggagctttgggattagggagttggcacagcctatttttcactttcatttgtcatttgctcgttttcactgctttcatgcaccattcttcccttggttttcaggattagcatgaacttattttatgttactagccaaacaatacctatgagttacaacaggttattcaaaatagctaaaataatatttcattcttattggaaaaaaaatattagcttctacttgagaaacaagattcttcatcttaaaaaataaaaagaaaatcaatggctccatctgctttaacaaaatgcccttttcatacttcttaccgtaaaaaatcgtcggtggtgtttccttttcacaaaccgaaatcgcaatgtaggccgaaattatctcgaggccgaggcccaacaaaagtttgtgtccgtggccgtggccgtggcctgcttcatccgggcggcgtgcggcgcgtgcagttgcgggcctcgcgagcgagcgagcgagcgatctccatccccaacctcaacaatccccttcccttcccccatcgcgcgatgctggtggagtgtggcgtcgcgacctagccctagccctagcgccaccgccaccgccaccgccaccgcctgctcgctcgctcgattccccggctccccgtcgctacctcgctacctcgccgcgccgccacagccgccggcgccgtctctcaccgggatcgggacaacaagcgccgcgccgttcagtcaggcgacgggggcgtgcgtctccgctctctggggggcctcgacgtcgcctcgccggtgtttcggaagaccgtcggcctggttggtatctctgattgcttgattactgctagggaatgaatgggtggatgtcgtcgacggggtgggtttagctttagcggattagcgcgtatcacatcccctgattccagtcgagtagacaggataatagcaggtggagggtttgaattttttagttatataaaaggataccttacgttggtgctgtttgatggattggtagaggtggtgctattcttcccttcatcagaatgtcaagcggcttgcttcgtgtgtagattactactagtatttttagggtttgggtgcctgctaatgtcaccgaataggtttcgttagcttcttattaatgtttttaatgcactttgtcgcgatatggatagcgagaactgctatttgtgccgttttgagatggtgtgtgtaatttactatgtcgttatgggatgtttttttttttgtctattcctttggctcacgtgtccctcctgctgcaatactcatttttgtttgttggatgatcagttgtttgaaccgcttaccttttttataggcgcatataaaagtgatttggtggtcctggagtattcatttggtcatgtattctatattttggaaacttaagttttaatggattaatctagtggaggatgtagtcaagaattttcttttgttggttcctaagagatttcttggctcgcaagttgcaacgcgaattgggctctcatgtattttactattttagaaagcttttaattatcacagatatagtagccgaacagattggatatagctgtgtattcgagacatctgtttgttatcttatacagggcatgctccgccactgaagtcaaaatgtagggagatctgttaagttgtataccatattaggcttagtttattcttttatctttctccatttgttctgctaggaactgagctatcccatggcatcaccacaagaatccaattccttgtgcttgaagcgcaagcttgttgatgactgcctgtcaaaagagtgcaagtctcgtcgcatcaaaactgagaagggaccatcatctgattcatctgccaagcgctgcaaatgctgttgcactcgacctaaccttgccagtgattgtgtcaattacctaaaaagtggagtgcccagccgtgttatgttttacaaacagggttcttggcacaattttcctgagcagataatgaagtctctcattgaagaatttagaagcaataaatctagtgttgttgctgtgatggacgatgagcctgttcttgttgatttcttgtcgatgaccctggtcaacctaaaatctagaaagcagcggtctgtggcatggtttgatgacactgggaagtgcttttatccttctctattctttgatgaggaagctgatgaagtggctaaagtaggcggtgattttgagggcgccacacagggaataatgttggataaggttgcaaattctccaccagaagtggtgaagcaagttgtccttgaatctagtcctccagttccacagaagcctgccactgcagacatattacgcaaaaagatcgcatctgtggaacgaggcagtgaaggctttctttttgcgcaggaccttttcctctctggcatgggtccatttgcaacgccaaataatatactgcacatccaccgctactctccgaatgatatcactgcacagtgtagacttcaagcttttgaaaaacaaatgatgtccaccaaggaagaacgtggtgatgcaaatgtaaggtatggatggctgggatctaggaagaatgacatagttaggatcctaattaatggttttggtaacaatggaaaacctgctgagaaggcaggcttgagtgctggtgtttatctttcaccagaagaccgagcattttccaggtactttttataaacttaaaaaaatgtattgaccattccattttaattgtttatgtatttacattatatcttgcttgacagtgttggtctttgtgatgttgacgaaaaaggagtgcaatatatgttgctctgccggttgattttggggaacatggaggctgtcatgcctggatcacaagattcttttccaagcagtgacatatatgattctggtgttgatgattgctcaaatccaaagtgctacgtcatgtggccatctcatcttagcacccatattcgtttagaatatcttgttagtttcaggctttcctcgaaagttcgaagtaagatgataaataatagttaaaggtttttatcatgttttgttgatataggtggagtgatatattttttggttcacttgttttcagattatttacttggtttgaagggtttatggtttcacccatcaccaaaggaagttgcggtggatatttctactcttgtacctgtgaggcaacctagttttcttcgtttcttcttttccattgacactctggttttccagctagatgtgcatgtactgctaacagtggtagaatagaagtctgatctgagagcaatccaatttcactacagattgttcctcccttctttaaatgacaaatgatcttggctttgttgtacatttttatgcagataatgagtggaaatgctgagggaccaacttccccttggatatccttcagagttctttttgccatgattcaagaaaatatatcatcggtagcaagggaattgctcttccatcattatgaagagctgaaggtactaactaaccaacaagttacactgtgtttatttattagcattggctgtgtggttggttggtgtgatgggtactaaaatgttttaattgtttatttgacaggaaaacaaaataactcgtgaggagatggtaaagcaaatgataatattagttggagagaagttgcttttggaaaccttgaagaggcttcattactgtgtaagtcggctgtcccctgctgttatccttcgaaacaatttctggtgacatatgcttgttttctcagttcacatccatactaaggatacttttaatgctcatatacttttaatacattatggacaagtttgcatacgacaacaggcacaattttaggaagtttttgttcaggtgttgcaatttttataagatggtttattatcacattgtttatcaaatcacacatatttgtcaaataaagaaatatctgctaaattttttaaacgagtaataagaaaattggtaggggctaggaaactagcaaggccttgaaaaaaatatagggaactctcaaagcagccaaacatgcctaaaacaggcacaggccttttgaattcatgtttggataaattatttggaaattttcctcacttgtttcaggcatcctcttatttttactgtaccagtttatctgtactcatatttcacatagctgttgctgcatctgtactggtgtgattaactgcacctttcttctgatgccattgtgtccttggcttctgttgcagccatcattatggtataaatctgctggcaaaatagcatcttctgatcctgcgaggacagctgcagaagacaggtctttggatcaaactgggaattgttcattaattgttagtgttgcgcatggtgattctcatgccccaaatgcagtagctgaaaacagcaccagtctttgcaccaaaggatgtgatactcctgcaacaggcatgatttccaagggctatgattctctggcaccaaaaggtgtgccggaaacttctacttctgtcggccccgtacatggggcttctccaagtgtggaacccaaagtgagggattctcctatacaaaccgttttatcaggaaacattgctactgattgtgccaaaaggcaagatccattggtatcaagagtggcacctgtagctcataatggccttttaaggatgccatctggaaaatcagcatctctcgcagcgcaagtttgcaattctgttagaccaagcacaggaccttcaggtcgtgcttctacagaaccaaataatgcctctaaaagttgtgggatttttgctccgggtatcaggccaaagggtggtgaatctcttgttcctagtttggcattaggaaattccaaatatgcaggtgtagaaggtctcaattctgcaccaagagcgacacctccgggtattaggccaaagggcggtgaatctcttgttcatggtttggcattgggaaattccaaatgtgcaggagcagaaggtatcaattctgcaccaagagtgactccactgggtatcaggccaaagggcggtgaatctattgctcctagtttggcattgggaaattccaaatgtgcaggtgcagaaggtatcaattctgcaccaagagtgactcctccgggtatcaggccaaagggcggtgaatctattgctcctagtttggcactggggaattccaaatgtgcaggtgcagaaggtctcaattctgcaccaagagtgacacctcccggtatcaggccaaagggcggtgaatcttttgttcctagtttggcattgggaaattccaaatgtgcaggtgcagaaggtctcaattctgcaccaagagtgacacctaaagacaaggagtttctttcattgagtatttcatcacaacaaagcccagttcttaattcaggtaaaggccatgatgggacatcaggtgccgcacgtccagtacatgcaccaggtttaccctcttccaactgcagatcatctgtagcacttcaagggttattcttgtgtacaaaatgtagataatcaatgctttcattaacgtgcagggcatggaaatcctaaagctttggccactgaggcccgtggttctctatctctgagtattgcaccgaatgtccatgaccctccagcatcaagtaaggagcctaaggacgatgcatctccaatagcaggcatggtctcagaaagccagcactctcaagcacctaatgcagtcaccaaggggtataatgctcccacacccagtacggtgcttggaaactcttgccatggaacaacattgttggtaacatcacttgtttttttgctaactctcatgcttccttggtgactgcagtacctaaggagtcaaaaggccagcatttacagagtggagtgcacagtcaatcgtctgggccagacgatgctagcagcagcaatgtcgctcgggcagctgataccatcgtcgccctatcaactcttcgagagaagggcaggtagatgttgcagccccttgtgctgatcgctctttgctttttgctgggccgttctctagtgctgtacatgtgatgtgaatgttatacaccgtcctgcccaaaaagcgtttaccgtcgtaccatggtccatgggtcggtccgtttaacttataggtggtgtaaaccggttggatggattcgtttgttgtaggttacctgtcaccttgtcgacttgaacgtgaatcgttgcacatccctggcagtaaactttgtcatggctggtatcttcggtgtccgtatgggttgtgttgcctcggtgtccgtatgggttgtgttgcttcggtgtccatatgggttgtgttgccggttttccagttagctatacatacctgcctagttcccatgtcaaatttaatctttcgtttactctagtgtacatttagtgttcctggaatatatgggtagtgctagatagtagttttgagatgccaatatgcaagcttggttggcatagattgatagataggcttgtgttgggctgtttttgcctgggatccagtctattctctatgtagactatgggcaggatttccatctaaatttcggcccaagtactatttttcacagttttagcggagggcattctctatagtctatacatacccatccagaatttaatcatataaaagcctagtagtttgagaaatgattcgattgagcaaaaggctagtcgagcctagcaacaaatggaatggacaaaaggcttgagcatttagcatgtagccattatataccatctcgtgctgcttgccacgtcggatcatgatggcttgcactggaaaggccagtctagcctttaggccatttgagtgccaagcagcacacacacatggcactttgatgagtctttcctcctttcgctgcctggcaatcgtggcactttgaggtgatgtctcccttgcttaattagtaggcacactgacctgcctgtcaaagaatgatatgattactcgatcgtagtagactttttttgttaactaggatgcctgcaccattaacctccactaatcggggtgtaaagattcatcagacatctgagtcccagttcagatagcattaacctccactgatgatgctagtggtgtcgcctcatgtcagtgtatgtcaccctgcaatttggtcttccctggataaaagctttgtggaagatgaatggataaaataagcataaaaaaatgaaacaagaggagcaccagatgaaaactcaaaactatactgtcagtctgtcatgattgatcagcattgattaaagatttttttctggaaaatgtctatcataataaccaacagaaatactttgtgatgaattgagcagtcacaatgtgcactatagattcttttgtgataagccccaaaaaagaaaaaaaaaggagaacgatgctatcaggagaaccatgtcgtggtctgcactccaacaaagtagaaatgctgtgttctttcagaaagaagtagaaatgctgtgcaagtggaggaacagaatcacatactccattttctccccggcatttctagtccaaagtcaaaacaagaacaagaacctttggatggtccaactaaaactttcttggaaacgtacggttgattttgatcgatggcccagcacccagaatctgaacttctgaagcttgaaagaacacgcataattttcagctggaattggtttgcatcattatttcaaaccttgaacagctgcaactgtaaaacattgaccagcggcttaattacagtttgaacatatagcaaatcactaaacagtaaaaaaaaagaaacacttgcctgtggcaaattaaagaaaattagcaacgaatcaaggaacccacgtgaagtgaaagtgaaatgcaggcatgaataaatgcacggcactagaagtggaaatggcacaatttggaatcaacacacaagtggtaacctatgcttgcattagcagtggtggtcgcctgggcatgcacgtcaaaattaatccctggcgattaagcgatcctaatgatgatcattgacgcgaaaacagtcgccatggccggccggtttctcgtgttcatcgaacaggatcatcactggtactgtgctactaggcaccacaccaaggcaggcatgcatgcttagctttgcgaaaaagttgaaaggctgacacttaaccaccaccaccacctgcagctaatagctagtacgccaaatgcagaggcccatctcattcatgctcctagctatatatatccatccagttctttttttttcatggacccatatctaaaatcactctggtttccttcttttcccttgtgagattcggtctcgaatcaacaaattaggagggtagattcgtcatatattccgcgcaatattaggcttcctttggaatggagaaattttagagattccttttatgaaaattgaagtaattcgtgtaaaaatcctgaaatttttgtatatgttctgaaggagccctgctgctagctaggcccttaactgtgcaatttgtgaaatatgtttcttcccaaacatgctttaaattgagagatgaacctaatgtaatacatgattccaccttgaatttgataagttcaaaaaatggacggctttaatttttcacctaagtaatatatttagtttctaaatttcatgcgatttaaattagaggtagttaaatgcagttaaatttgcacggagttggtttaaaaaatatcactccatgtccattgataaaaaaaaaacttgtgttaagaaatgacctatggtgaacaacatcatatatgagacagggagctcaaagcacgagttagagcggattctgcatgtcgagaggctaggcttcgtgacctttttttttttaactgaatttggtcgaggtctttcttactacccatcaaaaaacataaaaacctggaactggataggactgtcgagtggtctactccttcttgttttcttttttctttaaagaaatacatccctttaaaaaaacaaatatgttttattataataatagaagcttcacttatctcagtcaagtatacatcgaggtgatccaattacaccgagagcactcccaaactcggcatcactaaaatgcacacagccaaacacacactcaaacgctaaaagagagatcatagagagtattaaggaccatcaatcataaattgcataaacattattctttctccaaacctataattaacaaatttcttagataatgttttgacagaagagagcttaggtacggacatataggtgagcggctcaacgcgtttcaagccttcaacgtacagccggtccaacgtacgattctcatatataccttccttgaaataaactcagaccttattaatcaaattttcttctttccctctcaacatcaagttcaaaatccagctaaatttgcaatactaaaacctgtacttgttcgacaatgactggtattttaatgaacgattaagcagcagctgtctgatcgatctggtgatctcatcattttttccccctaattaagactcgctggagaccacaacatcgttagatcgccgactacgactgctgccactgaccagctgccaagtgcatatgcagatcagacaaacaagttttggtcaaaattttcgcgtaagcttccgtttgtccgagagattattctcctaatcttgatgcgtacgtacgtggctacgttagctccagcggcagtgtggctggcgatcgaaatgacgagcaaattaaccatccatcgcatgcagcgtgcgacgactgtccacgtgcgccgccggcatgtgttgactgaacttgctgccgtcttgcagatctaaacttaaattcatctcgctttcagatgtaaacgtttcaatgtagcgtttacttcaagctcttcttgcttctagattatttataacctgttcgtaataggagaatgcaaatggcagcatgctttttctgagcttctaaatggtatgttatttttttaaaggggcaattgcaaatttaccactactttaaatcattattgcaagactgtcactagaaaattgcaaaaatgccactagaactatcattcgagtggcatccttgtaatattgaaaaaaccggtggcaaatttgcaaattccccttttttaaaagaacttttaatatatgttcttttatacttatatgttttaaatccacctttcagtttcataacagttaatttatttatttatattctcgaataattatcacatatcattcatgtattggccgttccagtccattcattaaaaaaataaatattattagaaagcaagttgaaccgctttaaataatttagggtgtaaaataagctgaaaaaaattgcttaggggttaagtgttcaacagaaatagtttggaagtaaaatgaacctttttttcaaaaagagaaaaaaagacgctttcaactgtatgatactgcaagcaacagaaattaatgatgtagtattatgcatatatatatatatatggagtaaattaaagattccatgtatgaaaaatgcaggtttaactaactggcgctgaagtcaaagttatctgatttttttgtcgtcctgttttcttggttagagtcctatgggcatatagaaacctaagttttgtatgaatcgaatcttgttttggttttgacaattttgtgggtttgcacctaacggatcaacctaccctaattgttaatgggtgagaactgagcttaaatattagctgtaaccagttctacttagttttaataagttattaattagcagctaatgtctcatctagctagctcaaagtgcctgccttggcgtcacatactcacatgcaatgcaaagcttaattcagctagcatgcattggcatgtttctctgcatagactggcttagtgcgtacgtgatcgatccacccatatgaattaatttcttaccgtaatcaagggcatgatttaggggatttaattaatcgatctcttctgccactgttacactctgaactgatgaattccttgcaagcctcgtccttagttaatcttgcctctttatttgttcttgacaaattaaggaaaatcgaaaaatgtaatagccttttccatcctatattgatttgcaatatatcatgccataataattggattcctgctcatcaacaaaacaagttgggaagttgacttgtattgtgtgggggcagaacaaggtgactaggtgaggagttggtggtcatgtgtgtcgaccaaaacttggataatctattcggtttctttttcaggatcaacgcttgcactatcttcttggcatgcagttctggtctgacatgatctagcaactccactgaccactgtatgatcccagcccttttctcactgtcatcaccatatgggaacaggacacgatctgcatgcaaatcgacagccaggttgttcttcgaatcgatactattggggtagtagtagaagaagaaggttaattaattaaattaatcaactgcatgtgattctgcatttctgaactttctgaaccgtgatcccaggcaaagctagtcgattatattagtaatgtagtatagtattatcggagctagcacaacggttacaccacgttcgagatattgacttggcgacgtcaacgcagcagcagcaccaagctgccatttttaacacaccatccagtgagcttagagatagctaactgcgattgattatactaatactagtagctagatagtgcagtaattaacctttcgtggaaagctgaaggaaacatgcttgccatggaagcaatgcagcaatgcacatatatctctcttttctgcaattggagaatgcaaagttctctgtacttgttcagtctatatgatctatactccatattctagtatcagatgcataaacgttaaacacacgtctcgttcccagcaaccagtaggctcttgcttttggctgaattctgcagattttctgggtcaaaattgcagaaaatgtcatgatcatgtgtccccgacgtggccgtcacggacgccgcggatgttaagctgcgtcaacgtgttattaatattcacctcggtgtaagaaacacctagcttgattacctatgtataacttgagcagtaagcatggctttgcttcaattcttcaatgtttcagcatttgaggcatagtagcatatatgttcagactgcagttcagttcagttgttcatagaaaaaggggcatagatgtttgcttacacagcaagcacagcatataggatgttggctgctatagctactagtaggacacaactttaatttgaggtgtcacttgtgactcgctacacaattggttactactaatattgagacactagttagtatactttggcacaaagcgataacaaagtttaatggtcaaattgccatctaattggctttgaaaaatgccacacaagctttttttttaacgaaccaaggtaagagtcaaacagaaacgatggccttttctgggctacactcaagatatcaagggccccaaatataactttccaaaagtgtgaacaaagctaccttgccaaccgcattgaggactctactgctctttcatatatagccacttggccaaattctaatgctttgctctctttttaaaaaagaagaggaaggattttctctaaaaaaaataagaagaggaagaaaaaccaaaaatgcatgctcaccattgatcctccctatagctagctgtttgattagattattaggtaaattattgctacgaattatatatctactcgattatagtgataaattaaatatattaaatattttaagaaataaatttaatagatagttaaaataaatggtctaagctaaagggaagtttttaaagaaaacataatatttgaaatatgagcaaacaatccgtttcaatattctggtgaataagatgcaaagaaatgaagaaccgggtcgaccctgagtcctcactaatttaatcgctttcatatacagtcgtcttaatttgttgtgaatatatagtgtcaaaccgtgtaatactaaatattagtattagctagcaacgtcgtccatgcatgtgtttcttagtttcagaccgagtaaaaataggacggcccgaatcgcagtcgccgtttctagagaaattcgctgaaaataacggacgagagaatcggtccaaaaacgggtcgcgaaaacgtgcccggtctagtggaaacagatgcatgagcaatttgcgtaggagaaggtccagtggaaacggatgcatgggcaatttgagaagccgctttgcttgcagggcggagcaaagaatataggcggaaaaagcaaagccaagccagccaccgaggtaggtgtggacaaaaaaaaacttaaaagctcgtgattcggattgatttgaactcatagtcttcatatatacttagaggtatagctcgatagcctaacgaatttatctagctactctctctgttttatattataagttatttgactttttcatagtcaatattctttatgtttcatcaaatttataaaaaaaatagtaacatgtataataccaaattagttttattaaagttaatattaaatatattgataatatgtttcttttgaattgaaaatattagtatattttttataaacttgatcaaacttaaaaaaaattgatcaaaagatgtaaaataatttataatgtgaaaaaaaagagtagcttccaaaccaacctaatcttttatagcttgttagcgctaacgaaccgagcagagtcgttaagataatgagctcaaacaaccgagccctatgggttgagctgactcatgtaaaaccctagaagatgaatataggactcgagaggaggagtatgaaaccctagaaaatgaatatgggattccagagaacgaatatgaaaccctagaagatgaatatggaatcctagaggacgaatataggactcgagaggaggaatccgaggacgaatatgggagtcagagaacaaatataggccccgagatccacccctccaccgaggcgagctgcgagcggtggcgcggaaagaaaccgacgaggtggcgtgcgcgcgcgcaacgcgcgcgtcgaactgaacatacgtagcatacgcgcccgcgacgcgcgacgcgcgccggctgctcgctcgcctcgcctcggcgcgcggcgcggcggccgcggcgcacgagcgagcgtttcgttcgcacgcggaaaacgccctccacgcgtcggcacgcgcacgccacgccacggcgtctcgcgccatgcgtacgtccaactgttcaccacagcgaaggcgtttaagcccatgcgccaagtagacgagcgtgcttgaccaaagtaggaatgcgttttttccccttttttttttctccaaaggaaaaaaaaatgattatcaacgaactgttgccacaaagatggttgagaaaatccaacaaccggtagagtaacaaccaagtctgtctccgtgactgacagagtgatcacctagcagcatcggttaggtctacagttcgtttgttgcacggacagctagctagccaaatgcagatgataatttgtcctccgcttatcgtccacaacaacatcgacaaacacacaacctgaataggctgttgctgtttttgtttccacgttacaacaagttgaatagtggagtagcatatgttttcaggacaatttttcgcgtactgtaccagaatctacaactttgatactcctatctagcgttgttacctggagtaccagctggagtaaaatctttgcatcgccagcaaggtaattggtaggcctaaccagcgtttacattaccgttggtaaccgcccttaccgcgaggtacggtaatagaaatatcatggtaacctccttaaatttaaataaatttaaaaaataatttaaatttttgataaattttacacggttttatacggttaccgcgcggtaaccgtgcttaatcccggtttcggtggtttggaaaaccctgagcctaacactgcctagcttggaccttcccgctttactttccttttgccatttcattccttctcatcttttcaatttcacgacccgtcttttaatcttttttttttcgctggacacagctctgactttgcctttggatgctttactcttggatgtcccaagcagctgaactagccagccattcacctaaaattctgcacattcataaagacgagcattacctacacgcagacaaaattcagcggatggaaaagagaattcagtgatgcatgcaaaggtccatatcaaaaccaaaagaggagcagcagtacgtaccaggggtactagaagtgtacccctccataaaaaaaaaaccaatactagcagcgaacctagacacatatgtgttcagattcattactaggattggattctttttaggatagagtagtaggagtattctgcaaatgaccatagcgtttaacgtagtactagtatctcatcaattcgtcaatgtaggattaatctggcagccattaactaagacagcgtgaaacaggttagattgtgtttagtttcacaccaaaattggaagtatgaagagattagaacgatgtgactctaaagttgaaaatttgtgtgtaggaaagttcgatgtgacggaaaagttgaaagtttatatgtagaaaattttgatatgacggaaaagttggaagtttgaaaaaaaagttggaatctaaacatggccttattcgtcatagtgataaattaaatattttaaaaatatacttagtatatggaatattccctccatcataaaatataaaaagttttggttggattggacacatactagcactacgaatttggacatattacttgtcgagattcatagtatcaggatatatctcatccacaaaaacttttagtaatattttggaacggaaggagtagcttagaacatgtagtccaaacatacagcattaggaaaaaattatccagtgaagaaaatgaaaagaactagcacaattgtcaatccaaaaaaaaaaatacgattcccccaaaagaagaaaaactgatcggaagtgtggcaaaatttagcatcaaaccaggtctaaaaccacagtaaattttgtgcatacatgtagtgaacattttcagcaactacataaaaaattgcatattttccaacaacaatggggtcttctttaaaacacaggaatttgtatcatgacattttcttaaaaaaaaaagatggacattatactccactgttcttggttctcccagcgtaagcaaaagctcatattaatactgagcaagtgaacagttactaccacttagttcatcgcttcatagtaaattcatttttctcccatttatccaaaaataagtttatttttaaatagttattacattggagtctatgaaaacagagaataattacattgaaaatagataaataaagaatagttacaatataatttgataaagagtgtgttgagttcacgtcaaaattagaaatttgattgaaattggaacgatgtgacggaaaagttgaaagtttgtgtttgtaagaaagttttgatgtaatggaaaaattgaaagtttgaagaaataattgggaactaaaccaggccaaaatacatatattgtagtctttttattactatgtattaatatgtgtgaaatgatcggggaaaaataatcctctactgtctccacagttctaccaccaccagcagcagcatcggatccatccatccacgcattgatgttgcagcgcagacccgtcgttactcgtagcttagtggtaacagtaacccgtccaccaattgctccacccgttgcagtcgccatcgacttgactctgacctgcccctttctctttctcttattcttcaagagtgtgtttaggtacttccaaagttactagtttggattaaaattgatacgatgtgactaaaaagttatgtatgatagattaacgtgatggaaaaagttggaagtttggatctaaacacggcccaagagagggtgtttagatcaaggtgtaaagtttaacgtgtcatataaggtattatataaggtgttatatggggagttcatacactacaaagaaaaccaattacataattcgtcagtaaaccatgagataaatttattaaacataattaatccatcattagtaaaattgtcaaaacatgaaacaagtagacttaaaatattcgtctcgtaaattagtcgcattctgtacaactagttattttttaacctatatttaatattttatacgggtgttgacatgaagcaagtagacttaaaatattcgtctcataaattagtcgtattttatacaactagttattttttaacctatatttaatattttatactggtgttgaaacgtttcgatgtaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacaccccctcagtctatctctcttcaaagtccaagcagcccacgaagtacccggcatttattttcctcacccattttctccactaaaatacgcgccgcttattaaatttcccccgcctttgctttgcgtcaccatatcaaatgcgcaactagcactggtgcggcctaccagtgagcgagtctgcgagtgagagaaaagaggacacgagaaagctttagagagagagagagaggaaattgattttttttaagtttgcgatgaatgaataaacaaatctggtgaagaggttgggaggaagaagaacggctgctgatgagagccgcattggagtcaaaaccaaccgtctctttctctcctctgactttcccccactctcctcctcttcttcttcttcctcctgtgatgccatcctcctctttcggcgcctcacaatcttgcgatccagctcatgtggcggacggaatgagagggaatttcccgttcttgcgctcctggatttcttgcccagaggaggagtcttgactcttgcgagcgtgttcgttcttggtgattagattcatgctgcctcgttgcaaggtggtgtgagttgttttcctggattcttgaagttgttcatgccctgcaggaagaaggggttcattttctgattccgtcgacggcggagatgagaggttactactgcttcttccatttcttggtggtgtccgttctgctccacgtccatggcggccgctccgagagccagacgtgcgaccccaccgacctggcggcgctcctggccttctccgatggcctggacacgaaggccgccgggatggtcgggtggggccccggcgacgccgcctgctgctcgtggacgggcgtgtcctgtgatctcgggagggtggtggcgctggatctctccaaccggagcctctcccggaactcgcttcgcggcggcgaggcggtggcgcggctcggccggctgccgagcctgccgcctcgacctcagcgcgaacggcctcgccggcgcgttcccggcgggcggcttcccggcgatcgaggtggtgaacgtctcctccaacgggttcaccgggccgcaccccgcgttccccggcgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaagatctgtacatgatgccagcgctgagaaaactaagtttgcaggagaataagctctccggcagcctcgacgacgacctcggtaacctcactgagattacgcagattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacaagctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttccaccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggtcaatattgccatcctttggccgtctagtgaagcttcatgtgctggacttgagctttaacaatttttctgggccaattcctgatgagttatcaaatatgtcgagcttggaaatattggatttagctcacaatgatctcagtgggagcataccatcatctctaacgaagctgaactttctgtccaagtttgatgtttcgtacaacaatttgtctggagatatcccggcaggaggccaattctccacgttcactagtgaggattttgcaggcaatcacgcactacactttcctcggaattcctccagcacaaagaattctcctgatacggaagcaccacatcgtaagaagaacaaagcaacccttgtggcccttggacttggtactgcagtgggggttatttttgtcttgtgtattgcttctgtggttatatcaaggattattcattcaagaatgcaggagcataatccaaaggcagtagcgaatgctgatgactgctcagagtctccgaactcaagcttggtgctgcttttccagaacaacaaggatcttggtattgaagatatattgaagtcaaccaacaactttgatcaagcctatatagttggttgtggtggttttggacttgtttacaagtcaacactaccagatgggaggagagttgcaatcaagcggctttcaggcgattactctcagattgagcgggagtttcaagctgaagtggaaacactatcacgtgcccagcatgacaaccttgttctgctagaaggctattgcaagataggcaatgacagactactgatctatgcatacatggagaatggcagcttggattactggcttcatgagagggctgatggtggtgccctgctggattggcagaagaggctacggattgcacagggatcggcaagggggctggcatacttgcacctgtcgtgtgagccccatatattgcaccgagatatcaagtcaagcaatatcctcttggatgagaactttgaagctcatttggctgatttcgggttggcaaggctcatatgcgcatacgagacgcatgtcacaacagatgtagtgggaaccttgggctacattccacctgaatatgggcagtcacctgtggctacttacaagggtgatgtgtacagctttggaattgttcttctggagctactcactgggcggcggcctgtggacatgtgcaggccaaaagggagcagagatgtagtgtcctgggtgcttcagatgaagaaggaagacagggaaactgaagtatttgatccaaccatatatgacaaggagaatgaaagccagttgatcagaatcctggagatagcactgctttgtgtgactgctgctcctaagtcaagaccaacatcgcagcagctagtcgaatggcttgaccatatcgctgaaggttaaggttcagtcaagttcttaaatggtttcagtttgatcgatcaagatccatcctgatagtttcttaagatgattagttctgtaaataatatttacatagcgtgaaatgccaagagttcaatttccttctcatgccacccttcaagtaatagttcatatcatcctctttcctttcttcataaggtggttgcaagatcaccacaatgtaaaaaatgcattgtaggtttaaaccctcaggataacaccctagcagttacataaccggcttttctacagatttattgtatgttctgtaatttcagctactgctatggtatgaatgaacttttgtggggcatttgttttcagtgatttgctccagctagtgctatcttatatgtccattttccatttttcacatctgatccttctcactgcatgtaaaatatgagaaatcaaggtcttatgcagcgctgcagaatgcgagcaccgccatatcagagtcagatacagatggtatggccagttacattgttctggaattcattcagcctatactggtaaattgctgtatggttttatcttttatgatcttgtagtagctccattgtcttcatttggctgatggtttgaccttgccagcattcagtactggcactgcagtgctttggcaggggtgatttcttccacgttgcatgctgttctctcatatttgttcgaaagatttaggttgggaactctttttcgtgtaggtaaaacaggatacttattagaacaggaataaataagtattatagctaaaataaatttgaaaaatggattaatttgatttttgaaacaattttcctataggtttttttttaaaaaaaatatttttgaagcgagtagaagtttagaagggaacttgtagtacccaagcctttttttttctttttttaaaaaaagctatgacctattctggataggcctctcctttgctcatgcacaaaattgtcgaccgttctacagtgcagaggaaaaacacggaaggagcagagaacggcgtggtacagcgtaccagatcaaccaccacccgtgaatcgacggcgcgtgcaggggattagccggcgaggccgcccgtcgcgcgcgcggctccatggttaatggtttcttccggcctcgctccctcaagttgaacccgagcacatcacaggcaaaggcaagccctcggcgtaggcggcgtaaagagggggagaggagatagagccggacgaatccgaacggcaaagcccgcgtggctggctggcggcctttcggcctattctcacgcgagcggctcggcccaaaataagcctattcgcattctcttctcttggtattttccactggttgggccaaaaaacgggaactacaagcagatgcagataagctcaacaacagcaacacctgaccaatgctggtcgtacgactacagctgctcgctgtagcctgctgccctgctgtttcgagtatcacacgacacttcttcacttgtgtagtgtacgtatatatggttgctttttttgataactatatatatgtgcttggttggaccgctaaatcttaatcttagcaacgggcatccttacctacgtggagtggattaggcctgtaaagttattagatctcgatccagcactgtggagcctatttagccaaagctcttctctcctgtcccataaaacttaagcagtgcagactctcgctcctctctcctctttttcacctctgcaatctgtacagactgtacttgcccccacgtagtctgaatccatcggtttacacacaaactcctagttgtacaagatggtggtggtcgcacctcataaaaatcaaccagaacacagcgtgcagtaagccaaacagaggcaataacacgcactaaacactgacagcgtggggtttcgccttcgaggcttcgagctagtcgatcgtgtaaggccctgtttacttcccaaaagaaaaaaaattccacccatcacatcgaatgttcaggtacatgcattaagtactaaatgtagaaaaaaaaacaattacacagttcacgtgtaaattacgagatgaatcgattaagcctaattgcgccatgatttaataatgtagtgctacagtaaacatttgctagtgatggattaattagacttaataaattcttctcgcagttttctgacgaattctgtaatttattttgttattagactacgtttaatacttcaaatgtgtgttcgtatatctaatgtgacaatcaaacctaaatttttttcccaactaaacaaggcctaaggccaagtttagatccaaagtttttcttcaaacttctaacttttccatcacatcaaaactttcctacgcacataaactttcaacttttccgtcacattgttccaatttaaaccaagggtgtgtttagttcatgaaaaaagttaaaagtttgaagaaagttgggagtttaaaaaaaaagttagaagtttatgtatgtaggaaagtttttgatgtgatatgatgtgatagaaagttgagaatagggagaaactaaacacggcccaaacttctaattttaatgtgaactaaacacaccctaagtaaatttctctatatcgagtaaatcggaaaaagggagccatgggaataatttcatctcccatccacataggagaaggcaatgcaacacggaagcaggggcaggctgcaggctggctgggtgggggaccccggtagcagcagcagcagcagcagcagcagcagtagcagtagtacttggcggcaatggcattggcattgcattgtcatctcacgatgcagggggccagaggggatgcagtgcaacatctctctctggtcctctccggccaccattattaccaccaaggactctcgaccgcaacaatggtggtggtgcccctcggcccggctacgcgcacgcacagcgcaagcggcaagcggaagccgatcgccgccacgccagcgggtgacccacacctcgatcacgttggtacaacatttggtccgctgatagtatgtgctcggggcacatccgacggtgccctggaatccaaagcttggacgatccatcatccatgtatagagttgtactacttctactatagtagtagtgatatgaaaaaaaaattgatttgttctttctttttgagaggtaaatgatttgttctttagccaccatttccatctctccttctctctctacaaggaccagcatgtagttgcgacttgcaagttgcaaacgcagtgcgtcattggatggactgcattgcggtgcagacgagggagcagatctcagagggcgggtttatagtgatggtggattggtgggtggctacttttgctttctacttactccgtctcatgatactcgtcgctttgaatttttatttataaattttgatcatttgtcttattaaaaatattttaaaattattatttattttatttgtgacttactttattataaaaagtattctaagtatgatttatcattttttatatttacactaattttttaaataagacgaatggtcaaacgttacaattaaaaagtcaaagcgacatctacgatatgacggaggtagcgctaatcccaaaactcaagccaaggcgaagccaaggcaagtcctctcctcccccaggcaagccaagcagcagcagtgggcgcagtggcgcagcgcaggcgagaggaggcccatgcacccatgcatgcgatgcgttgccatgttggggtctcacactcgcagcagccaaagcctgtgtgtgcctgcagcccgcggtgccgcttccccccactgcgccgcgcacctggccaaaagttggccgatcgatcaccacgccgcccccaccgcaccaccaccatactacacatactccagttgcacgcacgcacgcacgcacgcacgcacgcacggcatcgacccatcagccaccactgatcgatttgagagcgttttcttttcggttttcccccatcccccctcttctttttctcaaagacaaccacactgatcaatggcgtgcctgcccaagcacgcagtaggcggtgcatgtggttcaacacacacccccaaaaggaaaaaaaaatccataaattaagagaaaaacatttgtaaaattctagttttgatgcacttttaactgagtgtaaatgtgctgtaactaagcgtaattgctatgtaggagtaattaagtgtaagtgtaagtgcatcatacgaaatataaaaacctaaaagtctatcgtaagtgaaatagcaaaaccgaagaaaaaagaaagaaggaaaaatcgagagagatataaaaagtgttatcgttgattcgtttgttgcttattggcttataaaccgcagcaaaattttaaattttcaaactttattttaaattttttaggtgttttttcatcgcattttttcttggttttctagatcaaccacgaagagccgacgccaaccaatgccactgcattatcaaatcatgttcatgttcgggaaggcaaggaaagggacaccaggagggagaggaaacggaagatgccccgagcacagatcaggtttgcaaagcgatcgagtctacgagatagttgtggttttggacgggttaacgggacatctccactgaacttgccctttcctttcccttggggatgctggctgactcgcttgttgggtggtgtgtgacgagcactttctgggattgcataaggtgttggttctcaagtatgcagcaattatttagcgaggctattgctgtagatccacaattcgtgatcgtgcctcttcatggggatgccatgttattggctcattgcatcttaagctcccaagcacaaaagttgtcctcagccattcctagtaggatcaaggatgcatacatgcatgctcggtaagtattaattatccccttcaaacttaaattatcaagacctcgaattttttttaatagaagacatgtgaccaaaacagctaaacatatatggtagtaatatttaggcaaaaactttacaccctttttagtggtccaaatgttaaagctaagtcatgaaacttcaaaattaagttctaaactttaaatttatcatcttaaaagtggccagtaaacatgcatttttttcccctttgaaggactattacatgtcatatcatctaggagtagtagcaaactaatcacttgtattgatctaactcctagactaccaatactgctactgtagaagtagtgctagtatataggagtactccgtatactcctgtactacttgtacaatcaatacaaaggctactggggcttgcgtcaccgagcaaactaggcttacgttccctgttgggcagatcctagtactagcagaccaacgcaagctactccctccgtcccataatagatgacgtttttgactttttatttgtaacgtttgaccatttattttatttaaaaaattagtacaaatataaaaaaataagtcatatgtaaagtacttttgataataaagcaaatgacaaacaaaataaataataattttaaaactttttaaataaaacgaatgatcaaacattgacaaacaaaaacttaaaaagtaatatggaatggaggtagtacaccaacaatgttattgagacgtactccttcctgggagtagtaatggcgatccacaggagattcctgggatagctcgaattattgttttcgctgctcctaaatcagagcaacgcgagcggaaacattgttatttggtgactgggagttattccctctgttccaaattataatacttcatctgtcccaaaatataataacatatccgttaacattccattcccaaccaatcacaaccctccaccatcactactggagaagtgatctttgctgggtcggccgatttccacaatagccccggttgcttgaaaagccgggactaaaaatgatctctggtccaggtttatttgtgcaaggggactatgtgatctttaatccaggttcacctcgtgtcagaggctatcaggtcctcaaagatctttagtcctagttggtagatcttaactttagtcctggttgttgttcctaaccggaactaaagtttatagagatctttaatcccgattggtattcggttggtaaaaccaacctggagtaaaaatcaatataccgtatataatccctttgcacgtatcctcaaaaatttctatctactcttcctcctcgctcttatcctctccttatcttcctattcctcctcctcctcccctctctctctctctcacagttttatcctcttttctcatagagccggcgaggagctggcgacagcggaggcggcggcccgcgcgcgcggaggaggccgggagggcggcaggcggcgggtcagcgattttttctatataatttgtgattggagatctgagatgcatttgatttgtgtgtgatgtattcatgtgatgtatttgtgatgatttttgtagaacttgtgatgtaattttttagaatttgtgttgtatttggagatgatcgatttgaggatttggagataatttttgttatgtgatttggatttgtaatctgtgatgatttatttggggtgatttggggatggagtgaaatcaatattcaatgttaaaggcaataaaaaaaagtagcgatcgatgctggcctggcatctttagtcccggttatttgaacagggattaaaaaccgacatctttagtcccggattctccctcccggttcgctacccgggagtaaagggggttgcgaaccgggagatatgaggagttctccagtagtgcattcacttttcccacctacctccactactcatccaatcataaccctccactattcacttctaactactttattaataattgtgtccaactctaaaacttcttatattttaggacggagggagtaacttatagacttcaacatttatctaaaaaatataacaacttattttttttctcacccaataacaaacttccacctcttaatatccccacctaccttctcttttaaccaatcacaacaattacacgtttagttttacctacttttttaatacctagtatgtcaaatctaaaactcatattttgggtattttggggcggaggttgtaagaagaaagagaccaacagccgtatgtgttgtggcaataggagaattttgactattattattattctggaggatgcatggctagctggagtagctaggatcagtaccactaatgttgcagctgctgcctccaggagcaaaagagcaaaacgggacgtagacggagatctatgctgcctcctggagcacacgctaagctatagcttctcactgatgtgtgctgggtgaattatggacgaatcattca

SEQ ID NO: 37610 - DNA, 11465 bp, Oryza sativa
ggtggggggggggggttcaacaatacggggaccatactaaaaaaccacacaagcttttccctctcatctcatcgatggatcaccattttgtgatctgttggtgttggtgtttgcgactgcgcgagtggccggtggggcctcgtgggctctcgatgagtagtgatcgatcgatctttttttttttcaattttttttcttggagacacgggccgactgctgatctgatccagtgtgccgcccaacattgtgggtagctttttccagatcgtgcttctcccttttgtggctgtgaacctgcccaactttgggctgccaactttcttcgccctttgctcgaaaacattatctactggcatatatttgctcgatctatcatgcatcggcttggacttgagaaacccgggatcgatcaattgtggggttactacaagctttcttcataagataatcaaactgaatttgatgccactccgtgtagacaaccaaacaggaggctactatgtgctccgtgcagcagacacgtgcatgtaacagttaacgccgtggccggaagtagtagtagcactagtacgtgtggtaccaccggttacaaaggcacaggtaaattcaaggcgatcctccacagaaaccctgatgattggccatccgaatccctagctttgtgaggacacgctcgggggtatgtgcaccgcaaacagatcgcacacgtgcacgggcgccccagtcgcacatgccgcccacgtatgcacgcacgcacgcgcgagtgcggcatggaacgaaccgatcgaacgggaggaataaggctgtagctgtaggagacggacgcgacgagatgagcatgactcgtcgtcagtcatgcccctgcacgcgcgggtacagaaggaacagaagcgagtggtagctagtctagtcaagcaatagctaagaggcttgccgctccgctgctgtgtgcctgtgcgtgctgcgaattcatcagccacgccagcgcgcggtggccagccatgggcggcgagttgaagttgaacgggtgcaagctggtggcttggcgcagcgcaggggatggccaggaggggcgcacgtacggtggtcgtcggcagagagcgagagggtggagaggaggaggagcccgcagcttttggcgcagcggggtgggccagcgcgctgctcccccggctctgttgagcgtggaaaattcagaagggggtggtgctgttcctgcgctgtcccgcccgccggcgccgggttccttcctggacgccgtccaccgcctccacctgatggaccgccacctagctacatataccattgatctgttcagaaaaaataatttttttggatgatttcgatcgtatgaaaatctttgtaacaaatgatttaatcatatcttattctttaaaatttttatgaaataagtaatcctataaagattttgaacaaaagttagcaggaggttcaaccacttaaaaaaaattctttgagtctatccctcttatctgattcatacatttttcatgtggtttaatcaaacgatcattcctatattttttccatgtttttcatttctttattttacacttacattcatgttagaatcccgtgttttttctattactttgtttttcaatcatgctattcaactggaacctaaacgataatttccttggcacgtttcacatgcatcttgctaaatgatatattttctaaatatttctatatagaatttattttaaattttaaataaattatttttttagtttatatagttgttaatacttaattaatcatatgttaatgagttttcatgggtgtcttaccaaactcagaaacgaataagcccttagtattagaggtagaaaaatatggattttgaaataataactacagtagtcttgtacaaaactcctattatacgttctcagtgagccatatgcatgtagcagacatgtgactcggattttggtgttataaaactgatgttaattatattaactcatctaccaaaatttgacatgagatggtcaatctgtcttcggctacaaatatttgatgtttgacctatcaaaaagaaaaaaaaggggtacaggacaagatttaatttaacttttattgttaattttatattagttatagtgtataaattcttataatttcttaatattgtgtggtggtagtttttaagacgaatctacacatcattttttaaaactaaatatttaagagattattaatagttaaaagttgaaagagtttgattaaattttatcaaaaacatcaaatactatctgtgattaaaaagagtactatcgcaaatagtaaagagtaaagaggactaatcaaacgtataccatggcacgacatgcatgccatgctataaccgtgaaacacgtcgagacacaaatagtcaagcttgtctaaagtttagttcggctaagtgtgacaggaaaccacattttcaagcccatgttccccgtttaagctcggtccacgcgacaggaatcgtggacgcaggccagtgatgggaaacagaaaatcatcctctgatagtaggcgctggatatgtttgctagctgatgaaatccagctaccatgctccatgtcttaggatatttgttgcaactgtacttactcattaaaatagggagattccatctaaacaacttccttctgtccctaatctcagtcttgatcctccaaatttttaataagaaaaatacggctacacaacaaaatatagctgtatagagtgtacacagactggtccatatcttaattagtagaacttctgctgataatttactgttcatctgcacttctgggaacaaacataggagtattgatcaatagagcagctagctggtacaaagtctactatcctaataaacccaaggtaaataaaagcatatactcccactctttatcattctcaacaaataaacccaacttgctcgcgtacagtacatacagtacataggagtactgtagtgcaggccggagcaccagtacactgaactgctgcacccaattcatactagtactccttgtcaagctcatttaagttgatacgcacggtcaaaagctcatttgtacggatggctccggagcctctcgtttggcagctgagatgatcttttctcttttaatttttgggttaacataacacaaaagattaacctgaatatgccataaactttaccagtttggacccaggtaagtaggatataaagcatgagcctcacttgtcatcaacttttcaggtcacatttcctttggaaggttaatttacactttacacccccccattaccaccataattaacatgactcatcttttttgcagacgttggaagctatagctagcacaacaacatcaagaaattaagactcccatccatatatattgacgtcaatctacagatatagggatgtcgacagtcttggcaatgaagactatgatcacgtcgaagcaatttcagtgttactatcggtacagcgatcgaacaggcttgtacagctatggagaaagcgagagatcatcaagagggccaatccgaaattctagaaagtacttatgcactaatccgatgcacagcacgagtacgaaactacgggcaaaatattcactcgatcagtagataggggcaaatgcatgcaacgtacactggtcgactagtaccattcttctttttttttttaaaaaaaaggtttttacccaacacatagaatgttttaacatatgcattgagtattaaacgtgaaaaaaaatcaattacatattttacgtgtaaattgcaagacaaatcttttaaacataattgcgctatgatttgataatgtggtgttacattaaacattttctaaatatggattcattaggcttaataaatttgtctcacagttttctggcaaaatctttaatttattttgttattagataatatatatttaatactttaaatgtgtttctgtattccacttgtgttttttcttacgacgagttaaaagattttttttcccctcctgcgacgtaacgtcaagtcatccatgtagtacgagtcaaacgtgttttccatgtctatgtcgcgtcttctttttttaatcggcgaaagaggacgaggacgccatggacatggcatgcagtggtcgacaagagcaaaaaaataaaaaaattaaaaaatctcgagttctttttttttctttttctttcacggttggattggtcacgtcacggtacgaccggcatgtcgcgcacactagggttgggttgatgtgacaagattgctccgtacgtacacacccccatccctttcctccttttttaaaaaatgaccccctgtttgtgcgctgtcacgtaggggacgttacgttgctgttgttggggatggtaaaaaccggccggactcgtggaatcaaaggctctaggacaggttgcccgtttggggtgtggatgatgatgatgatgatgacgacgacgacatgggttaaggaggcaaggttagctgtaatcaaacatatgtgtacgtaggaggacaagcatacaaggactgattatataagcatcacaagtggctcccagttaattaagtactactagtcgctaatccgcaggcagctctttaagtggaaaaaaaaagatagtacttgattagtcttgtcatgattatggtatttttgactaattgtgatttccaactcataaaatagaagcatcaagtacataattttttatacctataatatatgtctcttattaacatagaaagtaatgtctcgagatatttatgtactaactcgatggacccgttcctacttttaccatggcttttattagacagactgtaagcactatagtcagcgcatcgagaaagtatgtcccaagatacctaatgctcccctctctgttcaccggagctctacgtatataaaatattgcctacacctggttgaatatattctgttgagcgattaacattctatgtagtaggagtactccctccgtcccacataaaacccattcctatcatgctaaggtgagactagtgaagagtaaaaatgactaaaatacccttttattattgaaaaaaatagtaatgttgaaaggtaggtaaagggtttttaagggagaaaacttttcgttttatgtgccaaggttaggtaggatggtagaagttgattttttatgggacaaaatttaaactatagaagttgattttatttaggacgaagggaacatataacaaaattagcaccataagaccatattgttaacccaaataatgaaatcaatacttcatgataccggtagaatctggaggacgggactggacaaacacgtaggaggagcagtactagctgtaacacagacggggaggagttcacaaaccaacacgggctacaggttacaaggaacggtagtagtactccagtgatacaacagtggtgccccacgggaacaccagtctgcgctgcgtgcgatggagagctgcatatgccgggatggtggatggatctctctcatcaccattagagcatatataatagcagactattagccagatataaacatattttaataagataagtgatcgcgggctatagatatgtagccagctgcagcacgaacttcaagacacaatatatgtaatatgtgagaccatatattaataatatattaaataattattgtacgaattagctattaaattggttatagatgaattaaagctagtagtgaactatactattatactattaaacttgctcttacggccgtggttacaccgacccgacagccgcttacatgagcccataaaatacggctttttcaaaaccccctcgcttcccaactttttaaaaactcttcagacactgtgcgggagctcacgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagagaaaggttggttggtcccttgccggcggggtgggggttggattgattttgctttgctttgctctgtggtttgttgatgcttgttgttggtgttggtgttggtggtggtggtgcagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaaggtgggtggctaggtttgtttccgccgcttcgcttcgcggttcgctttacttcccttctcgtttggttgatgactcgatctgctgctgctgctgctgctgcagagaagaagtgcctcaactcggagctatggcacgcctgcgccggcccgctcgtctgcctccccaccgtcggcacgcgcgtcgtctacttcccgcaaggccacagcgagcaggtgaggctgagctcacctcctcagccgtctcgtgggcgcgcttgctttgcttctctctctctatctctgctggtttctcttgtttctgacgcgggtgagctttgcatacgtgaaggtggcggcgtcgacgaacaaggaggtggagggtcacatcccgaactaccccaacctgccggcgcagctgatctgccagctccacgatgtcacaatgcatgtacgtggttccttgccctaatttctcggggcatttctcagatcgatgcggcgtcacctccactccactcctccggtttatctccatggctgtcggtgctgacttgggctggcaatttttttgcaggcggatgtggagactgacgaggtgtacgcgcagatgacgctccagccactgaacccagtaaggcgcctggggtttttgcatgatgtttgcagtgctgaggttttgatggtttgaaggcgtgaaatattctaagcggttaatttgatggtttttttggatgtgttcattcgtgcagcaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggtgtgatgagtggtgtaatttggggctgtgctcctttcttgtacttcttgggtggttgggttttgctgttgccaataacaggtggtatagtgtggtttgtaggatttcacacagcagcctccagcccaggagctaattgcacgggatattcatgacatcgagtggaagttcaggcacatctttcgaggtaacttcttaaaaatctgtagagcttatggcagtcttgaattcttcataacggtgaattatgatattcttaaagggaatttcctaataatcatctctgccccttttccattcgataagttcaccctttgtaatcatggcttaaaaccttcctaataaaaacgttttcaagtgttctgagaaaaacttcaaccattctcacacaatgtgatgtaagcgtctttttcacttaaaaatcagttggtgtgaatggagcaagagatacttgattgaattagggttatgcatagaaatgaagttacgagatcattaattggataagcacataaaaaatatcaaattttaatatgttaggatagttagcagtggatcaagttacaattgacatatgaatacatgatactttcagaggcgtactgaaatatttactagagttcgcaggtcttacaaaattgcacaatgagcaatcactgtactggacagtataattctcggtgtaggcttctttttgtatgccttgaattcccatctttctgcagggttgaacttattgttagtgtgttttctgacacagaatgtactttgtattgatcacaataactaaaaaaatgttgtcttaacataaatgttgatagtacatatgcttgaggtacttgtgctgtattgattatgaaatgggatctgctcaacactaatgatgttgttagtaattgtgtttagtagttttatatttttgaacatgccatgttactatcttttgtagtaatatgctgtttttgacaggccaacccaaacgacacctgctaaccactggctggagcgtttttgtcagtgctaagagacttgttgctggagattctgtgcttttcatatggtttgttttccatctctcttgcatttgtgattttcttttttacctgtgctaatgagtagggcgcattgttgattctctgactcaggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccggtaagttggacttttaaattagtatatatgcattgttgtttttcctccccatgtacaccgttaatagaaagagtgtttgtagggcaagtccatcagaatttgtcataccactgtcaaaatacatcaaggctgtttttcacacccggatatcggttgggatgcggttcaggatgttgtttgagactgaggaatcaagcgttcgcaggtgacctagcaaatgtcaatgctcagtccttattctataatctaggccaaatatataaatgatggtactttttttagataatacttggttacctagcaccaggagatcctatacatgtttgtaggatgtatgtgactatgccagtggctgaaattgccattatctgtactttttatgctttcacgcgttgatgttcttgaaaaatctgcgcatctgtcaggacatcaccccattatttatgggaattttataattgggcctctataaaaatccataatatactaatgcgcccaatgcacactttaatgaaacacaggtatatggggactataactgaagttagtgatgcagacccagtccgttggcctagttcctattggagatctgtgaaggtaatttttatattacttgaggttgttctaaagagctgtgggggtttaaacgtgatttgtgttgtctttcctgattatcttcatcttctttagttgcattttcttatgatctgtacctctggttttcattataacaatcatggaactgccttcagatgttattgcactagtgcttgcttccacagttccactaactagtgtgatattttcaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatggtacgcttaagattcttgttactgtgtgtcaggcataaactagttttgaagctattttgctgtatgcttgctatgtgtgtgcgcctatcatgtggaagtttatttggtgcatttacatagtgttttagccatcacactcaaattactgaagccacagccttaataaatttctgaacctgccacatcaaccagctgatgattctaactaaaataacctgaagttgagattgtggtgcaagagcaagaggctatagttcaagtcagtgttctctactgtgaacaatatgcctcaaatgatggttctggatacagagattgatcagggaactttataaaatgctcatataggctaaaagtaaaacaagttatggtgtaagtgaaaagttgatctcttccttccatttcttaagcacccaaggtggatcaatgttatttgataaggctcttccgtagcaaatgtaacgttctataatatgcattctttttattcattgtctttctgtgcattcttgttatggagaatgcattgatctgcctgacataattccattttctagtatctctcattcatatttctgttcttttattaactgctgtatcacacttaagatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtaactagtataatttgcattgttgctaggtcaaatatgagctcctctttttcctccaaaaaatatatattcttcttttcatggaaccattgtaaaattgcaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtaagaaatattctcagaattctgatttatt

SEQ ID NO: 37611 - DNA, 6828 bp, Oryza sativa
  unsure (1)..(6828): unsure at all n locations
tcctccgtttcataatgtaagactttctagcattgcccacattcatatagatgttaatgaatctagaaatatatgtgtgtnnagattcattaccatctatatgaatgtgagcaatgctaaaaagtcttacattatgaaacggagggagtacaatactttggtttcctggtttccacaactaatagcttatcgaggaaaggtatgtacaatgtgaatggatatcccttcttcattcactgaaagacatgttgacagctcatggacagtatctaatgaatatgtttaaaagtactagtgttatatggagtatatttttgcaatgttcggtgcctaattgtgatctcaaacagaattcatgtgcattcagtcatacatctttaatgtgtattaatatgttaaatttttttactagactgttcttccttcaataatatgtgttggtcagtcactatatgttgatgctcagttacccaagacccttcgtgagagtaaacatcagacatgattcttcttgaaactgaccttcctcatatgatgtaggtcctttgtgaatagtgtatggtacatcaagatactttcacctgaggatgtgcataagatgggaaagcaaggaaatgatccacggtatctgtcctgaagtgagagaacatggtgccatttctggtaagatgtcataattatatttattgtaacgattaccaaatcccacactaatccttaaaaacctatgactggatagagatgttcttttctgagtaaatctgttatcatgttgtgtacttcgatagttgttgacatattggcatcatgtgttttttgtcccttattgaatgtaaaatggtctcattgtgcgggttgaagaatgtctgtttgctctaatttttattgctcggaataactcacatcttaattgacgactcaaatttaatttagagtctttttatgcatattcatctctgcatactaacatgtcctggtatactatcacagggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctgaagttttttctgtagtgcctaatattttgcttttattattaatgctaatcatatactgttgtgatattttctgttgttgaatatccaaatctaaagaacagaattcccgatggttcactctacagaatacatagatcgacgaactggcaagagagtaagatttgaggcagagtgagcaaataccgttttgcgtgggctcgtttgtgtttgcctttctccttgcgccgcctgccaccgtcgtgtgcgccgagtttcttatccgggacgacggcgagggaatcaactggtggtggaggaagctgtaatttgtgggagctttcgcgtggagtgagatgggatccatgatccaacacaggctccatggcggcgtatgccgttataaaggattggaatgtacgatctgtcgcagttgttttcgcacctcctttctgacgaggaaacctggattgcccccgattgggattatgtgatattcccccgtgacacgagaatgtcatggggaatgtcaccgaatcccaatccgattgcccccccctccttatttttcctgaccacatagtactaaactgttcccgatcaaaaaaggagaaaaaaaagagggagcaatttctttttcaccaaagccgtttaaaaaactttttgatcccgacaaaatctgattaatttttatataaaaaaataaaaatctactttgaactttttttgaatttgattgttaaactaagcggtttatgtcctcgaaccagcccgagaaatcgagtttttgtcaccatccggttttcactagttttgtaaatcctagttctttggggcaattctatcagaagagtgatgtggctcgagcctctactattgatgcgaggattatggacaactcacataatctctacaattttttttttgccatacatagatggaaatggagctgctgttcctttgtctaatttcttagacatcctgctatttttttctggatacgtcattgctggccctgttatagttggagacaataacatcacattaggcaagggctaccataaaagatgtttgagaagtgtagataataaattcttttacaagggtgttgtgatgagttaacggatttgttcggtagacttttgctacagcgttttaagctgtgttgcacagcttagccgttcggctgcacaaacacatggcgcaggaagctgctgcttgctgctagatgcctggttgtagtgcaaccacagctaggccgtatgaacaaatccaataattgaacaagtgaattcaaatgtaaaacgtattccctagagagaaaaaaaggaaaatgtaaaatagagttgttctactagtagtggtgtactactcccctcttctcaaaataaatttaatatttcactcattatgcacgtacgaacaaaaataaaaatagtataatatcccactttattaaatcctaatataattattgttgtttttatctattttcaatgtatttatgtcttactatacaaactttgatatgatgaataaataattaaataaaaaattattttgagttaaatagatggaaaaagtcactaacatcaccgagcagtgagtcaaagacatcacagaggtactcaaaccggagtagcactgtgctattcaacggtcaacctattgcatagacagagaggcgcaagcgcaacccaaatcggatttacagaaaaaccctcccgttgccgttgcctataataccgaccttttcccaattattttatctatttatttatttttttaaaaaaaacctgcggcgtccaccaacccaaccctttttccccaagtcgacacgcgcagccaagagaggcgaagggcgcaacgcaacgcgaacccctccttcccccgtcgcgcccaaccctaacccgcctcccctccacgtagatccaatcccgccgccaccgccgaaccctagcccgccccacctccctccccgccgccgccggaggcgcgcgcgcgcgcgatcggcgtcctcccgccgccgcgttcgtgcggggtggggttgggaggaggaggaggaggaggagggcccgacggcggctcctctcgagacgggggccatggaggcggacggtgccgcggctgcggcggcggcgggggaggcgagcacggaggccggcgcgaggcccctggcgccagaggaggaggcgctgcggcgcaacaccgactgcgtctacttcctcgcctcgcccctcacatgcaagaaggtgtgtgctcgttctctctcgacgattcgtcgtctcttttccctcgtatataagctggtttggtttttggggcggggtggtaattcgtcttttctcgattggagcttagaatttgaattccgcacctcgtttcgggaatcttgatttctgagctaagtaaacacgaatttctttggttcaagatggaatcttttcatatggctattccccctcatccaagatgtgatgcttaatgtagataacgtaataatataagttcgtagtgccttcaggttcggggtatttgttgcctcttggtgttagcccctgaatttttcagggtttctatgctaggtcaaattctgaatcggctctataatttaaaatttgaatggtatggttgtcctgaattgatgctccttcgggtgaaaagtgaaaacaatgtaatttactatcgcatttgttcccaatatatcgctattgcagtggctacatggcttttagtagtacggtaaggtaggaattgtaatgcttcccttgtcaccaggagcactataacaatatgttagtatccttattagtctagttattcaagatcattgcttcacaatttttttgtttctctttgggaatccttgctcggctcagaattccatttgcttttagcccctctattattttggaatacgtatgatgctgtactgatttagttctggagctgttctgatgaactatggttaaattagagagaggcaaaacgcttgccataaatcaaatctgtcacacaatctgatgtgttgtaactttgtaatcttgtttgataatactatcaaaattatgctacattaatgcaaatatgtgcaattctctatatataaacattaatgtaacactaaaaaaatgctacattaatccttatgggcttttgtgtcttatttaccatgaatattttgtccatcatggatttgttactaacttctagcttgaatattttaattgataatgattctttttgttccttacatcaggggaacgaatgtgattttcgtcacagtgataatgctcgtatgaaccctagagactgctggtactggttaaatagcaattgcttgaatccaaaatgtccgtttcgccatccggtatgtccctttccttcctttttccccttatgcactggtattatgtttttttatcaatacttgccagcaagcagcattgtctaagactagtaaatttgctgttatgtttctgttcatcagaaactaacagggtgtttgctcctagttattaagcttaatattatttggtcattttgtccagtgaagttatttggagtctaattctgtcttctacttttacccagccaattgatggtatgtttggtgctccaactactggaatgcctgcagtttcttcacactacgctccatttaactctggaaagcagttggttccatgctattactttaaaaagggaaactgcttgaaaggtgacagatgcgcattttatcatggaccacaatcagtgggaaataatccatcagaacaggtggtaaaagtttcttccttacctttggagcagcttcagactcaaaagaatgatttgttgggcattaaagattctgtgcagtctactaattccattcagcatggtgctccaataactaatgagaggggcaaaacagccgttgatcggtcaacggttaattctgccaggacagctacagttgcaataccggttgcttccaatgcaatgtcttgtcctaagtcagagaaggtaaaaagtagtacgccagcagcacttaaggaaagcttcactacttcttcaggtggggatcatcctgagtgctaccagaaccattttccaatggatagtgatcctgtgcgagattggaaccaaagttatgaaatgccccctgcagatgatctgccccagaacagtagggaggctgatgaacttttgggtgaatcttcaccaggttttgatgttctcgtggacaatgatgcagatggtgctgcttatttacatgatgaagattttggaggagatatgtatccagtggaagattatgaatatgctccagctgattttgatgttcgtgcacatcatgaaagagagcggttcaatggtatggatgagcaagaccagatgggacatatgtatgatggctacgagagaaaacggcgtagatcatctgagaggagcatggaacggcctttccactcagaaagaaggtttctgcaaagagatagagaccgtgtcgagatggatggatcggatttacgtcatcggctccgtaggagaagaataaatgagtcttcattggcaattagtccagaacgcaatggagagcaacggcggagggatgagcgctacagggaaagggcacatggtcaccgttcacacagggatcatcaccagagctctcgaggaagcactcttagctctcgtctgcaaggcagaataaagcttcctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaa

SEQ ID NO: 37612 - DNA, 16912 bp, Oryza sativa
agacaagatatttcttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattctcaactcacgatcatctctatctctactaattgaaaatgtttttgctagtactttaatatatcatccgtgtatgagtcggtttttaagtttgtttgattttggaaatacacatccgttcagtcgggttttaaattcgtttgcttttaaaaatatcgaaggagtcatataagatatctctttaaaaatctcacatgctaacttgagatgatcaaactcctaattgcaactcatgattttctagaaaaatatatatccaagccgcgaattcctagagtgaatatcatcttaactaataaatcgtataacaacaataaattaaagagtaacgtgtacgaacattccttaaacttgtaggggtgtgtcatctaggtccctgaactctcaaaatacatatccaaatcctagaacttgtcataatgtgttatctaggtctcaaatcgtcataaccccttcaaaaatctacgaggcattgatgtgacatgccacacagacatgacatggcattattttttctttttctttttttcttctcttttttcccatttattctcttttctctatgacccgtgtagaaaaaaagaaaaaaaagaatgggaagaaaccgaaaaagaaaaataaaagaagaaaaaaaaagagaaaaagacatgtcacgtccatgtggcattgccacatcagcgtcacgtaggattctagaggggatgtatcaatttgggacatagatgatacactttgacaagttatgggacctggatatgtattttgagattttagagacctttataacataaccttacgagtttaaggactgccaatgcactttactctaaattaaaataaccttcacccgttgtaacgcgcgagcttatttttttctctagtcttaattagtatcttttaaatatactcgtgatcgtgccgcgcctactggatctctgcttctgaccaaaatgttccgcattgaatcatcacaggactgaaaatcaatcctcgcaaaccacgagattatcagtatattaagtctcctgggaagctcacatgtatacccttgcaaactgtactgctatatgctaaattatctgcctgcatgatcattgaacgcaatcgtgagattctatggccttcttaagagcaacaaatgcacacctttctggacggggaaaccaacaaccaaatgcatatattgttgcacatcatcaaatgcccttcaaaattgtattagggcgcatgtgtatttcttccgttagatcaaaaattacaattcaaattaaaattcaaaaagagagagagagagagagagagaggattgagagagtaatcctgaaatgcaatgttttctgtaaaatacaatcggcttgtggtttttccccaaagaaacaacattggatgttactcctaattaagaatttcggcatttagcaagtactaaaaaataccagtaacaatttcattataaaaaaagataggataaatcacgatcgcaaaaactgaaaaagaaattctcaaaagaatgaaacagtttgcatcatgagaagaagaagacaagaagaggatgagccttcagtggcatatataaaaactggattactactgtactactctcagtctctcggcttctagactagggaagctcaccaacccaagaacaagaagtgatcggagatggctcccaagaaggtgctcctgctctgcggagactacatggaggactacgaggtgaggcaaatcttcctcttgttccgtgtcttgtgtgttcgattcgtgtcctcgcgattccaatggggttttcttggaatcttgtggatcaggccatggttccgttccaagcgctgcaagcgtacggggtgtccgtggatgctgcctgccccggcaagaaggccggcgactcgtgccgcaccgccgtccatcaggggattggccaccaggtacttggaatgattcgattccgctcgatttggatagggtttagtataactagttagggcttggtctgatgaattgaacatggcggattcccattctagagtggtcaggaatatcttcgctttcttgcctttgagtaattttaggatgtaatttctaggattaatacacatctgctcatcgcaattggcagaagggggaaagaaaaggagagtacacacagtcacacaacgggacagggaaaacatatgtgcaactaggtttatttttgagagctcataatgaaatgacagatttcttggtatgattgatccattagctttatctgttattctttctattctccaaatatctggtttagcattgcgagataagtttgacggaataatcagtcatgagcagaaatattccttaactgtctacaaaatgggatagctcttctgcatgattgaatggaaaaatcatttgaacattttggatactgaatatacttagacagccattcttatttctttcgtcacttaagtgaactgttgattggttcatgatttgggggttaactgttgctgtagagatttcttataaattcatatccttgtctgtttcccatattattgcattagttcctgcttctctttagatggtgttgcttctttcaaaactaatttgggggtcctctttgtctactggactactactccctttagtaatggaatctttgttttctctgaagcactcgattataaggatcgtctgtattgttggttcttttaggtgtgatagtatggtggtacttttcgtctttctaacataagtttgctttgacaaattaaattagattcattttgattcatcatgcagacatatgctgagtcaaggggccacaatttcgcacttaatgcttcgtttgatgaggttaatatcaatgaatatgatggcttggtaattcctggaggccgtgcaccagagtatctcgccatggatgaaaaggttcttgatttagtaaggaaattctctgatgcgaagaaacctattgcatcagtttgccatggacagttgattttggcagcagctggagtagtccagaaccgtaaatgcaccgcatatcctgctgttaaaccagttttggttgctgctggtgctaagtgggaagaagctgatactatggacaaatgcacagttgatggaaatcttgtcactgcagtggcttacgatgcacatcctgaattcatcagcctttttgtgaaagcgcttggaggctctgtaactggctcaaacaaacggatattgttcctttgtggggtatgtttagggaaatttcattcaattgaattcgtatgactactttcttattttcttcatttttcataagtcataccatctctgctgaacctctttgcttaactacatgcttataacaggattacatggaagattatgaggttatggtaccatttcagtctcttcaagcccttggttgccatgttgatgcagtttgccctgacaagggtgctggggagaaatgcccaactgccatacatgactttgaaggtgaccaaacatacagcgagaagcctggtcacgattttgctttgacagcatcatttgacaatgtggatgcatcaagctatgatgcacttgtaattcctggtggacgggctcctgagtaccttgcactgaacgataaagtcattagccttgtgaagggcttcatggataaagcaaagccagtcgcctcaatttgccatggccaacagattttatctgctgctggagtccttcaggtacatgataatgattaattttctaccattgctctacattaatcgtacttacttgattacttctatacctagtgttggaatataaagtgaattgtccgtctttcctcatcagcttaagcttttggattgaactggtcggtgcatgcaactcaatacctagcgataggaaaatttaccttgaacaaaacaaaaataatgcaacaatatctattcttgattaatggataattaaatgattaaatcattcctgcaaagtaaaagcattttcatagtgtggtaaggtaggcaacaagacgtactattacagtatcagtatgtcactatccttcttagcgtagttattcaggatcactgaattgcttccgaaaatctcacacaaatggacacaaacctgtttgatgcacgcagcgatgctccccagtctccctaattgtggatgataatatgatatgcagggaaggaaatgcacggcgtatcctgcggtgaagctgaacgtggtgcttggcggggcgacatggctggagcccaatcccattgaccgctgcttcaccgacggcaaccttgtgaccggcgcggcatggcctggccacccggagttcatctcccagctcatggcattgcttggcatcaaggtctccttctgaagcaacgagaggtcaggtcccagcgtttttgcacgcgatatagcaagacacagctttgggctttcgtctaagatatatacagtcttaccgatactgtaccagtctgctgtcgttttttgtgcttgaaataataagataattactaaaagggtttgcgtgtttatagtattatgtctgtacgagcagaaggagctgcacctggggattgcctgtgtatgatatgaactgcagttgaatttcatgagctctcgcctctcgccgacctgggcagtacttcttgggccgtgcttcaccgtgcggcccactaaagtcagcccatcaccgcgagagcgatcggagaaggaaaaagtccaacgctactccctaagactgagtttgaggagaagaggattgagaagattggaaagatacgtaaaacggggtgagccattagcgcatgattaattgagtataaattattataaatttcaaaaatagattaatatgatttttttaaagcaacttttctatattttttttaaaaaacacaccgtttagtagtttgggacgtgtgcgcgaggaaaacgatgtgatttctcactcaatgtcacttgaacgaacgcagccatataggttgaatttaatttgtatcccttgaacgcagctatgacgacttcttaaaccggtataaaataacttcaaagtagtattgaaggtggtattcactgacggcatattgcccttggtcaaaccacctgagttggctgttctcctctcctctgatctccatctctcagggcctattcatttttttttaaaaaataacacataagaataggagaagtgaaggaataggaatgcatgcgaacttcaatccataggaattttccaattggtcagagcggatgaatttttttatgttttctttttataacttgtaggaaagaatttttttgttttcctatatctagatttcttcgaaccaaatggatttcatagaaattaatccttagaaatccaagtcctttgaaattccccttagaggctatggcgccgggtccttctccctcttgctttttgtacctttcttctcgacagacgtccaccaccctttcccatccctcctctttctgcaggctacagagcttgcagagcttcttcgatcgatttgctctttataccatttcctccgtttcgtaacgtaagactttctaaaattatccacatttatatagatgttaatgaatctatacacatatatgtgtcttacattgtaaaacggatggagtagtcattctagcatttcccatattaatattgatgttaataaatctagactgtgagaaatgctagaatgacttatattgtgaaacgaatgaagtaaaagattttgggtggatgtgatacattctagtccaaattagtacaaatgaatttggattatttttagcagggagggagtaacagagtaataatagtcacacctatgtataaattaatcgtctgaaactctgaatcttcctttcatttcatctccaatattgcaaaaattaggtacggcgctgttaaggtttgggtaaagcgcatggcaccagcgccacctgccgatcgatggaaccaaaagcggcaggaaatgagataagcagagaaaggtcaccacgcaagcacgcactacatcacgtatgtgtgcctgctccaagctaagctactctttctagctaagctttgggcttaatttgccggcttttcgctttttcgtgaacgcgcaaaaagattgcacctcaatatattatgccggcttttcgctcatgcgcggcaacgaaataaacactgaattgatgatgatgatgatgatgatctgaggctgctaatcttgccacctaattttgcctcaagaaaagctcgccacttacgctaaagatggcgacgaaacggcagctccgagccctttaatcctagcgtgcccttggcctttctgcgctaccgcttcttctaccttatccttctcacacgccattcttccagaaaacataatgctattcttaggtcgtgatgttcagttatgtttttgaaaaaaaaaacaaaaaacataagtgatcttcagttacgttattacgtcccctgtaactgtaagctgatgaagcctgaagaacctctcgccaaaagatcgaatatggtgtgtaaccgcttattgtactttctgaagttttggagcattcaccgacgaatctgtttcactgctcctaactgttactgacattgatgttacactgagactggactgaagacgtggaggctaattacctaaaaacgcaaatattagaaaatgacctaatatcaaataaatataagatgtgagatttcgaacccaagccgactagccctccttatgaagttagccggaagactgatgggcgtttctccgatctggaggcttactaaagctacacataagacatagctctagctggctctgaggctggccctaaagatggatgatctaatcccacacacgcaaacagctttcatcagagggagaaaccttcatgaaaacttcatttttgtcaaaggtttggcgcagcaatttcacagaaggaagaaagacatgatcttgctcaagctggatatatctaaggcattcgacaccgtttcctggagtttccttttggagatgttagaattcaggggatttggtgctggttggagaagatgcctgtctgctctgcttctaacggctgagacaagtattctgatcaatgggatcacttctgatccggtgaagctggcgagggggttgaggcaaggtgacccgctgtcaccccttctttttgtgttggttatggatacgcctgaggctatcatgacccaagccaggacgacgggattgctctctcctctcaatgctgcgagatttttgcccagcacttcagtgtcttcttccgcccggtgactcaggaagcgttggttattcaggctgtgctggatctgtttggggaggccactggattgaaaacaaatctcgcaaagagtgccatcacgccaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcacccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcctttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtatcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatgattcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccagtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagttccgaaagatcttgtgtgtgcaccatgtcgtcatgggaaaatgacatcttcttcccacaagcctgttacaatggttatgacagatggaccgggacaactgcttcacatggatacggttggtcctgctcgggtccagtcagttggggggaagtggtatgtcttggttgttgtggatgatttctctcgctactcttgggtctattttcttgaatcaaaggaggaaacatttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaaattctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaaccaacaaaattgtggagacttgtgaagtcacttttgatgaggctagcccaggagctagaccagaaatttcaggtgttccagatgaaagcatctttgtggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaaatcataaaaataaaagtcatgagaaaagattaaaagctcatgttctatgctttgttatcatgttgatactctttatgaactgggcattacacattagcatgggttcattgctttgtttatgtaaatcttgcatgattatgagctggtttgcttccttttaagcttcttctagaaatagctttgcacactaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcgg

SEQ ID NO: 37613 - DNA, 12859 bp, Oryza sativa
ttccgcttgcaatttgaactttgcgtgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccccccctctatagctgttcttggtctttcaccaatacagtgcaacccgtcgcagatacaagctgtggaggctattttgcattgtcaggttcagcattttccaattacctacctaggcctccctctttcaaccagaaagccgactaaggcggagattcaaccgattcttgatagattggctaaaaaggttgctggctggaaacctaaactcctctccattgatggacgcctctgtctcgtgaactctgttcttcaggctttgccggtgcacttcatgacagttcttcaattgcctaagtgggcggtgaaagacatagagcgtaagtgtcgcggtttcctttggaaaggccaagaaaaagtcaatggtggtcactgtctggtctcctggcgcaagctctgtatgcccattgagaaaggcggcctcggggtgatggacctagatctgttcgggcaagcgttgaggttgaaatggcatgccaagagccttgagcagaaaggaaggccgtggactctggtttcctaccatctgggtagcgacgtcaatgctatcttcaattgagtggcggatttcgtcatcggcaatggaactgacactaacttctggacgtcgaattggacgggaaagggaggtttcgcttggagatggcccatcctgttttcttatgttgggagatcacgtctgacggtggctcaggcgatgatcaatcacaggtgggttcgttgtctgctgcggccctatgcgagttctttcagctctgggacgaggtcagaaacaccacgctgcagaatggtgatgactctatccgatggaaggtctctcccgacgggcaattctcagcatcggcaacttacaacttctttttcacgaccaaagaggactgtcctgtgggcgacctcttgtggcactcaagagcaccttccagggttcgattcttcatgtggctagctctcaaaggaaaatgcttaacggccgacaatcttgctaaaagaaattggccccacgaggatcactgcgttctttgccaaagagaagaggaagattgccagcacctgtttgctgactgcagctttacctctgcggtctggggattgatcaggagcagagtgaatttcaacttcccgattcccaccgaggaaaactgcccactaatgtgctggtggcttcagccgagagcccgttgccgggtaagctacaggacagattttgacagtctagtccttcttacttgctgatcaatttggaaggaaagaaacgctaggatctttgagcatcgttttgaacggcgaaccatctagtggaagacataaaagaagaagcgttgatgtggaaggaagccgggattttttcccaagagtgcgagtagtcagtgtcccgtttgtttgttcccctaggctgaactctgtttcggctttcttccccctcgacatcctcatgtcgatgtaaatcttgtaatttgtaacttattttttctcctatcttaatgaaattggccggccatcctttggccgtcccggcaaaaaaaaagacacagctctagcttgaaattaatattcagggattctgaaggtacgcacaacacatgcaggatcacagatcgaattgcaagtgggttattggtgccggacatggtccaagatggacctctggctagctagccaaattatatgccatcaatcagaccatgcattcacgggcatattaagcaccaaaatatcctactcctatcatcatccattttatgcagatccaatccaccggcctacggaatattgcattattggtaataaagatgcagtcaacatctagctgctgattgatcattgctgatgagacatccagcctctagaaaactgcaggtttatcaatcaatgaatatacattttgattgcttagaatctatgataatatactgtacaattgacaaatccaacacataactaccctacggttcaagatcccagcgacaattgactgaggacatataagtttcgatacatttatcgtacacatcaacttaaaaaactgacacaagaaattctaaaaaaaacatatatgtacttctaatagtattgcacatatatgtataaagtctaaacttcatattacaaatgacagcagctagccaacagaacggtttacacttcagctgcacaaattacagttattcgaagtaagtgttacatagaggtaaattgagcagaagagttgcacacatagtaaatcattcagagtaactgcgataattggtagttgcaggaggatctatcacctatggcatctgtcaacagagttacctgggcgtcgtcatgctggatgctacccgtgcagatcagacaaacaacaagaacaggctacaagatacgcaacatgtccatacatatgagtaatgcaggccccagaagggcccttttcgttacaaataaactaatccaggcacctaccctatgaatgggatgtaattcggtatatgcaatcttttgaaacttccttattcattcccctgatatctttagattagaaaagccacaccatatcgttgtcatctcatacatgtctgattgttccccttgctgaaaagatatttggaaagttaacaaccgagaatgatgaacctaatctttggtagctaccctttctgtgtttttcttcaggcacatggtaaattgcctagaatattcagtgttagtactccacccagtccaactgatcttttaaaaccaacttatccataggaaacatgttctttggatgtggtaaaatacgcagaaaagcaaaagaccttcattaacatcctcatctgagcatctaaaagcaaggaaagagagaggttgcatggtcgtcatttcatgcgttgcacatcttacaccactaaatcttttgtgagcctttgctatcgcagttcacatttctcattgatgagctgaaaggtatggaaaccgaataatgctcttcaccggccgtcaactgggccaggatgaatcattcattcacatcattcttctcaggtttttatcataaggattgttactgcactggagtacccttcctccctgataaaagcagggaagatccagatggaatggaacagatgatagctgatcccaaaacaaaacagaagctgccaagttgatcagatacacactacataccctgttgtcggttttaacagataaaactctgaattcagtggaaatttccgctgttagacacagaaaaataggaaacagggtcgaaggaatatcgtccgtcacataaacgtagggatattttcgtctacaccttataaaaactcttgtaagtagtgtaccaggttcctccacccaatacattgatcccattcttgaactttaagatttactaaaacataaatttgtggcacagaatttcgcataagcaattgaatccgtgtgatgatcatgcgaggaagttaatgggtccaaacctgaaaacctgcatctctccggtgaaaccggccgcgggattgtcagctcaagaactcgttaacagcaaatgctctctgtcccgggacctgaactgagctaagcttgctgctgaattgtgacaaccaaaacaggtgtatacagttcgtggtgggcccactttgcagtgatatttttgcagcttgattgacgtggagagaatccggggaaggacgtgggccctacacagaaccaacggacaaccgaaaccagcttccctttgccttccttcctactagctttgtctgaattttctgatgctgctctttcgtctctcacgctgcaagcctgcaactgcagtatggagttgcacaatttgcatttgcacaccctccatcttggaatttggaaaactattgctgataacatgaatcatttcgtcttcatgtgagcgacgctgatgcattctatcttctactgcagtgactgcctcactgcaggtacagtcaccgagagaatcatctcgcaacagctaagctaatctctgaacgtgccgagaaaacacttagagactattcttaccttacgtggcattcatttttctatccagtttctttccctgctaaaactacatcaccatctaaattgaaagcagctgtgttgattcatgaatcagctaaaaaatatcatcgatctcgcgcgtgggccatgacaatcaatccaataattttgatggtggtggggtccggaggcctgcactttgcgcctcctcctcgacaaaacagctcgatcgatccatcaagagccagatgcgatcaatcatacctgcaattaacgtacaacctaattcccctttatatatggctataatcagctgcatcaactgccctggcatggcaatcgctgtagccgatcgccgttgctactgcgattgcctttcttgtttcctctactcttctgaagctcatcgcattttttttttcagtcggatgtgtacagatcacctaatgctaagttaaagatcacagtaaaatcactttttggaaactagctaactaattacttcatccgttctcgaataattgacactagcagtactattcaagctcaaatttgttttttcctgaaatttataaacacctaagggtgttatattagtcaaagtaagatgatcgtagtcatcagtggcagtaattcgagaaacgagggagtaaacaattggctcatatgattggagaatcattgtcatacatgtagcaatgaacgcatggattatacaagaactgaaagaggcagtaacatgctgcatggcacactaactgaaagtctgaaactctccaagagaatacactaccacatcgagtccagaaagcctggctgtccttttctctcccctagaatataccagctaatagatagcacaatttatcaaggaaaagcaggggaatataccctaaatatggagatccccatggaccatgcatgtctggtctacttgccgaatgtggagttgtccgtgtacgtctcggccaaccaccgggtctctcggctactctggagggccattttcttctgcagcttatggtgtctttgaaaccctctattaaacagcgcgttagccacgtggaacgggatgattcattaacatgtaattaattaagtatatattattataaacttaaaaatagatttatttaattttttaagaaaacttatatattaaaaaaaacatatcatttattagttcagaaaacgtgctaatgaaaaataataaagctgtagtttggagttgaagtttagaattcagctgacacaaataaggcggtatgtgaaaattactccagaaacccttgtgattaacaggcagtataatctagatttgacaggccttacattgctcgtggttgatgttaaatacagtactgaagaagtgttctctgtttgtagtgcattcgtttcatactggaccatcagattggctattctgtcactggtgtttgtctgctctgcagcttgattcttcttctcgtccggagaaaaaaaaactgtcacaatacaatactgtgctcttcaattttttttaaaaggaaatgctgtgctcttcatggtacagtatcagactatctacgctgttgctgacagtaacaaaggagcacatgcaccatgcattgagcccagaaaccaaagcacacgtgtcatggtcagttagaagctttcagaaaaagctgtgcgcagccttcgtaaaaaaaatgcgatgtgaagtctttcattctgacatggtcctacacaacactgatgataatgcacgcgtaaatttcataaaattaaaattatgagaaaactatatatttaaatcaatgtatcataaagtatataattagaactaaatttatcaccaaacaacaaatttagcaataaaattatcataaaaattttatgtcttccaccaagtacaaaactacaacttttataattaactttatcataacggtactgctagatatttaaacaatgtgataacttcaatattaaatttgtagttttgaaatacttgatcttaaatatataggtttacgataaattttgaaatacttgatcttaaatatataggtttacaataaattttgtataaagcatacctataattttataatacaacatattaaatatatacttttacgataacttaatcaacttccacacagttttgtaaagtttacccgtaaatcacaatgcatgcaacattgcaacactccaacacacaggattttcagcatcacattttttttaacaatgccgttgtattttggtttggttgtgagaattcacaagagccaagaactctgcatcgttctaaaaataattacaaaaaaactctgcatcgacggagagagtgagagtggatggaccacatggacaggtgcccatccagctcggctgttcaagccggctcgatctacgagccggccgtgtttcgaaataacccaaaaaaaagaggggtcaaaacgcaaaaggggcatcgctataaaaccgcggctccgcgggcgccaatccaccgcatcatcggcttccctccggctcgagccaatctctcgctgtgtctctctcgcgctctccactagcaccggctcggctcggctcgcgcggcggcggcggcggggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattgatttcaatatttaacccagaaatttactgtgcggtgcattcaggtctttttcttcgtcacattgatgggcaaaatgcctctcccccttctgtcattgtgattggtggagggatttcaggcattgcagctgctcgtgcgctgtctaatgcttcgtttaaggtaaatgctgtcattgaaagatgaaataactatatctctgtcttctatattctattagcttattgtccaaaaataagttaatgttttgatgcttcccgggccctttttcttagatacttttacataactacaggtcacactattagagtcacgggaccgacttggtggccgtgtgcatactgactattcttttggctgcccaattgacatgggagcatcttggttagttgcatcccagaagtagctattttcgccgccttgcaacgtgtttggttttcatctcatggttttatcatgtggttcaggttgcatggtgtatgcaatgagaattcattggcaccactgattaggttgcttggccttagattatatcgcaccagtggtgataactctgtgctatatgaccatgatctggagaggttaggagttattcctaacccataagtttatcctcaacttgatgggctttcattctcttacaattgttgtttttgttcatttagctatgctctctttgataaggatggtcgtcaagttccccaggagatagtgacaaaagtcggggaaacatttgagaaaattcttaaggaggtattgtcatcgtttgcatttcatttgttatccatcaaatgcttttatgcaactcttgtgagcttactttgttaatattgcagacggtgaaagtaagagctgaacatgaagatgacatgcctcttattcaagccatctcaattgtgcttgacaggaatccacacctaaagtaagtggaatttagcattcacctatatctggaatggtggtgctttagcgacggggtgaaatgttctaatgatatgcattcactcttacaggcttgatggtttgcaatatgaagtactgcagtggtgcatatgtaggctggaggcatggtttgccacagatgtggataatatatctctgaaaaattgggatcaggtatgcaatagggggcacttttgtatttacatgcgcacatgaagaattgttgtattcacgtagagcagtggactgacctttcaaatttacaggaacatgttcttactggtggccatgggcttatggtgcatggttatgatcctgttatcaaagctctcgcgcaagatcttgatatccacctgaaccacaggtatgcagttacatatcctcatggccaagtaattcacataagttctgtttcataggtttcatagttataatcccaaatctatagtatcttatctcttaactttcctccagggttaccaaaatcatccagaggtacaacaaaactatagtatgtgttgaagatgggacaagctttgttgcagatgctgctataataactgtccctcttggtgtacttaaagcaaatatcatcaagtttgaacctgagctcccagattggaagctttcatcaatatctgatcttggtattggcattgagaacaaaatagccctccgcttcaatagtgtattttggccaaatgtagaagtgctaggcagggttgccccaacatcaaatgcctgcggttactttcttaaccttcacaaagccacagggcatccggttcttgtatgcatggtagcaggaagattcgcatatgaattcgagaagctatccgatgaagaatccgtaaactttgtcatgtctcagctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattg

SEQ ID NO: 37614 - DNA, 673 bp, Oryza sativa
ttcgccatcgctgtcgtgttcgcgtggaagttcctgcggtcgtcgccggccaggccgcgccgcccccccggaccgaagcggccgctcgtcggccctgctgcccccgattccgccgctcgcgatgcggccgacctgccaatcctgggaaggttggtctgatcctctgattggtgtgatgatttttggataatatttattctaggttctatttgtttgtgggtttttcaacccttgattggattggggtttgtgtgtatggcagctgacgacacggcaaatcgtggtgaagcgactgggcgggtgtagaaaggtatggtttctccttgcgccttgtcatcagcgggttgatgaaacttcgatgatgtgatatcaattacgcgtttaagaaataaatgtttaatttgcctatgtggcagctcattgcttgggtttggcatgcctgattgtctaatgttgagataaattatatttgagaacttttggaatttagcttccataaatgtacaaccacacgtgtaaaatcttggatcaatgagaagacaatggcttaaaatgcactggttccacctattgatcactaattactacagaaagccgcattaacttatgatgcattactacctgtactatgacgggacaaaaggtaaggctgttgagtctaagttatcgcatg

SEQ ID NO: 37615 - DNA, 7391 bp, Oryza sativa
ctatatcaatataacaccaaaccaatctgtttaggtgtttgaaaaaatcatccaagaagatggcaagcaagaaacggcggtggtggcaccggcgcgccatctgctcgatgccggtcgcgcgcctcgaaactgcgcgcgaggcggtcaaaattactcgccacttgcgtttgctactcatggccggatggtcggcatggctcacgtggctgattatccttttgctgctttgcggaatgcggatttgcttatcgccggagattgatgagactgcatcggtttcggtggcagatccctcgccctagagccgtacgcactgcacggcccagaccaccgatcaagatagtactccctccgttccaaaataaatacaaccatagttttccgtgtccaactttaaccattcgttttatttaaaattcttttgaaaaaaattaaaaaaataagtcatgagtaaagtactattcatattttatcatctcataacaacaaaaatactaattataaaaaaaattaaataagacggacgatcaaagttgagcgcggaaaatcatggctgcaattagtaaatctcattgtcatcctggcctgtcgaatcttgatcggttggtgagaaaaaaaaagagatctagagcaattacaagagtaggctataagttagttgtaaacacatatgacacatatatagagaagagaagagaagaaagagaaagaaagcggactacaaatttgtactcttgtcaactgcagcacgaactctaatacgttgtgtgtgtataaaaggtgcagtgggactatatattaatagtttatagataaatattgtatgaatgagctattaaattgactatagatgatttgaagctagtagttggctatactattaaacttggtcttaaaaggagatagtccctctaaacatttattaaaaataaattattcgtgtattgatgattgaacacaagatttcgagattgaggggttgtttggttcaatacttcaacttgccacaccacattttaggctgccacacctccttagccttgtgtttggttcattgccatagttatggcaagccacactttcttaccatcttacctcatatgtcatagacttaattctttgcctaactttgccacaagtgtggcttataatttgtaggccacaaaagtgtggcttgcataacattgtctaaagtgagttatggtaacgttagttaagaaccaaacagcccttgaaaccacatattctctccgtccctaaatataaggtattttggtaggatgtgacacatgatgtgacacataacacattctagtatgttcatattcgttatattaggatgtgtcacatcctatcaaaataccttataattagggacgaaggagtatcttttatcactgccctgtctagtgcatctagatcggtcggtgagacgactgtatgcacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgtcacaatattctcgagcagatcataggatcgaagagaatcgccacgtcagtgaattttgttgtttactagtgcagctaaatgggatccgtatcaggacgagccaatgatgcaatttccaattccgtagtcgatgtcaacgaggtttgattaaggggagtagtatttgctaactagtactagtatatagtagtattagtcacgcaacatagttgaattcttttaattttgggcggtcaaagtaatatggtttttaaactctgaagatgatgtgcttgcgtctggtgatcttgttactagtttaatgaagccatcggcattgtcaaataccgaagtagtcagctcagaattaagaaatgccgagacattctgttcatggtgagctactattcggaagacccgggcttagtgtctgggttcagaaaccctccggagctggagagatttcatgagatattcaatgggattttgacagcaacatttgctcaaaagaatagcgaagcaatcttgacggttccagtttgaaatccatattgcattttttgtggtttggtcgtgtcaagcgcatctgctggaaaaatctgaaatgtagcaagtagactagacattagagcatctccaacagtctctccaaatctgactctccaaatgtctatttggccaactctccatctaatttatcaagtcaaactcgttgtttactccaacagcctccccattcaccctctctattctaagtctattacagtgggacccacgcgtcagtgtctcaacctttccttcttctcatctttctccccctttccccaagctctgctggtctgcccccatccgctgccgccatctaccgccgccgccacctaccgtcgccaccatctaccgtcgccgccgccactcgggctccatctccatccactgccgcggtaccgccattcgccgctgccgctcgggttttgctcccatcactcgccgggcgctcgggctccgccccctccatcaccgccgtcgctcgggctctgtccccatccactgccgccatccgccactcgggctccgctcccatccgtcgccgccattcgcggccgccgctcgggctccgtgcccatccgtcgccgctcgacggcgagggacgacgaagactacggtgacgacgacggcgagaggggagaagccagcgccatcaagccgtcgccggcagtagctagttgcgccgattgcaagtagtaggaggtgagagagaagcatcttcaacgtggggcccacaaatagcaaggcatttgggctggccaaatttggccattgaggggaggagtttggccagtcatttggcttagccattctagtagagaggctgttggagtaggatttttttgctaaaatggctaaattttaacttggagagcctattggagagtttgttggagatgctcttagtagttttatactgatttcgctatcaatattattccagcaatcttctaaaaataaataaaaggaaaataaaggtttaaattgaaggcttcaattgactagctcctcccacaaatgtcagtcatatatttacagcctgtcaaggcccattcaactttggaaaaatcaaacatatttcaagtcaattatttttccactatggtgtaaagaaaacagtaaataagcccctacttccagataaacttgagcatgtgttgacaaattgaacactcaccgtttgactccaccacaatagttttgaatcccatgacaattttttttgcaggaaagcatttttttcctcattgggccgggacaacaacttcgaaggcccaaacaagtgctgtgcaattacccagtgggccagaatcaaggcccgaatttctgcatatgtgggctattcagacctgtgcactaattcaaccgtttggttttactcagactagacatagatattagcccataattatgccacttttgggctttaggcccactaatttttgtctaattatagaaggcccaactgcattaatgccaacctaataaacagatacactatattgtgtcctctgaaatctgaaccccagggaatttcggtaccatctctggaaataagctatagaaatattttgaattatatactttaatggcgatatgagctaatgagcagcataaagttataatatacgcgtactaaaatagatggcgaatcaagtcgttcaaaaccaccagaattattgcgatcgagaacaagtgcaatcgagagaatctgatctttgctttcgagtcaacatgaatacggatcccccccacgctttgtgggctgatttctgacgaaatttctcaaaagaggaacacactgcttgatgggaataacaatcgctacaggcctacagcgcaggcgaacacatattcttcccccaattaagtgatgatctggcagtttcctcgtttgagccctgggagttattccgcaagactgtaaggctgatggcatcatcaccacctgcttacgaaaaccatttacttgggatgctaaaacttggagtcactaattatgcatgtaaatatttgtcaagtttagctaaagatttacaaatagatttaaataaatatatttctccttatgtgtttaattaagttattaattaattctgtgcctttttttgtattttttatttgctctttgtttagtgaacattgggcctgttcggctacactcatgcggcggtggtgcaactggccggaacaatgcttgtataagcagtttgtggcaacaataatgttgcagcagagccgaacaggcccattggctgcaataagtggttgcaatttatttgaacaaagatcaggatttgtttctttatagaaaaaggataaaactatatactcgcagctgaaagctctagcctggagagctcctttaaaatataggaattttgtttgataagttatgttctatattttctatgcaatttattgcattacaaacacggtgatcatcctaaagagctaaaattaccacattaattacatatatttttaaagatattagatcatgcaggatctaatgttttttaagataatgtagattggtagttaggggtgggcagaaaaagaccgaaccgaaaagaccgagaccgagaccgagaaattcggtcctaggtagtgaaagaccgaattttattcggtcaattcagttagtctcctcgggtaaccgaatagaccgaattatcaaaaaatgtctaaatgcaacctacaatccactatgtttaataggattaaaatctaattttcacgtccctacttcttctaggcatgcaacctaataagaatctttactcataagtgcttacgattttttttttatgatttttgtgttgaaaatttccattatttctttgtatatatgaaaatattgttgaatttcggttaggaccgagaccgagaccgaatttgtctgtactaacatttttgcgctgaaattcggtcttcacttttcaaaaaccgaaaagacagaaagaccgaagaccgagaccgaaattttcggttagaccgaatgcccacccctattggtagcaatagttgtatgcaaagtacaattgtactacctccgtcccaaaatataatatttttttgctatgaatttggacacacagttattcagattaatagctaaaaatgcttatgggacatagggagtatatgatttcaatttaactagcccacgcaaaatcgtgcatggaagttccctagtttgaattaaattcctctgttataaaggaccatgatcatctctgacggcaagaattttttttgaattcaaaatatgtggctatttatatttatttcagatcccagagcaatgtactaccacaatgttagaggggggggggggggggggggaaaggagaaaaggacagctagggtggcatacatctccaatgatcacgggggtgaagtgaagtgagagtagcagctcacatctcggggagctggccaatgggaaggccggtatagcgggatgcatgtggtggaggcatggcctcgtttgcgtggagcttactttaggattaggattagcactagcttaggagtagctgctagtatgagtcaaccttaaactcgaaatgattaacgggtgatgataaagccgctccctaatgatgctgccccgcaactgtccagcaactatctggatctctcgctttttctctgcccctctccattactctatttcctcttcctcttggcactttggccttctttaatttattcagggtctaagatatttttgatgtgttttattttctacgactttaaatgtgagtagttgtcctagctcttaacacctttttaaaatgtaattctcctgggaacttctagttatttttcatctttttatcgtctctttgcttttaaccaaataaattgtactttccgttttaaaggatagcaatttctaacgactaaaatctaggaagtgctacagatcataatgtatctcatttaatttcttcaaatacttccctatttcaaccaatcataactatgttctatttaattttacactcatcactaattcttataaaaaataattataaaaatacttatattaattctaggatggatggagtatctctctttcccgacccatttttctgaattgtatcataaatgaaggatacaatcccatctaagttgattttaaattaattcttatgtgccaatgtaaacaaacttatgtttttaattaatcagaggcaacaaattttattttcggtgttagttaatggggttgcttttgtgcaacgtactgctagagctagagtgttaatgcctcctctcacgtcatgcgcggtggcaataatggatggatttggtggagtcgcgtctctttctcttttgtattcctacaacgtcttctgtacttaattctttccttgcgaatatactacgtatgaagcacatttttgggtgcaccagaaaacacctaagttatagcatgtccctgacctgccaatttggtaaacaaaatgtgcaaatagatttggaaatttccaagaaagtaaatgatgattaaatatggtttcaatcatcacccacaaaatttcaaaccagcaaacgacttggtaaccccaataaagtttcatttttcaactaggagtggctcattgatatctaagggctcctttgatttgaaggaaaaatatagtaattttggaggatttcaatactatagaaaaaaattcctatgaatgcctttgaatcaaaggattgaatcctattcgatccttcggaattcctatggaatggacaatattatagagattttggaggaaacttagcaagagctcaaagctctttgaaaatttcctttgaatctctctctcatatccgattcctacgtttttcctacggtttaatcaaatgatcattcctgtgtttttattgtattgtacaattttctattttatacttccattcatgttaaaatcatgtggttttttttattcttacgatgcgcccttaaaacccaccctatatatatttctcgtatcaatattagatttctcctctcgaactctaaattgccatgagatttatgactaattattttttcagtgacagacgacgcaccgaccgacatagagacatccttgatgaccttattaatatatacatataaagatatgttagttcaggctttcgtatatgctctagaaaagtttcacaagtttttagtttcaaatagacctatattatataactagtaactaagt

SEQ ID NO: 37616 - DNA, 2176 bp, Oryza sativa
ggctattttttaaaatttttttaaaatttttttaaataagacgtatggtcagaacgctaaatacggatatttatggctgtatttattttagaatggaggtagtaggttaatgttgttgctttaggggtaaccaagatgcatgcatgtcttttgccccgtaatcacctagcagcttgctgaaagtttaaggactgctccgtcgtgtcgtgctggccttcatgtagccactcatggagctttcatataatttatttatttagaggagacatataaaaaatgcattttctctccaaatccagcttgggacattctgaactttgacaatatatattatacactctcctggccgtacttatcctgggcaggctctaaccattggctgagactctgagattagaactcttaatctacttaattaattaaatgggatgcatgtgattgagaaaaaggtaattaagtaaatggtacatcaccatcactgtgtggacataagcactaaaagctgacgctaatggtagttaattatcgttccgtttgcaatgatcaagtctactagcatgcgactgcaacgtctcgtcttgttttgctctcttgtgttttgtctgcttgctgttcctgccatacaccgtattctactgtcacttggtacgtacgggtagttattttttaatgaactgtaactgttgttttagggagttgttagggaaaactgtgattattaagccaccggaagaaattaaagatgctaccactagcccctttacaaaggtgagataagctagactactggagggtagcttggggcccgtttggtagtgtaaatattttgggttgtggcctatgaacagaaagaactcgactggtgaacgaaaaataattttattttacagtaagacttttgtacttatatttaaaaaccaaagttaaatgatacaaataacaaaaaaaattattttcaaagttaaattccaaaatttaaaatttgttacggaagtactccatccgtccaaaaaaaaacaatatagatagggatatgtctacctaagacaataaatctggacaaaagattgacaagattcattgttctaggtggagttacatccccacccacacctaggttgttttttaagaacggagggagtacagcttaggtcgggttattttagctcatagcctatcaaccggttatttaatgtgtctatgctttgaaaagtgtgctttctcaaaaaaagaaatctataaccatatgtattgcttagataactttctgaactactccatccatctacttttgatagtcatatttccaaatctaaaaattttatttttgataagcatatttcacttcaacaacctatcgtcttgatgagtttctcggatttaatgcatgactcttcattcttccacacatgattggctacatgggcattgagaaacgtaaatatcaatgaatcgcttgtttacgaggaataactagtagcatgtttatatggatgataagtagaattacttattcttagtctgtgtgccaagatgaaatatgactatcaaaagtagatggagggagtattataaactttatgatgtataattatgtctatatatattcatgcatgagctttcgtgggtatttaggggatgtttagatccaggggtgtatagttttggtgtgtcacatcggttattatacaaagtatcgcatgtggtgttcgagcgctaataaaaaaactaattacagaatccgttaataaaccgcgagacgaatatattaagcctaattaattcatcattagcaaatgtttattgtagcaccacattatcaaatcatggagcaattaggcttaaaagatttctctcgcaaattagtcgtaatttgtataatttgttattttttaaactatatttaatactttatttaggtgttcaaatgttcgatatgatagggtataaaattttagaatgggctctaaacacccccttaagctaaaaacaacattgtctaaggtggtttccgcagccaaccgaagccacatacgatgaacactgtgaaccacacaagggaaagtattcctcttgtccggccggtatatatatatgtacacatatatgcctttttataactttctagcacagcgatgtgcataccacagaaaggagaaagtactttgagtgacgt

SEQ ID NO: 37617 - DNA, 1293 bp, Oryza sativa
ctactagatgaaatttgttagtcgctgtcaaaatggaagctgtgtctgctgctgctaagctgagtggaaatttggaggaaaagaaaggaaaaatccagcaggagggtgacaccgcggcgtacgggtagctgtcctgggggtgctggctgccagttgcgtcaacggcagatgcgatcaatgtcgatgcagagatgcaagttgcagcatgttggcgtgtcatgccgaaagaagaaacgggcccgcgtttaattagccaaattgtcacaatgcacccggcttcttcgccgtactatagtgacctcaaacgcatacaagaacaagttccatttcccatcttgctctctccaagttaatagtagtagccttctgtgtagtcaaaatttaaaatctgaaactttgattttaggattttttttttcttatcatagtctatttatcaaccataatttgttagccgctaattatacatgtataagttaatgttttacatatgaattattttcagttgcttcgtttatttatctttacacggctgaggcttatcacccgtagctcaaccaattagtgccgttaaaatttcgcaacaggatgtgaaattatattatttttttaaaaaaaaagattataagataaaggtaagattgtacagtcacactagcttgcctagtgttgagacatttgttagggccttagggcatgtttgcttcgtgccctgaaaaatttgtctaactcaggcacaactctcaggcgtccgattttgtgcgcccgcgactggatcgacctgcctgagcgagagcccccggaccagggcagcaaccaaataagcccttaccccttgcaagtgcttctttgcaacaatatggaatgtgtagcgagcagtgagaggaattttgcattggtacatccctggttcatttgggttgttaagacaacaacaatgaaatttagagttggtcccattttccatactgctccaagttagattggactactgactatactgtactagtagtctttcattgtctgcttgttgacttataagccacaactaattttagaattgattttgggacttttcaccatggtctattttcagccttaacttttaaatcactagttatgcgatataaaagtgttacccatgaacatttttcggttgcttcagttatttttctattgcttattagttgtagctcaagcgatcggggccatgagtaaaaatacttaatagcaggatatgaaatcaaactattattttttaaaaaggagagaaaagataaaggaaaaattatg

SEQ ID NO: 37618 - DNA, 3552 bp, Oryza sativa
ctgcagcccctgagtagtgagaggaattttgttttgtaaatcccttgttcactaacaacccaaatttgtaaatgtcattattattcataatactacttgccacgcgctactgaaattttataaagttaggatcatactactaaaattttgtaaaattagaaccatatactgatatggttctaattttatgctatttttactaccatggtattttaatatttatgtaaccgatgcaccctaaaataatggttattttcatcagaaaccaattaaagataccattgcaatcacccgaaaatatgcatagaatccaggcgagaaaaaagaataacacaaaggttgagaaaagattggatgctccactttggtggattgtgggatgtgggatttcagatttggtccttttccacaaggtttgggacacgcagcagtaggccagatacgaggcactcttcttcttgtctcagcttctccttgatttcttttcccctctttttttttcttttctttctttggtccgttcaaaagtacagtggtgggccccggcgtgcctgtggtgttccccacaggggaattttgtgtcgccctcactgcttgtctttcttttgctttgccccacaaactttctcattgtttttctttttttcttttctatttttctatttttttgcttcatgagtacgctagctacatggcatggcatcctctcgtcatcaatacggccatacaagcaagccctcctggctcgtgatgatcacggccacgcgtacacagagtagtaaatttgttgcttaggtggtgtttggatcgacttaactttagtccctctatttagacactaatttagagtattaaatatagactacttacaaaactaattacataaatgaaagctaattcgcgtgataaattttttaagcctaattaatccataattagagaatgtttactgtagcatcacataggctaatcatggattaattaggctcaatagattcgtctcgcgaattagtcaaagattataaatgggttttattaatagtctacgtttaatatttataattaattttcaaacatccgatgtgatagggacttaaaagttttagtcccatctaaacagggtcttaattaacttgtgcattgttaaaacaatttgggatgcatatcgcgtacgataataatgagatgagaacaacaggaactatcagtcaatcgcaaggttttttcctggttgaccaaggcaaaaattaagactttgtattctatcgcggtcaatgggttttttgtttaagatgattccaaaacgtgtcgggctagggtggtgagaggtgtgtggatatatacaaacgacatgcgaaaattccacttgcaccggtgcaaccaaaatgcagctacatggaatcaatctttggtagaaaaaaattaaaaaaaaaacatgcccaaagtaataaaaagcacacataaattaagcacctaattgaccattactatcctataggtaggctaaaaacaaatctatgtccaatcattacatgacaagtaataatgtatgacaaacataaaagatactcctacaaacaaccacaaacacgctagcatgctttataacgaagatgtttgtataatgaccacaccaacaaagactgcacagataaaatagttctcccatactaggttagttgaccaagaacgttactaagcaacatatataatataaatactgaaattcaacatcatatttcgacgatatctaccatccaaatcggtactatcctagtaagcaacaacgacaaacccagttcgtgtctacccatcattcgaatacgttcatctgtatcgggtgggttcatcactacctttttccctaagatacatgataaagctagttctggatgaaggagctttttccaaaaagcaccacgcaggaaaggcgttcttcaggagatggaaaatggatattgccgtggaaagaattcacgagaagcaggactttgcccggttgggttggaagttggccaggagactcaacgagaacaccggcggcatccaaccaaggcctggtttagttcccaacttttttttcaaacttctaattttttcatcacatcaaaacttttctacacatataaactttcaactttttcgtcatatcgttccaattttaatcaaacttttaattttagcgtgaactaaacacacccaatcggtgcgtggaattttgtggtgtgtccatgcagcatttgctcgatcttggtgggcaggaggtttccctgtgacctgtgagagtccgtgccgccgcggctggccaatcaggtggcgaaacgttgcgcgtctcgattgggcgccgtgatgccttcaccgaaagcaaagagcgtcgcacgtgcgcctgccccatgctagctatagcaaagcctatgtaggccatgtttggatagctcttgttagctgtagcttatgtcaaaaatctcttactactgtcagaagttttctcaaactgttttaattatcatatatattctgagaatgtataattatacaatcagaaaataactagaagcttgagttcctagatttttcggattctcacaagatggtttctgattagctgcttttaaaaatattaagctccctaaggatagtaggacactggctattgctatccattgaagcccatccgcttcgtagcctagtttttactgcatggattggaatccttgtgggctcgcttcctcacgggatgttctaaccagatgggtgtactccttccatactcataaaggaagtcgtttaggataatgtttaagtcaaaccttgggaatataaatcatgaataactcttaaattattgagtttgaaaatgtaaaaattatatgaatagatttgtcttgaaaaatactttcataaaagtatacatatatcacttttcaataaatatttttatagaaacaagaagtcaaagttgtgtattggagaccgtgtcaatgtactaaacgacttcctttgtgagtatggagggagtatgtatagtttgtaggcaaattttgctacaggacatcgcgacttcgtggttttagctgtaggacactgcacgaagtcacttttggggaaagacactctcaaaatatggttatttgccaggggacactgcaaccaataaaatattaatttctggttcaataggagagctaaacagtgtaaaaggtcaaaaatgccctcgggcccacttgtcatattcttcccccaccccaaacctcctccttgcctcctctacctccaccggcgatgacgtcctcaccccacccacccccacccacagccacgagcaacgagctcgacgctaggatgggcggccaactcggcgcagggggaggcggcgcccgccgacggctcccacggcggcggcctcaccggagctccgccacgaatcgaactcgcaggttgagatgaagaagcggaagaggcgcggcggtggcgcctccgccgccttcgaccggagcgtcttccccattctgctcgccgccatcgccccggacagcggtaacccgcgacccc

SEQ ID NO: 37619 - DNA, 8778 bp, Oryza sativa
tatgtcctgtagcaaaatttgcctagtttgtatcatgtactagtttcatgtatatattaatttattttttaaaattgtggtacaacatctttaacacacaccgataatatgaaagccagcgattgatcagtggtctcgttgaaatcctattgataacgcaacgccacggacttcaaaaaattttggcatagacatgttaattctttgacttgatccttccgtttagtgtttcttatgattcaatttttatacgtagtaaatgttttttaggattcaaattctatacacaatatatgtatttctagagtatcctatcaatcatctgtcgattaaatttctctctgtcataaatcaccctccctcctcgaaccacacctcatttaattaggaacactatagtaactttttctcagatctaatcttcactaaacaacctagaaatgtttatagatgagaagttgagaacggagtgagcaattgtttatttaatttctaatagtccttctttagccaaatgttttagaacgctgtcatagcaagatatttgcggctcacaaatcatcactttatgagaccgttatttctaacttaaagtatatattgcctagtgctttgcctttttatattggagttgcaaagattccggagaaaagttgtctttttatcacggtggctgaataaattatatgttaacacggaagcctattttgtctttttttacggtcaactataatttttctgacttggacatcatctgttctttttcttgagagtagcattttcaccattttcaaagtagcataaaaccatcatgaccggctaccactaagctgcgcctgtctacttgtcaagctctacaaaaccggtcacagtttttttatgtatatctcttctttccagaaaacttgctctcactgacaagtgggacaagccactacaccctccttctgggcccacctgtaagtgacccattcgagaatatttacgcgagggatctggtacgcctaacgataataccccaacggctacagttcccattcgtgattccacaaaagacagccagattcggagattcccctcgggaccacgtgccgaggcggcccatccggcccggtccggacgcatccgcgccgtccaaccgaattcacccccgcatccggccgtccactcgccgacggctgagatgcgtcccccgcctcgcttgatccgtttcgtaggccgacactttgcccgccaaatggcacgccaccgtaattaaccccgaactccgggggccaaatatctacaaaaacaaagggtatgggcgtgaagcctagaggtaggggggctactcgtagcctccgttttaagtacaaagactccgaaccaaaactccacgcgatttgtttagatcaaacgggttcgtaaaaaaaaagttttattctcgggttcgttgggttttatctatataggcggcgagcgagaccatctcattcagttttattccgcgcgcctcctaaatcgcgcttaatccggcgcatcctgattcagagagtggtttggattcgttggattcgaggtgaacgaacagggcgtggaattttcgaggactctctcctctcgcagaatcccgcgcgcctcctgattcggagagcggtttggatttggattcgaggcgaggaattttcgaggactttggcagcggcggcgggggctggtgagcttctgctgcggcttggagtctgcccccaccattgcgtggggaggtggaggtggaggcggtggtggcggcgggggcggcggaggacgatccttccgcggcttcggtggcaggtgagttcgccgggttgggttcggatttcgtctggatttgtgggggactcagttatgggtggtggttgcttgcggtggttgtggtggcttggtcgtgttgaggtgtggggtctccttcctggtcatctcccagggcctctcgatcggatcctcctcgggagtcgggaatgcgaagctgagtgtgacgcgtgcacgactctcgagggaggaattcccttggtgatcgtgctggagttcgtgggattcgtcgagcttttcgatcctctgctgaaaaaaaaaagtcgttctctgtcagttactcgtttcgtttcaattgggtgagatttttttcctggctcgatttgtgcaggtttgatccaaattgagcgccctgaggatttggggcgtgtttatggaggattagatcgagaattttggttgtttctgtgagatggccgccgattccagcatgggattccatcaggggatcacggcctcgatgtacaaccatcacatgctctccttccaatctaacagcgacttgggcggtggcgccggcgctgcggccggtatggtgatggccccgaggagcatgaacgggactagtagcagcgctgggctgttcgtctctccgaacaccggtgtgctgggcaacgcatcggtggccggcccgtcgaggagctcgtcgggggatgcgttcagtagcacggtggcgcccaagtacaagttcgtcactggttcgccttcagattggaatgaccgtgagctgaacacactgaaggaagggcttgtgaggtagcaaatccctattccccttttgctttctgaattgctattgcctgtgctgtgctagtgtgacttgttgcttgtgcggttgtggctgatggaattttggttgtgcaacaagccgttttttctcccctcttatgtttaatggagcatcaatccggaacaggaaatctggagctggattcattcaattgaaccctgttaccttttgagttgagagcaatatcaatgaatgttctatagcacttttgtgattatttagcgtacttgtagaatcattgttcttaaccatagaacgtctttttcaccgggccagcgaaaccataaaacgtcttggtagccacacttgagtaccttacgactatatgtttgcactatagctgattaataaagtcactatccggtttgtcaatcttatctggggaccagaccatttcttttcagttcctcataatttcttcaatcttactggcagtatgctcgcgaaccgaatatcatgaagtacataaaaatagcagctatgctacccaacaggactgtcagggatgttgcattgcggtgttggtgggctacagttaagttactcttttcaaatgtcacattatctctctgtttccttgttaacatatatgttgattctggtcatgtgcaaattgggtagaagaacttcttaacttcgctaaaaattaagtcagatgtacactgaagaccaaaattgacaccacctagcaccctcaccacattgctcttttgactttttgatagaggtgcttaagcgcttcatatatttaattttactttttataatcctttatttccttttgtgactgatgtgataatttgccatctgccaattacattctagatgtaggctgactttagtcccaaactttttcttcaaacttccaacttttccatcacatcaaaacttccctacacacacaaacttccaacttttccgtcatatcattccaatttcaatcaaactttcaattttggcgtgaactaaacacacccgtattgtaacttggagtatacagcttttaaagttctagcaaacgatcaattccaacaggcatatcaagtatacacagcatttaaggccataataatgacctgccctggctgaaatagacactttgtttgtttgttttattcttaatacaaagctgttcattgtggtttcagactggaaatagatactttgtttgtttactcccgttaataccaaaatgtacaaagcttttgtgcctcccgtaaaatttggaaatagccaccatgatgcatgtagttgatatttagctgttgctgcatgcattgttttctcttacattgctcctccaacaggttatttgtttactggcttgcattagtatagcagctcatgcactgtattctgctcacattcgtttactgttacagagtaaagatagaaggaagaaacctgatggattttatacagggaaaaagataagagacatgaaggtagttttctatttgtaacttgtttggtgtacctcatttcttttgcttgtatcagccatgttcttttgagtttaatttctcaacagccaatccaggacaagatggttgcatctgcctccatggctaattttcacctggcacctgcaaacactgtgacccctttctcaatatcgatgcaacatacaaatcagcaatgtcaggttcctaaggaaggcaagaccacagcaataacattaacatctatatgtttgctttcttctgttcagctgttttagttcatctttattctgtactacaagtttgaggtttgacccacagtgtgttctaaaattgtgaaaactttaggtctgttagatagtgaggtaaacatcaaaacttaagacccatgttaaaaaaacaacttgagactcagtgtttccctctgtttaatttcatcatagaaacgtggttcacacacttacattgttgggctaacattaagtgtgtgtgtgtgtatatatatatatatatatatatatatatatatatatatatatatatatatatatatatacatatacataccatatgagtagattttaatgctcttccaagaattcctaacaaactcaaattgcttgtgttcttgaggctgcttactacatttgtagtcagtagaagcatcctctggaagcaaacttcagatgcctttatgtggtgcgcatgctgtattaagattgtgtcacctatagatccccgtgcaaatacaagaaagatctaggacaaaacacaagcaagtagcagtgtttccaatttccatgctaagcaatcttttatatatgattatgaatccttggtaacatctttagaaactgtttttttcttgtgaaataccttggaaaatagcaattgttagctttactattatttcgtgatacaagcttactgatatcatcggatgctagaaatccacaactgcaaaagaatgggggttgctgtatttgatgatcatgtagttttgtccgtttataggtctatgatggaggaaaggttcatacatcccatagtaaaggaaaagggtgttgcgttgcaccctcctgtttatattctttgtgtttgcctttcatcctttcattatctttcaccgtaaactttaggaacataatgtaataaaacaccttgggtttcattatcattttagatacctacaactatctcatgcaatgcaactgcatgcatcttatgatgtcttatttctcccaaaacactcatctggttccattatgtagaagttcctgtcgtggatagtgcaacacagcatctcctggaagaaaacaatcatttactcaaccaaatcgccacaaatatcgaaacattcaaggtttgtatgtccataaacttctcgcattttaattctaaagtgttgcttttgaagttaatgagtgcccttacgttagaaaaaaaagttaatgagtgccggtcaaggagcatatgatgcttgccaaacatcttaatttcattacaatagttggtttaaaagtcggttatctattgaaaatgctgtcgtaatatgtgatcaactagtccttgccctgaaaatatatgcccctttaactgttatatttacggggcatcgtgtgaaaccaataatgtcatctgccatcaattactagatatggggaaacacttaatataagttggaacctgtcactctcaggctttatgaatattaaaaataaggcaggacaactggacaggtgtgggttaccatttgttttctttttaattttattatgcctgaatcctgagtttcttgcagacgggagagaacacggatctcttttttcggacaaacaacaacttcaaaaatattttaagcaggtaaagcgtcatttatgtgcccgccatgtatcttgttctttatatattgctttgaggacgatttttactcttcatgtccaaacactgccatgccatccattattatgttccaaattagataggagcccctagttaactataccatccattatcatgttccattatcattatcaaagcctgtaccatcttttatcattttgggattgcttcctgttaactggtgtttcttgttctaggcagtattcaatattcatgttcgtagaaacaaaatataatattttttccttttgtgctgcagaatgagcgagacgcctggtatcatgggccagatgccccaattgccagtgcaagtaaacgaagaccatctgagttcacttcttcagctggacagaatggtaagaggggacccgtaatcacaagagattcaaacatgtacgcagtatttttcagcacgttcatcaccatttacttcattttcttccctttgctcttaaagtagtcgatacataggatgttaacagcaggatcttgtaatctacatgccttaaccacaatgatcgacacccactgctaggttccttcgtatggcgtaacgcaaacctctcatatgaagcaagaaccgcgaagctagtataaacatacacgaaaacaaggacttgaaaaggaaaaaaaagagcagatggctggagctccgccgcccaagtttcgtgtaccatgaagaaggctaagttgccgcaccgagtgagcgagcgccaggaacagtcccggcgtttctttcttccagcgagattgttttccagtgatctgattgtctgcccgcctgcctacctgcccgagttgaaagctgttgaaagcaccggaaattgaggcctgcagctgcttgcgggggtatgcgcaacgggcgagcgagttgctgttgttgtacctggttgggtatccagcgaaatgaatacaccagacacttgattcgggagtgagtaacacgcacacaagtgactgtaaatatttggatggctggaggtgttcccctgtcctgttttgttctctctgattggtcgtcaatatatttttcggaagggtaccttgtatgtttttccactttggagagttaggagggcaccttatgtattattgcatagttggaagatcgtgttgataaaaccaacaaaaagatggctttaggttttgaatagaatgcccattgcatttatacttcgttctgtgatcgcccttattactccctcaggtcgttttgaacttcgtttatagtcaaacttcttaaaagtttgatcaagtttatagaaaattataatatttatggcaccaaaatctaacattcaatatattttaaaagtttttattgctaaattttaatataaacttaatcaaaactaaaaaaattgaattagaaaacgttcaaatgatttctatatgaaacggaggcagtatgagtaaccggccgcacgtactgcgctgacaactgcatccgtcctccgccaaccacatctgatcttctactctcttccccttttttttctccaataacagttagattaagattaagattttcgtggcacgcttttcaaactactaaacggtgcgtttcgtgtgaaaactttctatataaaagttgttctaaaatatcatattaatctatttttcaagtttgtaataattaaaaattaatcaatcatatgttaataccacctcgttttacgtaaaaaacttaatcttcatcttcatctatgttccaaaatactctagtagttcaaactttgttctaaagttccaagtaccatgggtaaaagtttacagtgatgaaatatctaaaatacatctcacctctaccggccaggacaattaataaaggcatttctacacttttccttcgcctccataaagaactcaagaaataattactattactatactatattttaagatggagggagaactaggatggacgccctatgggctagtttaggcaaaacacactaatcctgtgtgctagctcagggcacaattttgggaagttccatagtcaaacacgataaataatgtgtcagcaacatgttccaaattttcagcaggctattatgttgatagcaacatgttccaaactaacaggttattatgaacagaaaccaatgttgcgtgttgttgacatagtaatactgcaactgtacaacaaaaattataatccattattaaaaagccgaaaatgacccctcatcgcacctcaaatagtactactgtacaatcatatacactccagaaaagaaaaatgcaagaacacccctttaatcaagatctgttactggacttgaaaaatgagccttgccccgtgcccgaaacacaaggaaaacatcctatctagcactaccagtgaaaaccactatcctgcaacatgcatatgctatgtagcaagcacaaaacattggaagtttggaacagaagctgtgtgctttctgagcaacgagcagtgcagcaaactataaaaccaccgtgagccatttaaaagccctccatgaacaaatacatatgcagttactttacaaaagatcaactggcaggatgatcaatacttgccttctccacggtaccttctgcaggtagttcttcaatagcaggtgtgctactggcaacaggactctctgcagctaattcttcaactgctggtaagttgttggcaataggactttctgcaggtagttcttcggcagatggtaagttagtagcaacagaactttccgcaggtaattcttcaaccgtgggtaagtctttcacgatagggctgccggcacctgagtttgcaaggtttgcaccggcgtggccaatgctgccatcggaatg

SEQ ID NO: 37620 - DNA, 579 bp, Oryza sativa
gcccttggattccggtcaccgtcggatgtgccccgagcacatactatcagcggaccaaatgttgtaccaacgtgatcgaggtgtgggtcaccgctggcgtggcggcgatcggcttccgcttgccgcttgcgctgtgcgtgcgcgtagccgggccgaggggcaccaccaccattgttgcggcgagagtccttggtggtaataatggtggccggagaggaccagagagagatgttgcactgcatcccctctggccccctgcatcgtgagatgacaatgcaatgccaatgccattgccgccaagtactactgctctgctgctgctgctgctgctgctgctgctaccggggtcccccacccagccagcctgcagcctgcccctgcttccgtgttgcattgccttctcctatgtggatgggagatgaaattattcccatggctccctttttccgatttactctatatcgagtaaatcggaaaaggggagccatgggaatattttcatctcccatccacatcggagaaggcaatgcaacacggaagcaggggcaggctgcaggctggctgggtgggggaccctgg

SEQ ID NO: 37621 - DNA, 533 bp, Oryza sativa
atccatatgacaaagaaaagtatgacaagataatacaagcttgtgcgctgactaaagatcttgagttgtttgcaaatggtgatttgacggagattggtgaaagaggaattaacatgagtggtggacagaaacaacgaattcagatagcaaggtcagtatatgaagatgcagacatatacctttttgatgatcctttcagtgcagtggatgctcatactggaagccaacttttcaaggtttgttctgtttgtttaaaactttcaataaatgctcaagtatgaaggttatgtcttaactccattcttcgtggcattaactccattcttcgtggcataacgttaataaaaaaaagggcaaaacctatttcgttacttttagaccaataatcgttagactctaagcaaatgaaacaaattgccttggcaggattgcctgatgggaattcttaaagacaaaacaatactgtatgtgacccaccaagttgaatttcttcctaccgctgaccttatactggtatgtatctaaaatacttt

SEQ ID NO: 37622 - DNA, 7785 bp, Oryza sativa
  unsure (1)..(7785): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaaggaagaaacgtaaagatttttataacagaaagggtggtagaacacttggtggcagacatcaggaggtcctctgatctgaagagtggccggaattttttctttcgaggagtagcagcatgtttttggcctccttaaatagttttcctgttctttttcgaggtttcccctcgactctgtaatatcatgtatattgtattaccctctttttttatgtatattgtattaccctctttttatcttaaagaaatttggtttacgttctttttcgaggtttcccctcgactcgacagtgtaatatcatgtatattatattaccctctttttatcttaaagaaatttggttgacgtccttccgccgacccggcaaaaaagttttctttttaggctatggaaatgatatatttgccgaacaagttttctttttaggctatggaaatgatatatcagtatttcgttctaaaaaggtgaaacaatagggatactaagttctaaaaatattttacatgaggcagaggcatgttggatcaatttgatttaagagaggcacgtggataacatattctcttacctttattggattggcaaaactaaggatgtcaatatcttgtactccctcggtttcatatttgactcttaaaactcctttatgtttttttgtttgatcaaatttataaaaaaaatagcaacatatatgataccaaaataatttaattaaatatatcattaaatatattttaatagaatattcattttgtgttaaaaatatcattatatttatctctgaattctatcaaacttcaaaaaaatggggaaaaaatcaaaacgactagggagcacagcatacactgacacggctacatgattacattcatcgatataagtagatccgtagatgcgtacttcaaaaacacatgaaaacgaaagccctttcattgaacagaactacatcaagcatgttaattttacatctgacactttttattccagcacacgcatgtgcacacagcatacacgcgtgcgtacgaacacaagctaacacgatcagcggccgggctgggaccagatcactcgctacactgaaaaaaaacacactagcgatccagatcgatcaagcccgcccatgtccatctaccccaaatctagatgtacgatttgtcggacgccgcgtacgtgccggtgccggtgccggtgccggcggccgggtatgcagggtcgacggcggggccgccgaccggagcgtggtggtggcggttgccgccggccgtaagcggcacgcgcgtgccgtggcggcccgtggtggcgttggcgcggtgctccgccctctcctggtgctcgtcggccttggcctgtgccttgccggccttctcctcctgcttggccatctccttctcgccgtgcgtggccgccgtcgcctggccggccttgccgtgcgccttggccgtcccctccttcaccttctccttggcaccgctcaccatgtcctgcaccttcaccttcgccgtctgcatcttttcttttcttttgctcctacagtacagtagctacgtgcgttgcgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttcttttttccaaaacaaaaagttagacgaagattaagatttttgtagcacgcttttcaaactgtttaaataaacagtacgtttcgtgtaaaaactttctatatgaaagttgctctaaaatatcatattaatatacttttttaagtttgtaataattaaaactcaatcaatcatacgttaataccacattgttttgcgtaaaaagcttaatcttaatcttaatcttcatctttagaaaaaaaacaccacctagattttttttcctatctcctaatgcacttgaattgtttaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggggccggggcgcacgccaccagccacagcacgttgacggcgagcctcgtggcgagcccggacacccggagcacggcgcgcgccacggcggccaccgccagcccgtgctcggcgaaggccagccgcccctcggggcacttgcacatgcgcttcaggaggaggagcgaccgctcggcgacgtggcggtcggcgtcgaggaggagctcggcgaggacgcgcacggcgcccagctccacggccttggcgcgccgcgcgccgcgggagtaccgcgccgtgacgtcgaggagcacgtcgagcgcgcgggagctcagcttcgcggaggcgccgtcggagaggagctcgaggagggccttgaccatgtcgtcgacgtcgacctccgcggtccagtcgcggacgctggccctggagatcttggagatcatggacattgcgtgcagcctcgcctcggcgctgccgcgctggaccagcacggacacgggccttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccattagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacatttcattatatataagaaaaagtttttgatatgaatctaacaatatcaaccaaaaacatatgttctaatagactaattgttggtgctagaaaatctttgagaaaaatgaagaatctcagacaatttagtgctagaaaattgtaatacctgatgctcgaaaatctcagagcaaaatgaaaaaaaggtaaatcatgatgcacgagaaaaatgaagatgccatccgtctccttttcatctcaatagcaggttaaatatatgaaaaaaaaatgttttcttaataacgatacgaagatatgagaaactatcaaaccaagtcaacaattcttccaaattaaaatcccgtaggggaaatgcttaaaaagtacagcttgcagcattagtacattatctgttatgatttctaacgatctgtattgatgtaaaatactctagtcaagagtcagacgggcagaatagtaagcgatcgatcgatggctacacattaaagtgccactgtgcaatgcatgcaaaataaataatactaagtctatggattggccgtgatctgtattactcaagacttcgtctcttacctagagcttatgttctatggatcaatttattcgagattttgacgaagaactagagactttttttattccttttgttttgctgcgtgcagggagcaattcgatgggcgtcgactggagcaatctgatgggcgatgatgaggtgacagtttcacaagtattaacctaagacttggtgtgatgctacttgtcagaaacgtaatgaagagaacacacttgcttgcttattcctttctgttttcttcttcttcttcttcttcttctttttttgtggagacagaagaagtttaatttttcaaaacggcaaatgcatctttggagttgttaaatggagattggggaggagctggcagaggatgacggtggatcttgaattgttaatctgtccggttctatttcttcttctgtttgttcacttgcatgttctttttcctctgtctgtattaattagttgcgagcggttgagcgtttcatttgaccgtgattgggtcatccatccatccagccgcattctcatattttctttggatgaaattatattatagagataagaaatttgcctgtaatgtcatttagttagaagtttcacacctctcaacatcatattactgacggcggatgattaattaatggtaaaaaaaacaaggtggattgcctcttgtaatcttgtatctatacaccatcttctgtacccaattatattttacctatacaagggcttttagcttgttaatgctgacttccctcccatgtataatgtatttttcagaaatgaaagatcatgtgtgccagattacttgggagtcaaaattatggtttctcttaatgtggtttaggtgatagtttggcatcattacgacatctttctttgtcatgcaccgtctgccaactcctgaaactaaaatggaacagaaaacgagtacaagtgcagttccaactaaatcactgtctgacaaacgagtactgtcttcagttcatcatatctgagctatgaagatctatttcatcacagagaatctgtttctgctccaattaattagcaagtagttttaacaaaaataattaataagtatcttgtggttgtcatgccttaatctgccagcaaaacattttctatatgattaaaatggctatatcaaccgtactgtagtgggaacatggatgatggatcactttgttgctttattttttatatatagtattttgctaacgcaagccaaaaaaaaaaaaaaatggttggccttaagctgtccattagtgcaccgccagttagcggaagatgcaattttcaaaacaaaaataaaaaacttgcacgaaattatgtttacgaatacttgcatatatatatataagcacccactagttaatacccacttgctagttgctacactgacgttccacacgtcctaagatcctatcgtttgctcttgccatcgccatacgactttaagagtttttatttttaagtcttgtactttgacaaaattaggcatatcgtcgaacaaacgctccctgttcgatttgactgtggcgaaatattcttttgaacagacgttgcaatcggcgcagctgctgatgatcatccataaattgataaattcgttgactaatcgatctgaaaacaaaggagcgtcctgacaagaactgtcaccggctggtggggttacaatatttttcagaatttggaactgctcagagttgaattactagtggtaataccgacacgttactcttactaggttcttatcctttctttgtccaacagtaattaactttaaattctgttcctgtgaacagaagcaataataattccactgcggtgacaaaactacattgacaattggcacagagatcttacctgttcgaacttcgagtttcttctcgggaagacttcagatttcttaatttcggttaagcacacagcgtttgacattaatcagttgcttgtttttgcatccatttcagcaggctaacgttttccaaacgtatgactgcagattgtagaaaaaatgatggtcggatgattcataacgttcaccgaattaacaatcgtgcttccacttggagcagctacctgtacctgcatgattcctttcaaacattgttgtttattcctacattgcatcttgcta

SEQ ID NO: 37623 - DNA, 15324 bp, Oryza sativa
tgcatgcaattacaggtttatatgcggccatggcttccagaggaacaataccgaaatgttcatcctgcaaaatgtcagacgcaggtttattatgggaaaattctcatgttgttgagaatcaaaagacatgccagatatttacctttggagtgtataacacacaaaggcagttggagagaagttcgttcctttcagaagttgaacaagatgtcacaaatttgacatgttcagaaaccccttcactcgctgccaatcttttgagctcctcaaggtattcaacattttctctgagacgcttatcatatccaccttaagcataatcttttgtaagtaaacagtagttgccagttggtaattcataatgcagtgacgatgcaacattcaacctgtagtggaaaggaaattacctgctactgttaaggttacttcctgtcgagcatcaccaggtagcatagaagcaacagagcgaagcagagaaaatgctgaaatggcaagaccaagattcttttttctctcaaaccggttaattgagaggaaattcaacctgcgcagaaagatgatggttaaatttggctagacctgaaggtgcagaaggtgagaaaaatgcttacacttcacactatactatttttttttaaataaaatgaaacctaagcgagttacagagagatatacaagcatgcagttacttataagcatgaggttcctgaaactgttcaacagagacagctggatatagaacagcaggctcgactcctctagcatgaaggctgcaaaaggtcctggcaaatgttgttgcagtgaacttgctgtttactagaatcaaatctgccatacctaatacatacaaaaaagggataagcactacagatagaacaaacactagggaatggtaaaaaacatagcaggcaacagttctagatgaacaagaccataccagtagttgtttcttcaatcatgtcaattggcttgcgatacaacctccgaagcatggtagtatgttgagcaagcaacatatcaggaaagtgacaataaaatactatctgaatacacgggaaaaagaagttatcaacatatatctacagtggaaacatactgatcacataaagcaagggatcaataccttggattttgccttcagtttaagcagtggaatcacaaccgaaacctggtctactaatatgatgtcaaatgagggccaccaaagtagcacacacattgcaacaaaaatgcagcgaagatatgcacagatagcgtggaagcggtaaaaaatatggcgaggcaagaaatctccatatactttaacttcaaatggacctgcaggacaatagaaaatcaagtaaagtttccattggcataagaatccctacacactattgagcgatttgagtagggtatccgaggaaacgttttgtgaaattttgtacgtaatcaatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattctagggcatcactactcactacttaactagaagtatcaacacagtatggaagtgaagaagaagaaaaatctttccctaacactcagactaccccgtaattgcagcaagcaactaagcatacgtcgaaccttgagcaaaattgaggaacccaacaaatatcccagctacaagctcaggcagcaacggttcctcaaatctactgatgcttccaccgcgtggactcggaattgctacatatcgaccaatttacaaagtagcacgcaaccaatcgtttcggggactcaaccggatctaccaaaattctgcccacgagagatgagggttcacccaagcatcgacaggagcaacaggaggggggagagagagtagaggcgtacctatcccgagatcggggtggatcacggcgaccttaagctgcttcgtcctcgtccccgacggctcgccggcgactcctcccgccgccgctgccatctccctcgcgtaaccagatgggcttcggccgccgccgccgccgccgccgctgcgggccgtggatctctgctcgctaactcgctctcgctagtcgtgtcgtcacgattccagctgagttgatgtgcgggtggattgggcctcatacagcccagtatctgataacgcgtgcgaatcgcttacggcccagtagcccatatcaatttgatggcatcgagccgtcgagtactcgagttcgagtgctcgcagaatgcagatttccatagcatattatttcggggatggctaattagcgcgtacgtgccctttacctaagtcgcgcgcgcgtagagaagcggtgggcccacttgttttcggcatcacgtacgaagaaaagccaaactcccgttcgtgtttctctctttttttttccggaaaaaaaatcgtcacgggagtgcttaattctcttaaacacttttaacttagatttgaatcttttcaactttgattcgaaaactttcaactctatatttgaaagtttaaatttatatttgaaaattttcaagtcaagcttgaaaacattcaattcagatttaaaaaattttcagctcagatttgaaaactttcaagtccagttgaaaacttttaccttagatttaaaatttttcaaatcaaaatttgaaaactttcaactgaagatttgaaaattttcaactgaagatttaaaatttttcaactcaaattttaaaacttttatcttaaaattcgaaactttcaacttaaatttgaaaatgttcatgttaataatagagctaattactggaaaaaagaaaaaaaaaagtatgagatcatagcgctacgtactcatgttaatcacgttagatatggcgttaatcacacactaattgtatgagttggcacctgcacgtgctttactaatgagcctgcgaacgtccgaaacgcgcgctgagttgacccgttggcgcgtacgcacacaacagcaaatccgtattatttcttgcaccaggatcctgataaaagatgtaggtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataatgcagtcgtcctactgctacaccagggcctcaaaagaagaacaagatagtgatccactgcatttgcaaaacagttttcaggtaactgctgtactgattttacacgcgagaagatttcaggccatgatgcatctttcacacataagaagggcagtatcccactgggcagttcatcacaagaccatatacagtcatggcagttattaaggccaagggtcctgatcacagtctcagcatttagcgacacacgctgggacacgatatccacacttggaagtgtaagcagtaacatggtcacacggttaattaagcctaagcagcagcggtgtccttgggagagcacggcgtaggctgggcatcaggcgacaggttggagatggagatgagctttgatctgtacttctctgccccgtcatcgtcgtggtggtggccattcaccatggcgccgctcggtgacttgatgttgacggcttctcctgccgctggaacagaccgggagatcgcaatcagagactgacgggcagcttcctgagtgaactctctcggtgatgcaggtgaggccatcaaacaaacaaaggctgcaattcaagcataacaggaaggtgtaagtatacgatacagcttattagaaggcttggcatataaatggaatgaataactaattaagtagatgctagtcattgagctaaattaggcagcttataattgtactactaccaacactcctaatataaagcaataaaaatagtaatgttgaaaacacaacgtaatggtccacatgaaagctcctaaaatattctgcagtaactgcatgtcagtttcatatgaaaaatgttatacataaagggcgattccatcctccaacctctgcttaagcctgaagtgtgctgccctgattgagtttccgaaaaagtagagttattcaatttaagtggagcatttggtatacatgggacgaacgggttcagtttgtgtagtcgcacaaataattgctgagctatgcacccgttagcacacactgttttagcatgaaagatgctatttttgttgcaaatgatccacccataaatctgttgtggataggatatcaggcagacaggcaccaaacaatcacactgtattcttgctaaaaaaaatgacttgccttttgaatgaagagcattttgatcatgtgactactgaatttagactggaagcatagactgggtacataatctggagtgagattttcatgctgcttgaaacgatttagtacgtttttcagtactaaggttaaacatcaaaagagtggtagatcgcaaaaattaggtaggccatcactcaaacagtccctcatatatagactaaatacaaccggtcgttttggtaggaccagctaaaatagactacttactagaaaagaattactactccatataaggaaagacaacctcaaattgcagattactatttcaaagcgtcgctactatagttacgtaaccttatcctcagcgtgaggtgcacctaccaaaccgaaaggcaccaaagaactcacaagcatttcactagtattacgagcttttcggagttccagtatcagccatgtggactaaatcgttgacgctccgaataccgcgaaacaggggcggatccaacttgggacatgaactgaacccccaaaacttttggggaaacaaacaaactgtttacttgtagtaagttcaaggctctgaaattaagagaagagcttcttccagatctagaagagaagctaggattgacgaacgcaagcaaaatcccagacaacagtactcccggtgggagagagatgaatcagaaagagggtgtggatgctcaccaggatcccctcccctcccctgttcagccgcgacgcgagatggcgcacggagctgaggagacgacgagacgggtgtttttccttttacgccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccataaacaagactctttgctggtgttctttttttctgaaaataaatatgaagatgaagattaagtttttttaaagtaaaacgagatggtattaacgtatgattgattaagttttaattattacgaacttaaaaaataaattaatatgatattttacaataattttcatgtagaaagtttttacacaaaacgcatcatttaacagtttgaaaagcatgccacaaaaatttttatcttcaaccaactcttgttgaagaaatgaacggacctttatcccaacaaatcatgaaatctccccacacggaacggtagacaagaattacttccatggttaaatactcacgtactcgcgactgaaccaaaatcaagtaatcaaccaagcgacgagcggtcaagcaacacaaaccaaccacgatatactgtcagtacacaatccaaccggagggacgcctgaccagctagcaataatccggtgcagaaactaacgcgcttataaatacacgagatgcagagcgagcgcttaccagataatctggcaggacagcgggaggctgcagggacgagcgatgaggctgcagcctgcagggccgaagatgagagaaagctatgggcgatggagagttggagacgattgggggaaggaggccaaccgaggatgacaaggacgacagggtgtgggttcggtttctttacggagtatatgaccgtgcacgttgatcacgacgcgcgggggttgagctggtcggtgagccatcgtggactaccgccgcatccaccgctcgtttgctcggtggatggtggggtatcaggctcggtccatagaccaggttctgggcattatgcctcgcccgtgatgaaacggacaagagctcgagttgtaaaacacttcgagaggtgcacgtgaggtgtcgtatctgcacgaatcgcgaggccatgtgtctctggagaagtcggcgaggtgaggcgcgctcggagctgcgggccccacccgcagatacgtctgtagcctggagcaaggtggggccgggccgtgctggaccgaataggaaggggagcggacacgggctatcatccagcccagtttgttcgtcactattctgttccggcccaaactgctggtgttactgttacgctccaaacctaagaaccatcttctaactgcattgtgtcacatgtaattctgttgcaaaacctcatggcagccattttgttagttgtcgaactactttcatttcattaatgaaatagaagaggatctcctctctttctaaaaaaaaactcatggcagcttatttattcttcgcgttatccaactctgaaatagtttggctttgagagtttcagttattggttggaatagctagcttttctttgcaagctgcacagctattttatcgctcgaatacgaattgtatgaatgtgatagttctggaaatagtagtgatgcatttgtgctcattagatatatgcgttacacttgaagaagaacaaagtgaaaaaacacacatcacatctatatgcagcaagtatcaacggaaccaaacgttcccctcatttattaagcatggattacacttgaaaagcgaactgaaaaacacgatcagagaagcagcgtcgccaactgccgctgccgcccggccggcgaggaagaagctagtcagaaccagcgccgtacggaaaatccgggctcgggctcgccgtccgcgagctgctcggcggcgactccgcagctgccacgggcggtgagcctccactccgaataaccttcgggttgggtcccgtcgacccacccacacggccggctgcaccgtcatacgcaggcactgccggggagccactggacacggccgtcggagaacatggtggtggtggacgaccagtcatgttaccggaaaacgtcggcgacggcggtggtggtggtggacgaccggtcatgttaccggaaaccgtcggcgacggtggttcatctgggctcttgtgcctgccaccggaagctctcggcgtgtcctcctccggcggcgcctgcgttccaccgccggaaactcttggcgtggaaggtggtggcacacgtacactggcgtatgcgtccggcggtgtgtgcttgccaccggaaactctcggtggtgtgtcctgtggtggcggcggcgaacggacactcgtgtttgcgtccgggggcgtgtgcgtgccaccggagatctttggtgtgcgtggcggcggcgatcttacacttgtgtatgcgtccggcggcggcgtgttcgtgccactggaagaagctgtcggatgttccggtggagggagtcgcacgcttgtttcaaccactggcgccggcggcggtggtgttcgacggggaaaggtctttggtgaaccaagggaaaatctgggagcaggcggtggaggagagcgcacgctcgtttcagacatcggtgtctgcggtggaggtgttcgacggggaaaggtcttcggtggaacggacggtggaggagagagctcgctcgtttcagccactggcgccggcggcggaggtgttcgacggggaacggtcttcggtggaccaagggagaatctaggaacgggcggtggaggagagagctcgctcgtttcagccactgctgccggcggcggaggtgttcgacggggaaaggtcttcggtggaccaagggagaatctgggaacgggcggtggaggagggtgctcgctcgtttcagccattggtgccggcggcggaggtgttatacggggaaaagtctttggtggaccaagggagaatctcggagcagacggtggaggagagcgcacgctcgtttcagccactggcgccagcggcggaggtgttcgacggggaaaggtcttcggtggaccaagggagaatctaggaacgggcggtggaggagagagctcgctcgtttcagccactgatgctggcggtggtggtgttggaccaggaaaggtctttggtggactaagggagaatctaggagcgggcggtggagaagagcggatgctcgtttcagccgttggtgttggcggcggcggtgttggactgggaaaggtcttcggtggaccaagggagaatctaggagcgggcggaggaggagattgcacactcgtttcagccattggcgacggtggtggtggtgttggactgggaaaagtcttcggtggaccaagcgagaatctcggagcgggcggtggaggagatcgcacactcatttcagccgttggcgccgacggcggtggtgttggactgggaaatgtctttggtggaccaagggagaatctgggatcggacggtggaggagagcgcacgctcgtttcagctgttggtgcctgcggcggtggtgttggactgggaaccgatggcgcgcacgcgccaccgctgctggtgggaggcctcgggctggcttgagcaccagcggggactgacgacgaccgtggtggcgccctggaggtcgccgcgacgccggcgcaatgccgcagcaggccatgcgggaggagcgaggcgacgaaggtgcgggtgaagggcccgcagtgctcgtcggcctcgcacgccgcgaggcggcacgcgcgcggaatggggcaccccgtgaagaaggcggcgagcaggtcgtgcttgcagcggcccagcgtcagcagagactcccagcagatgcccgagtcggtgtgcgggccgcccgggaagatgctgtcgaacgtgagcgaccgccgcgccggggtcgactgatcggcgccgccgccgtgcgcgacgcacgcggccacgagcgccgcgagcagcaaggccgtcctcatggttggcctcgcaaaaccgcagctctctttggctgcacctgttgtgttttgtgcttcactttggagcaccaaggccgtagtagcgggaaactgtatttatagagtgttgccaagctgttaattgtcccgatcgttttgcttgcacgttgggaggttgcacgtttagattgattaatgctagcgtgttaattgtgcatgtgtaacccaccccgaagatttgttgaatgttcatcgatggtttctcatctatgttctgagttctgacgttttctctagccaatgctgtgaattgccattactcgtagttgttgaccagtaatgtttaattcatgagtaaatagaatgcgagtatgtgaccatgtctgaacggttatccagatggaaaagtagaaatacaagtaaggaattttggacttgaaatgcaaatcagatgagctgaaagtctaaacctgtatgtttgtggagtaatatatttcatattaatctatgttgtcggtttttttcatatttttttttgactatttagatgacatgcaaataacgagaggatgtcctcgagagggatgaaaatccacatctcctataccagattcaacctgtttggcagctgagttttccaatttgtcttcctcgttttccgtgcaaaagcttttaaaactgttaaacgatgtgtttttaataaaaagccttttttatgatagttgtttttaaaaaatcatattaatctattttttttaaaaaatataactaatatttaataaatttcgtgataataagttactccggtttttttttgtatgcgggagattagttcccaactggaaggaacaaaacgcagcccggcctgatgatgaattttttaataatccctaaacatagagtacctattaactttcatattgtcaagttgcaccatttttttttaaaaaaaaaactgaagcgcctgatctcgatgcctacctacatatgaggatatatgacgcgtgtttttttttttctctttgatcattcgacagaatccctccttgtccgataatgaatagaacacacgcactcgaatcggattcaacagagcccccgacttttgttataataagttagcgtatctctcgcgcactaacttcaggcctcatcgatcattcatggcagtcgaggcatgcagcatatgtcgtcgaagaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagagtgagtccatgaccatggttgcgaggtctacacgctctgcaccccaagccgcccgtggaggccagcctccggaggcataccggggcgtctcggtggcgtggtgatctgcgccctcctctacgagggcgcggcaaccaaggtgcccccggtatacgccaatgggttcttgcactggcagctctaccctgacaaatacttgatcaagacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagtgtggagcggatcaagaaaatcctgatcgctacctcgcagcacaaggtgcacgcctacgacccagctacggggagcatcgaaacggtggtcaccgtcccagaggatttcgccggcggccgggaggaggcggtggccggtattcggattggtctgtacgaggacagccttgcccgtgtaggcggcgagagttgtcgacagagggaagccacggcggcgatgactgagatcctactacggttgccgcccaaatcaatcgccatgtgcatgctcgtttgcagacagtggcgcacactgatcgagagcgagcgctttcttacgtcacacatgcttgctaacatggaacggaagaaggtcatggtagtcacgaatggccgtcgacgggagaatttctttaatttcatgccggtggagacctggattgggcctgccgccaaagctcgttcggacgttcttgtcaaccgcaggatcctctgctctaagccatgccatggacttaacctgataagcaccagcagcgacgactacctgtgcaacccttgcactggttctatccggtgtcttggaatccgtggaaagtttcgtgagattgatccaactgtcagtattgatgacgatcgccgccatgtcacgagagttggcaggaacatcgggctaggattcgaccggttgtcacaagagcatgtagtggttgagatgagccgcttcaaaggcgacctgcagctgtgcatgatcaagacgagctgcgtggattactggagctgcgctggcaagccgccgaggccggtgaccgacatgccaccggcacatgttgacgggacgctctactggatcagcgagccacagccgacggcccgagaccgtgtcattgtggcatttgacatctcctcccgggagttctccgtcttgccatgccagccatgctgcagcgagagggacggcggtgattatccgttgctcgtcgagctggaaggatcgctgtcgctcgtcgtcgcaaacgcggaggagaacaatctgcagatatggacgatgcaggaggctgacggcacatggcacaaaagttacagcatcttactggacgagaggtacccggacttctcactaaaaacgggcgtggtggtagtgccactggacgccgtcgccgatagcaatggcggcggcaggatcttgctcgacacagggcgagcattgggctactacgatctcgagacgagaagcatcgacaccttgtactcgctcgaccagctaaagcttccccagtgccagatggcattccccatgctgtacggggatagcttggtgcccatccaggacgacgaaccgcccgactacgtcgcgccgactcttcgcgacgacgacggcgggcggcgctgctactaccagccgcaacacgtggagatcagcggcggcgagcagcctgcggctgcctcctgcgtattccggccatgcgaggcggccggcggcggctgcaggggcatgggctgcgtgtacgcgggtagctgctgcaggagggtgctgtgccgggagtgcagcctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggacgaggtggaggaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaatggtcctttttggggcgccagagtggctggcgccgtcgtccaactgcagcctctctggcgccgtccccctgccgacgtggcggggcaatgctgaggtggctagggggagcgcgccagagtggctggcgccccccccccccaaaaaatttttttttaatttttttttatttttttgatatttttttcacgcttagggacatagaagaaccaaccatagaaaaaatgaactcaaatggacgtaatatgtgacatgtagaatttttcctctcctctcctctctctccgaactagtgcagaggagagagatgtgcaactttttttatttttatttttatttttttgatatttttttcacgcttaggaactcacaagaaccaaaaatataaaaaataaactcaaacggacgaaacatgtggcctgtggaattttccaaagctctaccgaaaaacttctctcatcgaaaacacaatcttgcaagcggaatttggaggttttaatatcgccgaacacaatcttgcaagcggaatttggaattttgaattagattaagtaatttcataaagtggtagagtgcattatgtttaacatgctgatcaaagggtagatcaaagtggtagattagtgaaggtgcaaagtagactaagtggtagttcagtttaatttgggggatccactaggggtaga

SEQ ID NO: 37624 - DNA, 11098 bp, Oryza sativa
acggcgccagagaggccggcgccgtcccgttggatgacggcgccagccactctggcgcctcaaaaaggaccatttctgggataagtttttttaggggtctatttgcaaaataagtttttcaaaaggaccaaaatgtgaaaaatctagacaggatggacgggaaggttattagggagacgtgggtgcgcagataccgcgctgtgtcttttaatagagaaattttacggtactttaaagaaagtatctaaattttacactgaaaattttgatatatgaaaatatcaaattttacattataaaatatggtactatgcacagagaactagagaagtcaagtactttcttaaggatggtaaaatttatctatttagatatgatgcaccatatgcacagagaactagagctttgcagaaatagctcgggacaatgcccgacagtttatatcaaagagttgatgaccgtcattgcgagcagtccggattccataacacgagcattgcgataaactaaaatggagtttttcacgaactaaactagtagtgttcaactctttgaactgtatatcatgaagtaattatgatttctctacacagatctgtcggactgtcaaccatacaacactgtctaggtgaagttcatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttctcaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcagggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctacaccactatatatggctgtgttcttaagttcaagttcccaaccttattctctcgtttaccgcgcgcatacttcccaaactgctaaacggtgtatgttttgcaaaaattttctatagaaaagttgctttaaaaaatcatattaatctatttttgaagttttttaggctaataattaattaatcacgtactaatccattgctccgttttccgtgtccaacccttacctaagaacagaaccttaatgtttttttatgacgtggcacacggccatgtggagggatgccagtcattttgcaggcaacccctgccaccctcctaaaagactataaaagggccgtcaatgtcattttacaaccggccccttagaggctacaactctctccagaggctacaactctctccagatgcttagaaatgtcctaggctgccattttataggtgagcccctttgcaggcgataaggtgactgcttgtaaaatggtgtcttcctccatgtgacattgtagatttgtgaagggcaacataggtgtagatttataaaactttaaaaagaatatgttttaaatattttaataaataaaattaaaaataaaaattcgaaaacaacaatacactctttagtggaattgaagggaattttaaaggaattgcaaggaactttggaatgtaggattttgaaaacataaagcatgaaaagcacaagattggaatatatcttgccttgcaaattcctaaagaattagatgcactcaaatgctccaaaataatcattcgggtggtacataggaataggaatgataaaataatagtggacacaataatagaacaccacgggataagaccttaattgtatttccacataaaattttaagcatcaaccctttgttctaaaggacttgataggaattttgccataagtattcaaatcctctaaaattcattcactttacttttttttccaaaagagcctaaaggttttgattcctaagaaaaatttcaccatgtaaccgtttagatcaaaggaaattaaaacaaatgaaagtttccctcaagttaaaaaaaaagaaataaaaagtttcctgttgtaaagaatcctgcatcctgatctgcaacatgtctatatttcttcttttttttttcagttctccgggtaaattgctcatgctatgcttagcacaaatcctatttctttcccaaacacaaaacattcctttttttgtccattcttctagaggcgctccgatcaaatcatccggattattttggggttgtttggttcggtctcaaactttgccaaaaattgacacacctcatgttagacacatttgaccaagttaactcatcgtttggtttatggtcacacttatggtaatattctctttcatttctcatggtcccacgtgtcatcaactaaaaaatgtgtgccacactctttttttctagctaaagtgtggcttacattttgttggccataactaagataaagtgtggcacacaagtatggtaaatgattgttgtatagcatgcaaacagcccctttattttgcaatatagtttgtttattttttttggtttgttaatattagctctttttctagagacatgtggggaccgatgtatatattgacatttgacacgtttctctagaggtgcatgatgtgttgtttgttcggttttttttttggaagccattggtttcatcggagaaacatgggtggaaggcgtgcgggtggtgcgaggagggcatagaaggaggatgatttcggttttacaatagtaggaatatagatagttcgatttttctggggcggttaatattggtatttttaagacgtgttgggatgcataccgtcattttaatgaaacgcagtatatattgatctatttttctcaggatgcaagatgtgctgtatgttttgcttttttggaagtcgctggctttttgggagaaacttgggggtgataggcgtgccgagtggtgggaggaggaattgcaagacaacaacttctttttatgttactaaagatattttccagttgtactcctttttttctactaagattttagtcttatattttgttttagtgtaccgcgatatatatttacactttttactgtgcatgatgtgtcgcgtgtttttttttaaagccgccgctttttcctaagaaacttgggtgttaggtgtggggcggtaggaggaggaatcgcaagatgataggtccgcttttatagtagcagacttgttttctagtcatactcctatattttttctcttttctactaattttttattcctatatgttgtttttcagcattcccagggtcctactgtacataaaacccctgcagcacaaggaagcctaggagagagagcagagagtagaggatgacattcccctcacaacatgagggaatgccaacatgagggaatgccatctcgaacccctgaagttgtagctggtcgagctagtagaggatgtcatcatgtcaatgtcctccctatgtcgggcaagatcatgctgccattgacagcagcgtccagtggcagtgtggcactaccatgcgatgcgccggtctttactgagaagttaggctgcctctcgtatagaaaaatgtcgtaagttttcaagcacatcgccattactgcaagtccagtaaaatgtaaaaaaaaagtctttagtacaattcaagggaatttcaaaggaattgcagggaactttggaatgtaggattttgaaaacatagaagcctgaaaagaatataattagaatatcttgccaagcaaattcctaaagaattagacacactcaaatgttccaaaataatagtttggatggtacataggaataggaaagataaaataatagtggacacaagaatagaacaccacgagaggaaaccttaattggatttccacataaacttttaagcatcaaccctttgttatgaatgacttgataggaattttactgtaagtattcaaatcctgtaaaaattcattcacttttcttttttttccccagaagtgcctagtggttatgattactaagaaaagcttcactatgtaaccgttttgatcaaaggaaattaaaacaaatgaaagtttccctcaagtcaaaaacgatattgaaagtttccctttccaaccatggcaaacgatcgttccctactttaaggattcatgcatcctgaacagcaagatgtctatatttcgtgttcttttcagttctcctggtaaattgctcatgctatgctcatatcaaattctattatttgccaaacacaaatcatccattttttggccagtttttctagaggagtactgatcaaatcgtctatattactttgccaaaagattgccacacctcatattaggcaagtttgaccaagttaactcattgtttggttcatggccacacttgtggtattccctttcatttctcatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcatagaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtgatgggcgaccacgcgcggctcatgtccttcttgtggttcgccatggagcttgccatgtcatcgccgcttttcgcgaagctctccgcgctcttctcctccgatgccgcgtgcctcgagggcctggagcgcgtccgtgggcgtggccacgagcggctccgtgtcgtggcgtataggctcggcggcttgcggtacagctgggcgccacggttccgcctcgccgtgctgctcctcctacgggacaagtttcccgagctggttggcgccatcgaggtggttgatcccaccgtggccccagtggagcgccgggccatggaggagctgggctgcattgtcaccacatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaacgttgccattatactcctctacggcccgtccactgtctcttttctttattgtcattgagattttaaaaatcgaacataattatcttttgggttcatttttactttctagaagtcccgccaaaccgtcagcggctttgtcattgtactcctcggcggctcacccactggctcccttctttattgtcattgagattttaaaatcgaacatgattatcattgttttttttactttctagaagttccgaacctttaaaaattagacttgtagtttcattttttataatttttagaagtcccatcaaacgatgccactatgcccctctatagcccgtccgccgccgactctttattgtcattgtgattctaaaaatcgaacataactattgttggaattcatttttttattttctagaagtcccgtcaaccgttggcggctctgcaactatactgttatacaccccgcctactgcttttattgtcattgagattttaaaaatcgaatatgattatcaatgaggtttgtttttttttactttatagaagtcccggcaaccgccttactcatttgcttcacagcctgcctgacgtccctccctttaatcgtcatttaggattctatttggtgttttattaacaatttttgtatggcgtattaataccgttttgtgttcttttaatgcttttattttttattttcaatttcagttgttttaaaattgtattcctactttaactctctttttatttttctattttagatattattttattttttattctaaattttaattaatctcgtattgggttcttatatggatttttctttcaatattgtttatttttaattccaaatttcagctaattttaaattgtattcctacttgaactcttcttttattttcttttgctaatttcggatttatttatttttttctgatgtttaattaatctcgtattgggttcttatatggactcttcttttaatattccttatttttaattccgaatttcagctattctta

SEQ ID NO: 37625 - DNA, 2181 bp, Oryza sativa
aaatggcatatattagcaattaaaaacaaaatggctcaatcgagtgattaatcattgcctagaacctctgaaaagaaatagaagagtgccatatgggtataacaacaggttccaattcaacaaaaataagtggagtattcatgaccatggtgcaactctatggacttcgaaaattcttgtggtcatttaaggagccccaacagtgaatataaaaaactgctgtgcaagtcatctactccaccttcataaagcacttgtaccaattcaatattttggggactgcttcaatcagcgttttaagcgtgttgctttcactggctgcatagaaaaatgtcaaaaccagtaagatatgcacatggctggggatataagatagtttgtgtaatgttataaatatcaataaagaagctgagctacagtacagtactgtaatcaaacatgacatataccaatatgacttgagtaaatgaggatgtatgagaacaaccacaatgtatgttgatatttcagaacaaacacaacagatttgcagaacttttggaatgacattccatgttccttgtgtaaacatataaaaataataggaaggatatagcacagaaaattggatcaaattagtcaaagcaacattcaaaaattaaatataaagtttcacaaaaaatttagtagcacatgataatttactgataactatagccttactgaatcggtgctctaagaatagagtaagaaaaacattattggtcagggcactcagtataacataataagtcatgaacagtccatgtcatagtgtcatacttttgtgtagtgtgttttttatggattaaaaatgttgtcacgaatcttacctccacatgcatataaactctcaatatttttcaaaagaacttctttggcttgctgctctaagaattgcgttgaaggaacatcttcaagtagccctgcctgaggcacaagaggaaagaaacaaagtgaggcacacacaactgttacatgaagataaagtgcatgatgtattaaccagagctgccaatttttcttgcaccaacgaacctggaatacttgatgcagcagagtaccaatcaaagcacttgttgaatattcattgctttttagtctgtcatcgagaacagaccttcttggacaatgaaaactagaagcaacctaaaataagctatatatcaaaatatgatgacaagataagatgaatgtatttttacaaacagttcttataaaataatatttgaggatatcatagcagcttgttcatattgatctgggatattgactacaaaggttataataaagagatggggggaggctaatactaacccgtgttccagatatgagtaattctggatgcactataacaagatttttgtcatgatcaataatacatattccatggtcagtgaattctccaatgacacttactgtgtcgcctgggctaataaggctatggaacctgtagtggtttgaaatatataggcaatagattgatgaaggttcatatgtatatagaaaataaaaatggaatcatgtcaatagttgcatataggaactcaccactcatcacacaaatggactgcatgctctttcccaccgtgctcattcagcaaacgtaaaacctgtcaaaacagttagcaactttgcaaaataacaaaaatttaattgcaaactagctcatccagataggtaaagaggatatataccttaacaggatagcgatcacatggtaagttatcgcctttgtgcttttctgacacctgaaaagtaattaaacacataaatctctattgtactagaagtctagagcagctccaacttcgatagaaaccaacccatggaggtaaagaaagcaaacctccaacaccaaaaagctatcgaagggcggggcatcaagggacttctgggagggtacattttgatcgctgtcagcaataggagaacaactaatgtttttcggatcaccatttatgagctgctctcctttattctcaccatcagcaggtaattcttcttccatgattgcatcttccacttgatctaaaagatcaagtagtgcctggtaaaaagaaatggcatagttttgtcgatcaattctttggcaacttagttcttacatgtaataatatcatgaaaccaatggcacccaggacatttagtgttatcttagtt

SEQ ID NO: 37626 - DNA, 1569 bp, Oryza sativa
cccagccccgactcggcacctcgccccgccgccacgcctgccacgccacccgccctcctcgaccctgccccccccgccgcccccgtccgcttccgtggagccatggctgtgttgaggactagggttttcttctttccggtcgctaggcggttcgatacggcggaggcggcggacggcggcggaatgggggatcgggttgggaagggaaggtggtgggaaggcgaggaggagaggagaggagccgagaaggggaaggggaatggccgaaagggaggggaattgggcggggttggaaattggagttcccgcgcggtagagatttcggcggggtagactgcgacgtgggcccgtgacggcccggtgaaaactaggcctgaaaggagaaagcattggtccagaagtgagatttggcccataaaatattgggccccccttacacggttctaaaagcccatgtacgacggcaaagtttctttcgttccctcatggaacttgtgcaaatctcatgaccattttttgcgttcctctgatcaagtggtgtacaagaaagtctcctgcgtacggcgcactcctcctgtgattcttcttcaactcatcaaccatcatccaggttctgattcgataatttgtcacctatttagattagagatctgatgatgattgactaccacgcgcatttgttcccatgtatcacctgatctaaaaattggtggtaaaaatcatcaaatttgccggcccgcccaagtacaaaaatggccaatcgttcaccggcgcacgaggattgacagccacgccaaaaagcgcggcgcgcgaggagtgacagcacgcggacccgacagccctgtcggggcgagagcctcccaactcgcgccacgacgagtcgtcgtcagtcagtcctcccccttcgacttcgaccaccagacgatggatcaacgctcgccaccttctccgagacaccgcgcgtccgtactcccatgtcgattccaggcgaaacaccaaagacgatcgtgtcgctcgtcgatcgccattgcccaagaacacacgcctcatcacctcatcgcctcgtcgtcgggtcctgcgcgagttttctctgccggtggttggggcgatcgatggaagagtaataaagaggatacatccaatcggtatggttcgtcttggtgaaagatggttcaggcaacccagcacgggaaaaaacgccgtaatttacttctcttctcgatcactccgtcacggccgccaccgcgaccactttttcccgtcgagaaaatgttgccaccttttgttggttcgccgtggtggctgacagggatccgggtgaagccgctgctgcacacgccgccgcgagcggaaaaggctccgggagaaccaaccccgagtggcacgtggggaggctgcctgccgcgcggtgaagcttcggtcacggactcgcggctcgttttcgcgctcgcgcgcctggtcaatgggttggcaagtggcaattgcgacgcacgcaggtttggatcttgctctggcctctggctgctgcgatcccagtccagcgatgtctcgtgacggtccgatggaggc

SEQ ID NO: 37627 - DNA, 720 bp, Oryza sativa
gatcccccgtttttttatgatcatccaacatcatcttgatttgttcatcatttagaatctgtacaagaccttgtggagggacataagaaggcttcaagtagtatacaccatctcctttttgatatccatgtataagcaatgactcctccaaatcgataaatttcagagaatccctgtctaaaagataaatcgatgaacaaatcctttccccaccagatttcctagagcttccaccagttgtacaaccagtatgaacaatgaaggaaatactagttcgacccatctgcagagattataccaatttattggtttgcaacctaaatcaaagagcaaatattcgatgatctgaatctagtaagacaactacatgcataaaacatgatctaaccaaaaccagggagaaaaaacgaacctgtagaatgaattgacgaggtgatcgaagtacaggctgctttagtgcttccttctatgacttctcttgccgggcaggagatttgatatcccttctctgtactatgcgatcatcgtcgtacttcgccgttgtaccgctgttctttcgccgccttagtgttgcagtagagatcgcgaaattaaagcagggaaagatggaaagtggaaggaggtgcgcgcgcttttgctgccaaggtggcacaaagcaactctacccgtgggcggcgctgaaggcccacgataacgagaaattgagcgcatcacgagaaa

SEQ ID NO: 37628 - DNA, 6709 bp, Oryza sativa
aatatggcggtgccttagtgccagtcacaatcgcagcacagtccttcttccaaatatttcaggtagcaagcaactattggatggcatgggcatctcctccaacatcagcaaccaggccaactgtcggattagggctcatgtttgccgtatacatagcattgtcaattggaagtgccttgtgtgtctttgctcggtccatgcttgtttcactaattgggctactaacatcagaaaagttcttcaagaacatgctccactgcatcatgcgagccccaatgtccttctttgactccacgcctactggaagaattctgaacagggttaagactgacttagtttgtaaaccattttatactgcatcacgtactctctccacccctaaactaataggtgtgtatttatgctttaacaggcctccaatgaccaaagtgttctagatctggaaatagcaaacaagcttggttggtgcgtattttcagtcatacaaattctggggaccattggtgttatgtcccaggttgcctggccagtttttgccatcttcgttccagtaacggtggtctgtttcatgtgtcaggtatgaactcccaacaagaaaaaaaaactttattactagccttttgtactaccatagcaccatgtgcaaaagtcactctgtgcaccacgatgagttccaagaagctataggtacaccttttctccataaattatagcgttcattcacaaaatactgaaaccatatactctgtgtaatgtgcagcgatactacataccaacagcaagagaattggctcgtttatcacaaatccaaagggctcccatcctacaccattttgcagaatcgcttacaggagcatcaagtataagagcatatggacaaaaagatcgtttcagaaaatcaaaccttggacttgtcgacaatcactcccggccatggttccataacatttcttcaatggaatggctttctttcaggctaaacatgttatccaactttgtctttgctttctctttgaccctgctagtgagccttcctgaaggttttataaatccaagtaagctctaagaagaacttaggctcttggtgattatggaagcattaagtcactctatgttggctgttttcaaacttatatattgtacatgcaggcattgctggacttgcggtgacctatgcattgaacctcaactcacagttggcatctattatttggaacatctgcaacacagagaacaaaatgatatcagttgaaagaattttgcagtactcaaggatccctagtgaggctcctctagtagttgattatcgccgccccccaaacaactggccacttgatggaaatatcaatataagatgcttggaggtaagtgcaatggtgctatgagctgtgaatctagacaagaaagtttataatgcaaatataattttatttagcagaaataaaataaattttatcatcaggatgagttcaccagaaaacaatataagtttgaaaaagaacaataaatgcctaaatgaaaattactactcgggaaaaattttcaaaaggaaaacatatcttaggaaggtgctttatttcctgataatattctattgaagaggagaacaagaacgcatacaaaaatctctgaagtaggcttgtcatggtttcacttttatatgtttgcataagagaaaaagagtgtcttgaatcggaaacagaaatgataaaagtgacaatttatttctatttctgtataatgaaagaaatcaatattacaataaaaggaaagtttatttataaattttcttaaattagtagtctttgctcaaatgaagccatccaaatgccgtcttcacttttactattttacaggttcgatatgcagagcatctcccatctgttctgagaaacatatcatgtacaattccaggaaggaaaaaggtggggattgtaggacggactggaagcggaaagtcaactttgattcaagcactttttcggattgttgaaccaagggagggaacaattgagatagacaatattgacatttgcagaatagggttacatgatttacgaggcagacttagcatcattccacaggatcctacaatgtttgaaggcacagtgagagggaatctggatccagtgaatgaatactctgatcaacgtatatgggaggtaattaaccaactatgcacactttcatgataaataaaatgtttttcatcatatgaagtagagagctttactctacatatcattagccatatcatagctattattgcttataaatcataatccatgttaaataacaccttgctatgtatggataatgggtacctgctatgaaatcaatatggatatagtaagactgtaagaatgtgatgtatagtgagtagtaactgtgtcaaatagaaaacgaaacttaattcttctattaatttttttatcagaatacaattattctattatttgattagctatcttgtttaatctccttctggccagatattggataaatgccagcttggtgatatagttcgacagagcccgaagaagctggattcaacaggtaatgtatcctttttgggttcagtggtaaaatttgagaaaagtagggatcagattagaaatcctaccacaagttatgaaatgatcaaataagatttggtctgcagttgtcgaaaatggggaaaattggagcgttgggcagagacagttgttttgccttgggagggttctgctaaaacgaagtaatgttctcatccttgatgaggcaactgcttcagtggactcctctacagatgcaattatccaagaaacaatccgcgatgaattcagggattgcaccgtgctgacaatagcacatagaattcacacagttattgacagtgatctcattcttgtcttcagtgaaggtaagccacacccttgacaaacacatgccagttttttacatgccactaaattgtgcgctcttatctgacgagcaggaagaatcatagagtacgacacaccattgaaattactggagaacgagaactctgaattctctaggctcataaaggagtattcacggagatcaaagggcttttagcagtgcggcacactacaatttgaaaagcgaggagaacagcatgaagccaaccaagcgcactacaacaacacacttgggtagaaaggggccgcactccacacgatcccaaatgacaaagaacgcacaaaacccacagaaatatacaccaactaaggggcctaccgttgatgttggctagctcttaggttcaggatgatccccaagtaaagaaaagaaacacaatttatgtagagtactgtaagtatgagctcaagctgaagtgggggaaactttcccccaactcatgcaatgcagcgaagctactcatagtccgaatgtaattgcttgaaaaacaaataaaggtaatacaacggagcgagattttcagcgaggggacttacgcgccagcgtgcctcactccactcaggcattccgtcgagcaggcaggcggcgttcgcggttcatccggcgccgcggtaacacgcgctgatccgagcgggagggtcagggcagaagccagatggcggtggcgaactggcgatgcccaccggcttgcaatgtcggcccgggattcggaaggggagcggcggggttcgctcgccggcggcgaagcccaggggtgacggcgggtagagggacacggtggcggtcagaatattgggattctccggatgaaccgcgaggcgggctaatcgggatcgtccatcgttgatctaaccgcttgcaccacattgcctatctgacaattttctctcttaaaaaaaactggcgtgccaagtgagccagtggttggttcagtgcttaactttgtgcacaaattttggcaatttgaccctttagagtaggtacaatagcaggctataagccaactataaacatattttaaagagataaaggaagagagagaagagtaatattttaaagagataaaggaagagagagaagagtaacggactacagatctgtaaccatagcacggactccaagacgtaacgtgtgtatgacaggtgggatcaggtattaatagtatatatagtaagcaagtattgtatgaattggctattacattggctatagataatttggaattagtagttggctatactattaaacttgctcttacaaaaactaattatacaaatgaaccatggccaaaacttatttaaaaaataacccttttgttcatcgccaaatcctatggcgctgaacttagacacctcagcgccacgtcaactggaattgaatgtcgtgccaccgtggatgggagtctgagtcggcgcgccaatgtgtattcagcgccgtgctatttggcgctgaggtgtctaatttcagcgccatgggatttcgcactgaacaaaagggtcatttttaaaataagttttggccacggttcatttgtataattaatttttgcaaagggtcaaattgtcaaaatttgtataacttcgtggctgtgtttgcgaaagaagcttatgctcgcacgaaaaacgaggtagtccattaactcataatataattaataaagttttagtttttcttttagagaaaatattaatatgattttttaaaataacttttattttattataaaacatatcgtttacggttcgaaaaacatgtgcatagcgaaacatgcgagtaaaagtgagaatttatagttccgaacatggcctttgtcacgttaacttaactgtggtaactgtggtatggttcattgtgtgtggttggcttagcttattgccacaacagtgttttagcagtataacagtttcttattagcaatgtagctcacattgttaataatgcagttgcaaggggtgtagttttaacttcaagatttcatgttcaattcttaacacattcacaactttctcttaaaaaatacttggagggaaacatcttccttcaaatcgtaatttctttttaaaaaatgttggagggacatttctcatttcaaatctcgttttttttattagccaatgtggctcacactcacacaccatacagcgcaggaaaaagtcgcgatcatgtcggccgattctgatttctacaaggacgatacgcgcgtatatgtggtagtggtgtctgtgtgtgtgtgtgtgtttttttgttgttgttgattcagcttcgctcggtagtaatgctagatgtggttgccattcagaaaaagttggggcttggttttctgcagcagccggccgctacggcgttacggtgcaacaacagctagttcccttaacaacgaatgatacgagtatactggccccatcgtttcgcttattcgcggaataaacgaaactgcatatttacaaacggaaaataatatgtgaataaagactttatatacgtattcttagtgatctaaaagcaaaggctgaaaaaaccctaaattcaactccaaatttaatgttgaaaattcaaaatttagctaataagtataagcataaacgaaaagatgaggccgtatgactcccgcatggtaaccaggtatagtttgctaccctctcttttttaagacgttttaactaaatttatataaaaaagtaacattttaaagataaaacaaatatattattaaaatatactccctccatttcataatgtaagactttttagcattttccatatttatatatatgttaataaatctagatatatatacatatatatgaatgtgggaaatgttagaatgacttacgtatgaaacagacaaagtatccaacattgaatttaatgaagccaattagtattatagatgttgctttttttttacaaatttaataaaactcagagaagattaattttaaaaaaaattcaaaacgtctcataatataaaatatacgaagaactatggataaaaattacaaatggtaggcactgttcttctctcattaaggtatagagtttacctcggtttctttagcacttttttcaaacggtgcgttccatacgaaactaatcctattaccttttaagctagtaaatttatactttacagtgtatttgtgagtgcaaacaatacaatgtgtgtttaaatatcacaaacaatacaaacactgttctagaaatccttatgttttagtatagagggaataattgtttgatttattttgggaagccaccatacagaatttccctgcttaccgtcacgagtgtggtcattgtcacggcaatggtttatcactttatgataacaaacattgctcaccacatgttattgaattagttttgagagtaactttcactggtggagaaacgatctttgctcggttagccaaaatccacaatagtcccggttgcaataaaaaccgggattaaatattatctttagtcccagttcaaaagtttagagctgctttttaatctaacaccaatcgggactaaagatctatttttagtcccgattggtaacactaaccgggaaaaaagatgcctactatctttagttccggttggtgttactaaccgagactaaagatctatttttagtcacggttggtaataccaaccggaacaaaagattgtggcggagagtacgaggcatctgccatctgagagatcgaggaggaggagacgggcagccttatctcttcacctcttcctccactgaccttatctcttcatcccatctctttctcttcctcctcct

SEQ ID NO: 37629 - DNA, 2499 bp, Oryza sativa
actaaccttttacaaattgcctaaaactaaaacttgttccggcaccaaacaagtatgtgtccggattcttccatgccattccactactctaggtgcgcacacatgtctatcaattctcacaaatcaacttggggcctacctatcgtgcgagcgaactaagacaccattatctttgaactttgatagtttgagttatttaagtactatggtaggcaattattttaaccggcttgataaatcgatctttttcatgtcgacctgaagtgagtgaccatgtaaacagagttgtaaataccactgtagcgtagatttttttaaccatgaactagtttatgtagacatatgttatagctttataagtttacaaaaacttgttatgaagaaaaggttgcatgtagcgaatgaaagcagagctatcacattagataacggaatatttatactcgatcgtttgatcatccaccacaacacagattcagattggtacaccggtgccgatctgtcattgatctgagcctcaaggttggatccgaatcatacgatactgtctttacacgcgtcgagccagaaaagttagccaagtaatcgagcattagagggcgcatactttacacgcacttaagcacttaatgactgtactaatccaagtacgacatctaagtatataacctaatggaaactactagcaaggcagtcccccgtgctaagttgtaagctgatttacactaatgttactgttcagcagctaaggacaatctctagtcgaaacagtagctgaagccaacggcttcaacatggtgtacaaagaaactgcaaatcaatcaggtaagattcatgctaatttttgtcatgctcatgtgaatggaatcttgctttatcgtgtgctttctactgaaatagaagtttttcaaataattattcctagtcatttataaatactttggaaggaattcctaccttccggagcagatcacaaccatttcactatgtccccacaaagatacggtagaaccagcaagttgaatagatagtattttttgggacacaatagaatcaataatactgcataagattaacctacacgtaggaattataaaggcgctccttgatggagcatttcaatacaacattatcacaagaagaaaatgatatatagaacacaatacctgggagcagcttgatccgtctgacctgccattttgccaagctacctgagaacaaaggtgcatacatactatcacactttaatgcgaactgaaagtatgtatttgcaatacaggcattaggaatttagataagagtatttgcagaaacctgatgtttatacatacaatctcatagattctcttaactcctaaggtagatgttctaggactccttacacttcgctgcggtgtcccacatatggcgtcctccttgattagattaaaactgtactgtatgtctgcatcagaatcatagaatgttcttacgatgttagtagttctgtataaccagcatcctctgttcagttgaggtaattccccttcaccttccatcaaaatgaccgtaggtgtacaccttgaaaaatcccagatagccagacaggtgaacagtatgttacagaaattaagagcatgaagaaggcaatgggggtctagataggtcatgttttgtggctgtgtgcatttcttgcagaggtcgggagtgggctcaattagaatgtatcatcttgttgtatttgactgagttttaataaagcttccattattgagaaatgggcaacatggaaaaataacatatttcaggcttaaacttgcgatgtgcaacaacagaaaagaagaccacagctttgacgcagtttattaagtttcatataatagaatacttgagttctgaggtttttgggcctggtttcccctcaaaaactgggccaagtctcttcttctttaatgaaaacaggctctccctgtcctcttctaaggcttttcctcaaaaaaagaatacttgagttctttatgactaagcaactaaatagtgtagttcacaagttttacttggcatacgtaccataaaatgaaattaaaggtatggtttttgcaaaatggcacacttgtgtcaattatcatttgaaccagaagaaatatcagatttttttaattctccttttgtacaaatacacgtttgttcattgcaaaacagggatccaattcacctgcggcacacaagaaccatttccagatgcttcaaaagaagaaaatgtgaaaaacaggaggaaatcttcttatggagaggcaactatttcacaacatttcactttctcttggatgaatggtcttcttgctaaaggtgccaataagcctttgaatgaggatgacataccagatgttggtgaggaggaaagtgcccaacacatctccagaatattcagtaatatcattgtgaaagggaattttcctctgacagtttcatcgatttgtaaagcagccttccttctcatttggaagaaggcggcactca

SEQ ID NO: 37630 - DNA, 16674 bp, Oryza sativa
gaggagaaaatcagcccgtacggttatctcaaaacaactcggcctccttccaaacaacaatctcaaaatagcttcgaaaagttgcactaccgttcgtgatcattgatcgaaaatcgagcattgtgttcctttcacaccaaccagcctttatacaaagataatttgttctacgtatgcctctagctcgtccgaaaacacagtcttgtgctcagtcaccaacctgctagcttttaggctccagttcgctctcgcctggcagcagaaagcacacaattgtccatccttcgagcatcctccacactcgattggacggacacgctacaaacaggtgatggcactcttcctgcattgctcggcattcctgaaattagtgcgaaaaatgtaaacatatatagcggtcggaaacacatcgtttataaaaaatgattatcggtcgatctggaatttccatattttattagtttaactatttagtggcaaatgcagtatggtgctagaagaaattaaaaatagctaaatataatatgtggttaaaagtgaaaatgattagaaactatactatttttacataaacgatactcggtgagtcaagaatttcgctagcgtttttatccccaagtaggcgaaatgctgcagctgaagttgtaccatgtgccaacagtcagcatcatattatatccaagttaatgagggggtgtttgggaactagggtccctcttacaaaagtataagtccctatgatagggacttatgtttttgtgagagggactaaagtttagccccactttagtccctccaaccaaacaccacctggaatatctgcaaaaataaaactcccataggaaatcgttactctgcctccagccgaaaatattcgcatgtgtggtgcttggaacaaggttcgatccaactttgagaattcggattatcaattttttttatagatatttagtttaaaaacaaaataaataatatacttggatttgcctaaaaaaatactaccataataccataaacttaatattaaaatgtactttttacggtaaagagatagctttattgataactgaacgaagggattagattcctgattcaaccaattcaaaatccgtgcaagcacacataatctcccctcctagcaagatcttgaattcgtcgtcgtttgattaagagtatgtactaccctcttagcttcttttcctattttgtgcacttgcactctttgaaagcattgcatcgcacctttcgtttcatggaccgtcgttgccccagccgatctcgagggattcttgttctcgagggattcttgttcgattaggacgcaacaacttcagcattgtcagttttcaagattagcggcgtatcatatgaatccatcccattgccacccgaagtcaaaatttacaaacacattctaatataaaattgatttttggaactataaaagcatgagcaaatctttatctaaacatcaaatatttaaaagggagcactacatttaagtatttaacggcaccctatctgtaacttggtgatggactaataagcacaaccataataataagggtatcaatcagatcataattttctttttcgttttatcttcaactaccgctcatctcatttaatgataaacaccaaagttatttccccccaactttattctctgctacacaaataaaaatgagatgagcgtggatcaaaggcagtactcgcttgccataatcgcgtgattcgagacatgctttcagcgttcagcctccaagcaaatcaaatctgtgtgattcatacacaaatcctttttcccttttcctttttgccgcaaggaagcaacaaaatatctctgacacactctgaaactgtgacagacttgacagtcaatggaactgaaaacgcaacccccgtgccaagaccattttcttcccacagtccactgcgcgagacgggagagacggccgcgacacaaaggaagcccaggagagacgcagacgcccgcccacaaagcccactttgcccatggcaacttccgcttcactgcctcctcctcctcctcctcgcagtagtagtaaccgcctcatcgcctcctcctcctcttcgctgcatactgcatactactgatcagctcttccgttctcgcggctccagatctctgcagggtgacgggggagatggcggagacggaagaacctggccaagatcgacgagtactccctcctgctccacatggtgagggttttaccttctcctctccaacttttttgatttgctgcggcttctttctcttcacgcggcggtcccgtggccaggcctgatcatggaggagttcgtgatgggcgaccacgcgcggctcttgtccttcctgcggctcgccacggagctcgccgtgacgtcgccgctcttcgcgaagctctccgcgtgcctctcctccgacgccgcgtgcctcgacggcctggcgcgcgtccgcggccgcggccgcggacgcgagcggctccgcgtcgtggcgtacaggctcggcggcatgcggtacagctgggcgccgcggttccgcctcgccttgctgctcctcctgcgggacaagttccccgagctggtcggcgccgtcgaggtggtggatcccaccgtggccccggtggagcgccgggccatggaggagctgggctgcgttgtcaccgcgtcgcctgcgctctgccttgtggtcgaacagccaactctgatcttcatgccctacgcggatcgcgtcttctttgagaatttgctcaccttgaactggaccccagatcagctcggcaagatcgtcgttctcgggcacagtttcagtgccatggtgaagatgcttgagctcagcatttcgaagcaagagaagtgtggtgtcactgagcagagggagaaggtgaggagggtactggcaattcagagctatgttcaggaattagagctttgtgctgagatatctggtttgttcgataaccctctcttgggagatgagtatcctgatgaattgaaccggtctgtctacaatcattcatcagagaagtgtatatgcatgcactgcattgcgcatattgagagggctgccatgatttatgctcttcccagcatcttttcagttcatttctttcagtttgatcctgaagttgatattgaacacttgataccaggttcttttgcagcccatttccctttttgtaaaagcttaacgtggtgcctacatggactatgttgtctgatgacttgttgctgctttgtttgatgcagataattgtgctacaaaggtctggagttatgtcaatgtccaaatgaattgtgatgctcagttagaagggtaagactgcatactgacaaaacaattaatttggaccagtttcccatgattatttgcttgctgaattctgtgaattttaagtaaacaaaatgatgctttggtttaaagaaatatttaatgaaggataactcaagcaaagatgattacaccattttaggcagctttcttgcgtgtaccctaaaaaaagggtttcttatgtaaaatgggctattttaccgtttaagtgagatttgcattaattatagtattgctacaatgcatgttcttcttttacttcagtgattatagtattggcagattgctgcagcctgcagcacctgtttgttgttttatcaatcatcgactatgtttctaggccatctgttttatgatttttcacgtgcgctaataattttgtgggatgtattttgtcgttcgctattgttgacttcacaaattaattccttttctaaatgaattaatcgaccaggtggcatttaaatcctagtgatgcatacattgaggacaagcacttacaggaagctaaaagcatagttaaagaaatgcatgaaactatttctgatgttaggagttctgcactgtacacaaagtttattgatcatgtgaagaaagatgagagcgtttcttctcacatttcaagcatgttgggagctcatgaatgcatccaattggttatttatggccttgggagctttgaatttgatgtgaagtctcaatatcagcttgccttcgctcttcttctaaaggcagataatatattcccaattggtgacattgaaatatatgatccagcactctctcctgctgatgtcaaagcatgcttcgacttgggtctatgagtgcttttggtgaatgagcaatgccaaagaagtgttaacaagcctacacttttctttgttccaggattgaaattcgttggaaatctcattgagtcaaatttcactgctaagcaattaaataagatcattctagtttcctatgggttcaagaatagtgggaaaagtatttctgctgcacttgaaaacaggagctgtggatttactggtatcaagggttccttagctttggaaagagacaggtttctttgggcaagtattaattatattgatgaagtaattgttttggaaaactttgatgaggaattctggggagtctctgaactgagggttgagtttcttgatgttgccgctgatgtggacatgaactcaaatgtgccaagtatgtgtgtttttcttctgaactcattttttttttcggtactcttgtttgatggtggagctaactttgcagggttgtctcttaaggaaaagtttttccttaactttgaattggaactggaatataattccttctttgcttttgagtaagacctcttgagacttaagggcaatatcttgctacttaacattcttcatttgattagtgtttgtacatgctgaatcaaaatttaggtcaataagactaattatgtaatgttcttgtgtttgtgttttcagtcgtgtcttatttccatatgcacctgaaagaaagaatgttgcgtccatttaaacaagatcaaggcgactgcaaggatgatgaacctcaattctggggacaggagttccagcaccgaatcccagcaatccatcggaatacttggtcccctccacccaagggttggatcaagctcaacttccatggcactggctgctccaaaaatcgttctgctggcatgggtggtgtattccacaatgatgaaggtgcactctcctacttcatcggttccttaggtaacgtggatcagactgtggctagtattcaagcacttgaacatgggctagaaatcatgcttgagcatcatgaaccagttaaaaagctgatcgttgagggggacgatctcacggtgatacgttggtgcaacaaaatctcttgcccacctgcaagagctcatgattcattcttacatagctactggtacatggatttgatgccgtgtgagggggctggtgtgcttgctgggtcatccaaagagactaacaatgagagtgatagttcttcacaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagctgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgcagcagcctgcgcatgcctgatggcgtccgcagcctctcccttgatgccgaggaccatcacccacatgtagcgggagaggtcgtcgacgagcagcaggaagtaacgtcgtcctcctggtgtggccggtgtcactgggccacacaagtccccgtgcacgagctgagccgctccttggctcggaagctcgtctgctggggaaaggggagccgccgctgcttcgtcaccacgcagacgtcgcagagctgctccatgtggtcgaggcacggcatgcctcgcaccatctccttggcactgagctgcctcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggttcatcaaggtggaggaaagccgctgcggccggtgccgctggaggtagctcgatgcttgcgtgagctaggagcagagccggctcttcctcctccacccatgcgacgtgggcctggccgcgtcgtggctgtcgacagtctttggcctaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtaagatggagcttcccgccgatggtgatgggccccgagagaggctgtggctcatcaccatcaacgaccttgaggcgacctaacgcctcctcgatcgacatcgtggagaggtccagcagagattcgatcgagcgagcgatctgtctgtacttctcagggacgcagcggaagaacttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtatcggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgccgtggaggtgggctgctgcccaccgctctgctcgctcccgtgcccttcctcttgccagctcctcaagctccctgtcggcggtgatgtcaccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagtggtctgagccgttgctcgcctgcgctcttctgctgcggcgagctcggcgtcctgctgacgccgagtgctcaaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggagcaattttctggttttcttcatttactaaacacaaaagccatgtcctcccaaagaggattggatacatatttatagctgcttgtagcagccatgcagccatgcaagtctaagagggtgctgtcgtagagcatccaaactgaaagtagagatgctgtcctagaaaattgaaaagcaggaaaaggcaccacaagaccaagaccaaccagccaagacttattcctacagatgcaagaagtggtggcgcaatccttttgtaatattttgcagattatagtatgtctatgttagcatgttacctgccatggattcataacgatgagaaagaaccaatgatgctaatacaacagatccaggattgacatctgtttttttttagtcacctgtgcgtgagtatctccttgtgtatttgcagcttgtgtgacttgttaatataaacatgctacaacatcttggtttttttatttcagatgaacagtgggtttaaactttttactcctttgctagtagaaagtggctttgattctgcgcggactagctgcagcctgcaggttataaccctgacgtcacgctatgttgagctcccaatgggcctaacataacggcatagtgggccgttaacgggcctcgtacctgtacggccgaaacggatcggagtagcaaaccaaaggaaaaagtacacccagggtctctcaacttgtcattgggttacaaaatcatccttgagctgcaaaacccgatatacgatatacgacgtcctttaacttacaaaaccgttcactttagtgcatagacggttttgatcccgggctgagtcaacgtggaacccacgcgggccccatatgtcagtataccacgtcatcgccctctctccttcccctcctctccatttctctctcttctctgtcttctcgcaggccggccggcaggtacggaggaagccggtggggcgaagcgggagaggaagagagcgacggcggccggcgacgacgcgggagagtccacagccgccgtacagcgagggggcggggcggcgggagaaggcgaggtgggggcgaccgcgacgcagagaacgaggcgagctcggaggtgcggaaggaacgccagtagacggctcgggcaccggcgatgctcgcgaccagttgaatgggatggtgccgcagccagctgtgggcgccgcggtcgacggcggtgcgcactgctctccgtcagggtcgacggcgcagcgcggcattgggggcgccgtggccaacggcggtagcgcgcggctctccgtcggggccgatggcgcggagcggcatgggggccgccctcaggaatgacgccgccccggatccagcagtcggcggcggcaaatgtggcgagggacagcagcaagaagatggatgagatggggaagaaaagatggatgagatgggaaagagaaagagggacgacgccgccctggatccagccttctccgctcgccgccgcctcgctggcttcgcgcgccgccgctccgcctcatcgtcgccccacttcgcccgccgccgccgccgccgccccgctccatcccaccagctccgtgcgccggcgctccgctgctcggcttctcccatgggaagatgaagagggacggcgccgccctggatccagccttcttcgcccgccgccacctcgccggctgcgtgcgccgccgctccgcctcgccgtcgccccgctccatctcgccagctcagtgcgttgccgctccacttgctcagctgctcccatgggagagagccgatagacacacagaagagaaggaagggggaagaagaggctaacacgtggggcccacgtgggtcccaagctatgtcaggtgccaagtcagataaaaccagagtgaaaaccaccggggatgtgttgtatctggttttgtgtggttcaaggacgattttgtaactggatgccaagttgagggaccttcggtgtactttttccgaaaccaaaaccaaaccctccaaattttctcaaaaaaaaaaaaagaaaaggaaaaagacaaacaacctccggggcttctgctctcgcccctcgccatgccaaacacggcggccctcgctggcgtgcgcggaacacgaacctgaggccctgagctctagcgcggcgccacgcgcgtctgcgtggtgtttcgcactcccatctccgaaatccgcagctgcgcacggccttgcgcgcggttgcaggccaccgcccgccgctaccaccctgcttgaccagatgcaagctccatcttcccagtgttcaaatccgtaagcactgctcaccaaatctcagtatcaagtctcaagcattcgttaaaatcagtgtgcattcgtagacccagaagtctgggattaccagtctgtgctggtcaggggacgcgaaacagctgttcgacggaatgcctcaaccagcaggatgttttcttatctgggaatcacaagctaaggtagtgccatttttctgtaaattaatcatttacgctgttttgctattcataggttttacatgcaacatttagaaaattttacttggactacgaagcaattccctgccccttgctgagttgctgtggcgcggatacttcaggtgtgtcgtggggaatatagccatgtagaatgtagtatgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatgtttgcttctgcacgacttatattccgggtggcttctgataattgtgtattcaaattccatgcatacatcactaccagcccaccaatgcctgttttgcagcaagagaacatcaacccttataccagaaaaaagatatttatccttcaagtttgaatgacggtagaacagcatgagtttacgttcaattaaattcatgggtccgaacaagtcaaaacttacttggattaacaaaaccttgtggaagacgcacaagcaaaaccaacgagaacccaaagacaaagttgcataacaaattcattctgaaagagagccattctactgcagccatcaagtgaaaccatggtcttgaatgattgtcaagtagactcagatttgatctgtagaaccggtcttcttggcgaaatgctcgaattattgcagctccatagaaagtttccccaaaatgatgaagaattggagccttttgaattcctgataggcgagctaattctgttgctgttagactgtaatatctctgcaggatattatgggagatatgattcattctcaataggcatattgtgtgtactgatactattttgaatctgactaagttacagttaactcttacctgatacctgatgcaaatcaatattgatggaataaaaataatgagaactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatggactgaccctgtttaagattcgccctgtaggtgtcgagtcaaagaaagacataggagcatgaaagatgcaatgcatcaggctcttgaacaaaaattctgatgtgaggaggcc

SEQ ID NO: 37631 - DNA, 4905 bp, Oryza sativa
  unsure (1)..(4905): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagacgacgacggcatgagtggtggaagatagatgcaatctaccgaggtggaaaaggctctgataccatgtgataaaatgtgaagcgttgaaccctttgcctcgggccgcatctctgttaaatagtggtagaaacagcctctaccgtggcttacaatgttcagttacaagtgataaggagatagaacaaatttggagataagaaactaatcctaacaaccttatcactggatgagctattacgggtgtgagcagctgcgccattatcgcatgcatgcgccatgcaccatgcgaacccccacgacaccgacactgtccactgcttgtcgccgtggtagcacaccgactgctgcgccacgcccgccgaaatggcgccgtcatcctcgatctctccttcctctgtcgcctctcccggaccgcccgacgacagccatcggtggcgtcgccgccggcgcatcggccctcggccctcggcgcgttgcagttcatgacggcggtggaggagatcgcgcgtaggcgggcgacgccggtgctggcgccagcgtggggccgcgacgcaatcccgtgcctgccgtccgccgccgtggacccgctccccgccccgacggagctccgcctccagtacctcaccgtggacatctcgccgccgctgccgccttgctcccctgctcccgcgtcgtctccgccgccacgtcgccggccgccggacctcctctcccacctcgcaccgtcgatctcctccccacctgtcggccggcggcgccgggctacccagagtcaccagagagaagagcgagagagagaaggggaagggagagaagagaggaaagaaatagaggctgactggacaagctgacatgtggggcgcacgtgggtcccacgctgactcattagacacgtaggataaaaccgggatcgaaaccgccaagggacctattgtgaccagttttatatagttaagggatcctatatatctggttttgcggttcgaggacggttttgtatcccgttgacaagttgagggaccttcggtgtactttttcctttatccaaccatggtaaaggtgcagctagggcccaaacactttactggtcctgtttgtgtgtgtctcaccacggcccaattatgtaatgggctgattctgggttgtttcacagaaggtccaaccacttgtcacgccattgacaactccgtttgcaattttgctttatactccctccgtcttaaattataataacttaaaactggataggatataaaccaaaatataataatttaaaatcggataggatattttctaatactatgtcccatcggttttagattcttatatttcgggacggatgaagtatttgtttgctcagtttgacctagcaaagaagcgtatcattgctacaccttctcttctctctcttttttcgcgaggaattttccaattattgatcgctccaagttttcccgtgtaagttgaagttttgtcaaattcatgcaacaaaactaaagtaatccgacaggaatgtatggtcagaaattaatggcctcaactgagaaatgtatagtcagaaattaaggacctcaacggtataattcgacctaccactcagccaggcctctgttgtacgtgtgtgacaggcataaaagaaaagggaaaatttgaaccatgccattataattttgaaaaatttgagctataccatcctgacccacatgccattgactcatgtgggttctacgtgtcattgagataccgatgacatatctcaaacgttacaaaattataatgtcatggttccaaattaccaagaagaaaagggaaaaatgtttggtctagactatagagcaagatgattttgatccacaaaggcctcaactgaagctgacacgcaactccttggtcacatgcataatcttatatggactgcagatggattcagaatgcctaattaattggcccaataccacttgctgtgctgaaaatggcgtggtttagaaaatcttcggctggtcgttgcttattctgagacttttgagttctgacgcggaaaaagaacaagattgggaaggttgatcctgttgcttgctgtgctgaattgaagcagcaaccaagccactgttgtcacttgtccctgcttgcaaattgttgtcataatctaatataaggattcagaacttatgcagtttcttgtcaagctttcactgaaaagagttattgcagctaaccgaaacaaatcagtactgcactggcaatcgtctccctcggatgggcattagttcattcgataccgtcaacgagtaggagttttctgttggcctcatcaatactgtaacaagaactcgggtactggactaacctagtgttcactcccccaaagccaataatacgcgtacttgacccggttgacaatggcatgtggcttcggagttcatacagcgaagcaatgtgtactagcaaaccaacggccgtcagacagtcagcattaaagctttatgttcctcatcaaaatccacttttcatataattggcttctatataataattggctgtagctcttttgagtaaaggccgggatatttatttattccattatctaaaaaaaatcaaaatccacttttcatatactcctgtccttaataaacatatagtaatacccagcggagtgtagaaaagctctgggattactgcgaaaatcgaacaaaaaatacgccttttccatagtgatatcatgctgcttcttttttctcaagagatgcagcaaccggcaggcagagcgcacgatcgatcacaaggcgagcagaggttcgtgcatccacccatcacacgcccgcgcgcgcgcatcacagctcaccgcgattcggtgaaatcgcaagcttttggcaggacgacaacgacgacggccacggccaccaccaccgcactagcggagctaacctctgattaaccggaaaggtagcgacctttctcgaccagagcgagagcacctgccatgatgggagtccatccgagatgatgagaaagcgagctcgcacgcaacaaaccccggccaatctctgtcgaggcaatcacctcccaactcaactgcccatgtcgatggtggtttctagctaagcatgccccatgattgcgagcttttcatcagcaagtttattcgccaaatctgcagccgttaatgtatcgagtttgactttttaaatgcatcgatgagaatgatgaagccggttgaccttagtggcgcgccggtgagagcctgagactgagaggtgatggcaacagccatcaaacgagatcaaaagaactgtcaccgatgtagattcagaatttcagatcaaggtggcagtggaggatatgcagtttcagaagttacgaaaacctgcagctgggagaacgggagagccaacctacgtctgttggaggaccagtctgaagatttgctggatttgttgaccaaaacttcatacctgttcgagtacctcatcctgtacattacatgcaacgcgataacgtcaacgaactagtaaatgttgccaacggactgtgtactgaatccggcaactgtcgtcgtgtggttgaaacagtgctcgactggaagagccataccacaattatagtttcccggacgaaaatggaaacaatcgcttggtgcgcagtgtaccggcaaaagcaatgaagaaacaacaggaagagatcttgaatttcttgatcatgtcaacctctgccttcagaaaaagagaaaaaaggggacaaggtctctgactagatggtaaaatggataaattatccttatgaccttatcataaagttgattacgattctacaaccatcagccacgatccatccacagtgcccactcatcagacatcagatcgtggagggttcatgacttcatggatgcatgagtacagagttactccaagttgacattagcagttcagcactactgaagtactcccttcgtccaaaaaaagacaaactctggtttccgtacccaacatttgaccgtccgtcttatttaaaaaaattatgaaaaaaattaaaaagataagtcacgcataaaatattaatcatattttatcatctaacaacaataaaaatacgaattataaaaaaatttcatataagacgaacagtcaaaattggatatgaaaacccaaggtttgttttttttttttgggacggagggagtaagtaggagtacttagttctcagagttcagatcttcaattcataacgctcacattcaattccgctcacatggcttcattccctccatgccagacaccaactaaatcta

SEQ ID NO: 37632 - DNA, 894 bp, Oryza sativa
ggggttttccgcatcggcgaaggtcgccatggcgactccgccggcgagctcccctcctcgccgccttcgtcggcgtacctcatcgccggcgagagcccgcggttgctgatcacgtggcaagagtgccgcggcggcgacgcgacggccggatccttcttccgggggccccagggtgccatgatcgccgcgagccaagaacggtgcttccgctccttgctactgcgcttttcctccgacccgtgttgccgatgggctccgaagagcgcggcgagcacggagaacttgctgctgcggcgccggatctcgaattctatgtccccttcctcgaatccacctgcgccgcctccgccgccgccgccgccgccgtaggccggccccacctgcggcgtccggaaaaagaggaggctcggcgtgcgcctcctcgccccggaggcgtcggacttccggcggcacacgtacggcgacaccgacctcgggaaaaccggcaccggctccggcggcggcggcaatgaggaggcctcgttctgcgcggcggcgagcgcgagcaggcggtcgcggaggcacggcgcgcacacgccaaccccgccctcgtacgggtgcctgctgcacttcattgccctcttctctttgccttctccattatcaagcacagcagcagaggggagggaggaaggaaggaaggaagaggaggacgacgcggtctctcctctgtatatagaggcgccgcttttcaccttttcgtagttttcgtttgttcgatcggttcgcatctctctgttccctcgcttgcgtggctttttatggaagtgtgttcctctaccctactctaggaatagatgcacggttgcacactagtaggacaaaaacttccgataagaaatgttgaaaaataaa

SEQ ID NO: 37633 - DNA, 141 bp, Oryza sativa
tttttactggcaaggagaagccctgttacataaccattaacattggctctatacattttttgcagaaatgcctgatgggggtcctaagggataaaactgtgttatacgtcacgcaccaagttgaatttctagttgatgcag

SEQ ID NO: 37634 - DNA, 10043 bp, Oryza sativa
atactgcctctctccccctaggtacttcaccaagtcattgatcagggatggtccaacataggatgcacttgcacttaagactgcaaatcctgcattcattatagcttttcttctaataaataggaacattgctgtgtaaattgatttagtatttagaccatgcctgttctcaacatcatctatgatttttttgaatgaatcagaaaggaactcagcggagtccttcccatagacatctggcacatcattcttatctagaggtttcttgtatccaatagcaaacacagggttcatccaggagaatgtgacaagttgtagaagatttgcttttccatatgggcatggccttttgatttctgtctgctgtcctgtagatggactcaatagtggctctgttatgctgttatctacaagggtgattcctgtttttcccctggcggaaattacaaatagaagagtgcagataacaagcatgaacaggttaatccattttcaggtcctaaatattcatgatcgagtaaaatagacctgagatcaaataccacactggtaattgattgcagaaagctaaatatccaccatgctcgaattataaacggaagctttgcggatttcgtcttctgaaaactgaacactactagtgataatattatccaggatagcacctgcacactttcacctagaacaaatgctggatatttgcagtcacttatgcttccttgtaacaacaaaactactatcttcagagtatgacttgctaagttaagcaggcaacaaactttgcttgcttgatatgttatacccagctttttgtctgtgttcttctgttcctgatatgaatgcttgctttcagcagttgatgtcttaaatctctgcctgcaccaccttattctcttatacagaaactgaaccaagatactcatgatgaatatcaggtgtatcagtgcaaaagcgtccatccagaagcaaggtgagtacatttcttgccattcttgcaaatgttgcaatttagtggaatctgtaatgttgcaatgtaaatttatgtgttaagaactaacaggagaatagatttgttcaagagtcatttttcatatacccttttatcaaaagcttttactacaatgaaccaacacaaagtattatcgttggcttccagctaaagatacaacttctcctaggaatccagtgtactgaaaagaatattccatttccctaatgacaccataatatttcttttaatccattcaaatgttttgcaaccataaatccatgatatctagtaatgttatgtaagagactgtaatatctaataatgttctggatcgtttcctgtagttatatggatttttcttttaccaaagtagttatatggatatgagaacagaaagttaatcactgattgccatgctgagttttccttaaggaacatgtgtatggccacaagcaaatgtatacagctgttctcatagtaaacatgtaacttctgcgtgttatcccacctatcaacatgaatacgtttaacagaaccacgactgttatgaactgcaaccacgtattggtccttgctgtttcctgtctgctaatggttacagatgcttggattgttcatttgttcacattcttcttatccatgtgaagaatgtatgaactcacccaacatgagaaccccaaacttatcatgaacctttcgttttttccagttcccctaatttcttttgcaaacattttgcagaggcaggaaaaaagaacaagaagggaaaaaggagaaacaaagataatagcaaagaaaacccatgcagtgcaatcaaactcatggatgtctcggcggggaggaatcagacgtatgcatgaaccaatctctgcatgcagatgcagggtatgattaaaccttacttgaagaatcacggagcaatccccagcggagaaacgcctgctgcgccgtctcgggaatcctcgcgagaacatgcaagtgcaggctcgctccttccatggcgcaatgcgaatgagacaggggaggaggagagagggagggagagatgggcagtggccgtgaactggtgacggtgatatagaaggtggggaggcctgagtccgcgctagatggttacgggttttggcgtatcacggtacacggtgacagagatccaaaaatacggttttcaccccggtaaggcctggttcagttaatccctacgagatagggattggaggggatttattccacacctattgtgatgtggaattattctctctcaatcccctctaatcctctttaatccccacaccaccgtagaataggggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagataccgatggcatatctcaaactttgaaaaattataatggcatagttctaaattacccaaaaaataaatctaatattggatgtgtaataatttggaaaacgtaacagctccacgccctccgccccccccccccccaacacacacacacggggggcgaaaccctagcagcgccgccgcctttcctctccccctcccccacctcgccgccgccggagctcaccgccggaaagccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggaggccgcggagcggcgacaccggcgcgacgaggcggcggcgacggcgacggctacggcgcggcgacgcgacgacgacgacttgcacggcagccagcggcggccgccgcgacggtgagatgcgcgcgggcggcggtgctcgcaccgccgggggcgagcgacggctgcagcgccgccagccctggtggcagcaggccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgaccacggtcgcaggaggcatgacggcctcggacgactagctgaggacatggcagacggctacatcggaccggcgtggcatcgtttggaggaggggtcggagaccggcttggcatagagtggcgcagccgatgacagcggaggccggctcggcgcgagaggcgcggccgatgaagggaggccagattggcgcgagaggcgcgtccggtggaggaggctggcttggcgcgaaaggcgcggccggcggtggaggaggcgacctcggtgcgaggaggagctaccggtggatgtggcgcggtctccggcgcatgaagactggccggcgggggacaccggtgcaggggtcccgcatgtcggcatagctggagaggtggtggagcatcggtgcgtcagccaaggattcgcaggtggtgatcggcaggtgaaaatctagtccggccttggccgggccgacaacgatggttcattccccctcctgagggcgttgtcgtgatgtctcacccttcaagggcggttgccggacgaaagcctagtctcggcttctttgaaccccgacggacggcggcggcggttttttccgtcgcttctcttcttgaagacgtcgtttttggcatcccttagagggcgatcttgtctgtgttcctttgttagtctagcagcggtcggtcacgcttagcggtggccggtccggtgctagccttctcccgggttgtgtgttggcgctgtcggtgtgcgggtggtggtatatttttttcctttttcctggttacaaccctatagagttgtaatcttgtaattttttcatgatctatcaatagaacttcgcaccgttaaaaaaaatttggaaaaccgtatttctccagcgtaaagtaataattatattaacaatcatttgaataatgaaaaaaggaacaggccactgatgcgagatggcgatgccgcagcctaaagtcgtcgtgccgattgctgtagctggccggaatggtccgcgtgaacagcagcgcgaggagatggctcagctgcctcagaggctgggagccggagctgcatagtgctacagcgaaaggcagcaggggaggcacgacgaaatgggtatgagaaaagcaccgtgacagcgtccctttctccggcgcggatacctacgtgagcgaaagtgcacatagggttggggtcggattgaagcacgcgggagcgggacagcggcaagcctgcaactgcaactgcaactgtatcagaaattcgtcgtatcagtccatcagaatcagaccgatctcctcgtgagctgagctgctgccacgcgccatttttactgccatctcgttcatcatcgatcctgtcaaaattacggctcaaatctccgttgatacaacatggtttggagtttggactgtaaattcgtgccgattcggaagcaatcagagagagatagagaggggatgggtggtgaggtgatgtcactgcttagttcctgcttcttgtccgtacccatccgccgctctgggaggccgcgagaattcattcgctcaccgcctcacgatacggacccccgatcgcgacgcatattccaatttatctcaaaatacacatattcccatttctctcatacattcgttcgcgcgagtgtgggctccgcaccggtccaccaacaacgtgctactcctacctgcaaccattgcactacaagtctaccacctcccttttaaaataattatcgctattaattaagtgatgtagtatattttaggatgtaacgagtacaatactactagtagtaacatcctaacagggcaacacaatgattaattaactcatcacctgcagttaattaattagtgagccgctagccctgactcacttttcggcttgtatcaacgctggcgatggccgcgatattctcgacgccgaccgctcggaccatcacatatacggcctggccatgatctctgcagcgcgacacgcaagcagtctcagtgcacacatgcaaccctatcatgcatccggtgcacagtgcaagccgttggatgtctgtcgattcagttcgtacgtacaccggcccgtgcgctacataatgcatgcatatgcacgtagtgtgatgtatgcaagctgtaggtgggtacatgtgtcgtggtttctttcgtaccgacccatggccgagtctgtacggccattaattgcacttggaattttctagtaaaacgggtcaatcttgattaattagccatgtgcttaccttctactccctccgtcctagaaaaaaagaatctagtactgaatgtgacatattctaaaacaatgaatctggacagatgtatatccaattcgtagtatgtatcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacggagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgaataagacgagtggtcaaacattgcaagcaaaaactcaaaatcccttatattatatgacggagggaatactaatttctaaccctgatttgggtgttactttccacttggcaattcagccaactggcgtacattatactgtgtcttgtcatctgtcactctcctatctcaaaccagaaatcactttgccgtgcatgcaaaggcagagcaactccatgtgtagattcagtaaatcggtagtaacattagtcatcatgtatgatttagcttttcgaacatattgatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggacaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtcttcttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaattatcacaaaactgtaacttttatgttatatgctgctacagtacatatgtcgtggagggccgccctgcatgccggtgtgcttaggaaaacggagaaaagaaaaaggaagggcgaagaagaagaaaaggcactgacatgtggaccccaccacgccgcatcagcgaaaatcgcctttaataatactgtctgggagtcattttgtacctgttttaattgttgaaaatgctgttcgtcggtcgaccgacgggggagcaaaaaatcgggcgctccccccgcggtccgtctctcacgcacatgcatgtatattctgggtcccaccatgatctttattcccacctaccatgtgtctccatcacatactccattgcaacaaatcgctcacatattttgaaaaccctttattaaggga

SEQ ID NO: 37635 - DNA, 6671 bp, Oryza sativa
acctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggaccggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcactctgtacacacttaatacagtgaatatattaattacaggaagctgtcccagctagaagaccttttcttgatcaattacaaagcgagtgctaagctaggactcgtcagactgatggcttgcgactcagtcagacgatgctttctggattctgatcttgaagcaccaatgccgctgctgagaagagcatttactggaatcggagcagctctacgtcttcttctcaaacgacgatccgatcctgcccggcgcagccgccggcctcttggcgtccctgctgctcgagctcgaagcggagtgatcggaagcagcaggggaagaagacggatcatcgtcggcgcgcttcctcttgagctgatcatggcggccaggcgagcgaagcagctgccgcagcacgtaggacggcaggtccttccggcggacgtgcgccaccgcgacctccatgccgggcctccagtagtcgtacatgtacacctcctccttgaacccctctgtcgtcgcgcggaggtcgaacagctgatgctgctgctgctgcggctgcgccggtggcttggacaagcccacgaagaaggacgacgtgcgccgccgccgccgcggctcgttgtggggctcggcggcgtacggctgcgggtgcaggtggcagagcagcatcccggacgtgtccgcctccaccctggccgacagcagcctcagccgcgactccacccagcccttccactcgcggaggtcgtcctcctccccgccggtcaccgtcacgtccacctggaggtagctcttgtacgcgccgaagaagttgaacggctggaacagcttgtcccacccgccgccgccgctgccggccttgacgatctcctggcagacggcgtcgccgacggcgagctgctcggtgatgacgcgcagggtggcgtgcgagacgttgtagccggagttcatgcacgggtacgccggcgtcacgatgggcatgaggtgtatcttgtcccgcggattccggcgggggtcccagaccgggaggctgaggccgagctcgccgtcgtcgtgctcgatggcgcgcagcatcaccgggctgggccacttccaccgcgcgaagacgcggaagaagcgcgggagcagcatgctgggggaggcgttggggtagagcaagcacacgcacgccacgaggatggcccagccgacgccgccgaggaagcccgcgacgttggagtagacgccccgcgccttggcccagtgcttcacgcaccgcagcgtggtgcggaacgcggcggcgtccgggaccagccgcaggatctcgtcggccacgcggacgccgttgaggctgcgcgcggtggcgaggtcgaggccgcggagcaccgaccggccgctgaggtccaggtcgccgggcaccacggggaggcacacgccggcgtacacgaggtccacctgcacgccgtggaacctcatcttgatcacgggaacgtgcgcgccgggcacgggctggagctcggcgacggccgccgtctccgccagcgcggcggcgagcgcgccgaagaagtcgcggtcgcagtcgacgtaggacgggccgacgacgagcgcgtcgatgtcggagccgcggccgtggacgccgaggcggtaggagccgaaggggagcaccagggcggtggcccggtcggccatgccgtcggggtacccgcgctgccgcgtgaggcgcttcacccagcggtcgacgacgccgcggaggccgcggagcacctcctcccgggccgccgtctcctcggcgctctcgtacaggccctcctcgcggaggagcctctccagccgcgccgtgctctccaggtcggccggcgtcgggccgacgagcgagatgggctccgcgacgccccgcgactgtggcgactgggaagccattctctcgtgctcagatcggcggcgcgccggcgcggtggcgaatcgggtggcgtggtgcaaaaagcgagggatcaggagagggatgcgagaaatggaccaaatgggagcttgacttgaagcctgcctccctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaatgatcaaatgtttgtcaaaagattaatagccgtatattagaaaacaaagatactataagatgtccacggatataagatggtcttaagtctctcatcagggcaactgcaatgatcatattattacctttttgtttttacataactagtggcatactgccatccggaccgaggtcttcagtccttgcaattgtaattagagatattgtttccaaaatttacatgcttggccaacatatgtcaataatttacacgtaccaagtgaacaccctaatgccttcactaatttactacgcaggctgacagtaaccatcgcctgtgctgttaacactaccaagtaacacgatcaaacttggctatggtcaattggccactacactccaaagcaaaagcaaaatatacaacatatatacggctttagcctaaaaacttgcaaaactttatctatgacacgacctattgtacattcaatcgagagcttgttagctctcgaattgactgtacatccttatttgtcagatctaactgaccgccacgctcagctaccttctcaatcataagtctcaacaatgggatcgttgaaagagttgcagcggatcccaccatgatgagcttcttctgcaaaaataatcactaaaacttaagttgaaataaaaaaagggtagaaatgggagcctattaacgcagagtaatattttgcgttatcaaggcagttgtcattgacagagtttgcacatttgtgtttcaaatgaaaatgacaagcatctaagttagatcaaacatggcatgagtacatcagcatgtcttctttttgcaactattcaacaaaattatgtgttgataatcatgaaagaccaaaacaatttaattataaaagaacgtggttttgagaaatggttgaaatgggaaaaattcattcgatgtactttacctttgcacgtgtcaagacaacgttgatcctgtgccaatcaccaagcaaagaagaaccactagcccttgtattcccgttggaccgtacaaaagatactataatgcattctttatccctcccctgaaaagagtttctgttagagctgcaagttacagagaaaccacaaaactaaggaaccacaagaagcaaaacatggttgctcccaaagcctggacagtttttcactagtgatgagggtaacagaataaccataatgaattactaagaaacagtgcaaattcaaaggcactgattcttctatctttttaaataatttaaataactttttacttatgatctgaatggctgctttaaagatgcatgcatggagccatagatgatttgagatgtaaatgttcactagaaccatgtatcaaagaccaaaatcactcaaatcattgaaacaatcttgaagtgttcagatcattgaaacaggtgataatgataatgaagactgagaaaaaacaaatgctcttcatttatctaataaaaagatgaagggaacttttatcacctggtacttgtcaattgtatgaacctcaactgaagcgtctacatgttgctgaatgagatttgcttgggcattatatggagttattataccaaccccatcttgagctacacctctctttagcaattcattggtgatctacaaaaaggatgtgatcaaattttgaggatgaaagggaagtgatgatatttcgatttttatataattaggctcaatatatgtaggtaaaaaaaggatgcacaacactaagcctcagcacaagtttgtggaccagagcagtttaaatcaagcgatattttcctagcttaaaagatataagataattagatattgctaattatttagcatggcacaacaaaagggcagaagcagtcagcaagacagcagcactatgaagcagatgaactttttaagtacaggattttaactagtagctaaagtttactgcttgcttgctatattgtccacaccagacatagatcagggcatacccatgaaacaattaatgcttctgtaggattgttcacagttctatgttccttggcctcaaaagctggtacttcatctgcatgatttgcccacatgattagcattgaaaggcaaatcaaaaggacagactaatcaaactaatcaataacctgtgttcgcaaagacgacagccctatcagggttcaagatctgcaatttgaagtcaatgaaaaattaaaactgctcctggaagataaagcgcatggcagtagaaaaacacctgacataacaaaaaaatgtatctagtaacagagtacttatacattaagaaataggccgcagcgctacctctttcagcttcaagcgaacaggacctctgccagaaagcttgagtttggcatttgcaatttccaacgaaccacaggataacctattgccgtaaatcaatgaatttgagagctccataatgccagatgacattcggtactacaaattggcagttgcacattgtgagttttagtgaaacaaggggtcttcaactcaacagaaaataagtggaagtggaaatactagataagtaagcataagtgtgatattcaaatagagatacctggcatcgcaatgctgaaat

SEQ ID NO: 37636 - DNA, 779 bp, Oryza sativa
ccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgctccattctagctttgacggcatctactgattgtatatctgttgctgttcaaaaaaataaataatcaaacacacattcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttat

SEQ ID NO: 37637 - DNA, 7437 bp, Oryza sativa
  unsure (1)..(7437): unsure at all n locations
ggatcccccgatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatcattctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtatttccggaagaattaaaaagaatgccaccagaccgagagatcgagttcgccatagaactggcaccaggcacagctccaattgcaaaaagaccctaccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggtcaggttaccatcaactgaaaatcagatctgaagatattccgaagaccgctttctcaacgcgttatggtctatatgagttcacagtaatgtccttcggactcaccaatgctccagcattcttcatgaacttaatgaacaaaatctttatggaatacctggaccagtttgtcgtggtattcatcgataacatcctgatatactccaagaacgaggaggaacatgctgaacacctgaggcggataatggaaaagctcagagatcatcaactattcgcaaaattctcgaagtgcgaattctggttagaccgagtagcatttcttggacacgtgatctcgtccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaagaaggaaaagaaatttcaatggtctgcagcctgtgaagacagcttccaagaattgaagaaaaggttgaccactgccccagttctcaccttgccagatatccgaaaagatttcgagatcttctgtgacgcatcaagacaaggcttaggatgtgtcctaatgcaagaacaaaaggttgtggcctatgcatccaggcagctcaggcctcatgaagccaattatcccacccatgatctcgagttggcagccgtggttcatgctcttaagatctggaggcactatttaatcgggaacagatgtgaagtatacaccgatcacaaaagtcttaagtatatcttcactcagaccgagttaaatatgagacagagaaaatggttggaactaatcaaggattacgatcttggaatccactatcatcctggtaaagccaacgtggtcgctgatgcgctaagtcacaaggcctattgcaatgtagctcaaatacggcctgaccaagatcacctgtgcagaagaattggagaaagttaacagctgaccgttggtagcagtcaggtggtccactgccagcattgacagtacagcctaccctagagtcgcaaatccgggaggctcagaaagacgacgaagggataaaagaattaataaaaagaatacaggagaagaaagacaccaatttctccatagacgataaaggcacagtttggtgcggaccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccagcgggtacgactccatctgggtaatcgtggaccgactcacgaagtcagctcatttcgtgccagtgaaaaccacctatgatggaaagaaactagcagaactctacatgactcatgtcgtatgtagatttggctgtcccaagaaaatagtgtcggatcgaggcactcagttcacctcaaggttctggaagcagttgcatgaagccctcggaactgatctaaattttagtacggcctaccatccacagaccgatggtcagacggaaagggtaaaccaaatcctagaagacatgctacgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctggaatgaggtgggcgaagccctggtattcggtcctgacatactcaagtcagcagaagaacaagttaagctgatccgagagcgtttaaagacagcgcagaaccgtcagaaaaattacgcagacaatcggagacgtgaccttgagttcgaaaagggagatcatgtgtacctgcgagtatcacccctccgtggtatgagaaggtttgggatgtccggcaagttagcaccccgctacatcggtccctacctcataaccgccagacatggcgaagtggcttatcagcttgagctacctgaaggtctcgcagatgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggtagaacgtcagactcgaaggaagaccatcaagttctataaagtccaatggagcaatcattccgaagacgaggcaacctgggagcgagaagatcttctccgcgccgagttcccggacctgctcccttaggtgttgaatctcggggtcgagattcttgttaggggggttggtttgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaactccgaatccaattccttccaatcaaattcctccgcaaaagtctattttgcctcccccgaggtcgatgggccgaatctcactcggcccatcttcccctcttccccggcccatctctccctctcccccctgggctctctctctctctctctctctctctttcccgcccacacgctgctcgcgcatgcgagagcctccccgagcgcctctctccccgcccccccctccgccccgcccgcgcgccgcgcgcgcgtgcgcgggagtcgcccgcgccgagcgcccctcccctcgcgcgagctccccgctcgcaaagacgcttcccgcgcgccgtgttcgcgtgcgcgtgcccgcgcggacgccgcccgttgtttcccgcgcgcgcgcgccgagtggccgaccgcccggtcgccgccgtcgtcagcgtctaccgcgcctgtcgccagtgtcgccgctccgctccaaaccgcccgccgtcatcgccgtcgtcaccgcccggcccccgccactccgcgcgcaagccgccaagggaaggaggccgcgcccctcctttctctgccgcgtcgcccccgctcccctccccctttttcccgaatcggcaaaggggcaagccccctttctccccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgctgtcgtcgctcgccgtgtgttcgccgccgtcgccgctcgagctccgtagcacccgctcgtcaccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgatggctcgccttcccttgtcacgtgcaaccgcccggtgtgctcgctgttgcccgtatcgccgtggttcgctccgccgctcgccgccgctgcccgccgtccattcgaggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcacggtgagccgagccgctgacaagcgggtcccacccgggaccgcgcgtggtgagcccggtccaccggactctctctcctccctcccgcgcgcgcgcgtgcttgggccgtcttgggccggccggcccgttaagctcggccgagccgctccatttaccttggaccgcgccctagccgcccgaggaaaagtctaatttccatccctctgttctttcttttcttttctttttcaaaaaggatttaattaaatccttttcctttagaccaaaaatccaataatcttataaattcaatatcttcccaaccgtaattccatttgactccattcaacttctaaaatttcccaaatctcgagatctatctagtggcacgcttagaggtctttaatagggctctattttcgccgtttgttgagttgtcccgtttcgcgtgtagtttcggagcccgaagacccgcagtgcaaggatttcgaggatcaagctccagatctcgagcaaggcaagccacctttgaacatcttgagcctatatttgaaatttaattattttgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttagaatttcatccaaacataagacaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgctcacggtcatgggcggatgtgaggtgattcctagtgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttactgtgatactctgtctccctgtgataccagcactatttcctgggactggtatcgattaatgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaattttaattccagggaaaaccctttttccttt

SEQ ID NO: 37638 - DNA, 1125 bp, Oryza sativa
tgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgcaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttccttgcaattggattttgttccgggaaaatggggatctgttcttgtggttcaagggaaaaatcttggtcgctcgtttaaagtgagttttttaaaacgagtcagtctagggttttagtaaaattattgggatttattcgtcagtcagttggggtttgaggggtgaaatgcattaggtcctagctcggtaacatgggttgtaaggtgtttatgctttgttcgttattattattatgtatctaatttcccattattttatcgttatgtgagtcttatttattcgcactcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagt

SEQ ID NO: 37639 - DNA, 21039 bp, Oryza sativa
ccgctcagtggcgagcttcctcaccgtgtccgcttggaggtccatggctacgtggggacttgcctcgctaacatggcggttgaggcgtcaggaggcaccgcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggataggatgcactcggacctgcacaaggcgaccaaggccttgaacgatgggaagctcatgaggatcgtcgctctgaaggacgaggtagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcaccttcagttctgcccgcagttcctgcagctccagcttcagctccagctccagctcccgcgttcactctctccttcgctccagcatcagccgccagaggttcagccagtggtaccggaggttggttgtccgctactcccagtggcagcggcgagactgatctgtcaggctccaggagtcgctcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagttgacggtcgatatcatgtgcctatgatatggctgtcttaataaggatttttgcttgcctttttaagtgttttaattcagatcagaacaattgcagttttaattcctatataataaagcttagtccttgagcatctgtttttcttcttttccccgtctgctttcccctcaagatggtctacaccaggactggtagccgcgcaacaggcgagggcagcaacggtgaagaacgcgctgatggtgtgcaccccaacggtgattctggcaatggtccgccaccacttcccgagaatccgacccttgcccaagttatggcacatcagactcagatgatggcagccatgatgcagcagatgcagcagcagcaccaacagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctgcagtgtaatgaccaggagaaagtcgctttcgccacacaccagcttcagggtcctgcgtcagcttggtgggacaaccacatggccacccgcccaccgggtactgaagtcacatgggcagagttctgccgtagctttaggaaggcacaggtgccagatggggtcgtggcacaaaagaagagggaattccgggcgctccaccagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggatcagcgcaacaaaatggacaggaaaagaaaggcggcgcagttccggtccaaccaaggtagtcagcaccgaccgcgcttcactcccggacagcagggtggacctaccaccatgatcgtccgccagcaccgcccgttcaaccctagcaacttccaccagggcactagtggcagtcagaaccaccatggaggccagcccaaccgcggtgcagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcaccgtttctagccaacctcatccttctcgaatccaaagacctagatgtcattcttgggatggattggctgaccaagtttaagggagtcatcgattgtgcgagtcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaagtgttccccgaagacctcaccaccatgccacccaagagggagattgaattccggattgatttggcaccaggaaccgctccaatttacaagagaccatacaggatggcggccaacgaattagcagaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagtcaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataagagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagaccccgtactccattcatccaggcagcactaaaatgtatcaagacctcaaagagaagttttggtgggtcagcatgaggagagaaatagctgaattcgtcgcactctgcaatgtttgccagcgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttgaatttcagcacggcctatcacccgcaaactgatggtcagaccgagcgagtcaatcaaatcctggaagatatgttaagagcttgcgctcttgattttggtggagcttgggacaaaagcttaccatatgcggaattctcgtacaacaacagctaccaggccagtctacagatggcaccgtttgaagctctatacggccggaagtgccgcacacctctcttctgggatcagacaggcgaacgtcaactgttcggaacagaagtattagcggaagcagaagagaaagtcagaatcatcagggagagattgaggattgctcagtctcgacagaagagctacgcggataaccgtcgaagggagctaacttttgaggccggagactacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaatatgatcggcatccatgacgtgttccacgtttcccagttaaagaagtgcttaagggtacccgaagaacaggctgattcggaacacattgatatccaggaagacctgacatatgtggagaagccggttcgcatacttgataccagtgaaaggagaaccagaaacaaggtcacccggttttgccgagttcaatggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccagccaaattgtaaattacaaatgaccccaagaaaatgcagaggaaatcaggataaaaccctaagaaaacaatgcatataataatcggatttgacatgtggaatttttctgaattctacatgtcgaaatgcattaacaggatttttagtggaattttcagagctctagaaataattttaaccaattaaaaatcactaaagtgcaatttttaattccagggaaaaccctttttccttttcctttttctttttcttttccctccctttttcctcctttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccggcgcaccgccgcgccgaaaccgccgccgcgcccacgcctccgtcgctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggtcgaggtccacctcgtccacccctcctccgtcgaggttcgtcgccggagccctcatctccacgcgcacgggtgagcgccacctctatcgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttatcgccgcccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtccccgtcgccgtccgatctacccttgggtagatcggggccgtcggttcggccgccacgtggcgccgccgcccctccttttccccgtgccactgaccagtgggcccgcgagccgccacccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgaacatgttgatcccattttgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagattataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaattaacaggttaatttggagcgtcacgggctagttccggtcgggactagttcggggcgtgacatgaagtctctagaaattggatttgtgtcttttcttttcttttatctattttttcttatgcataatttccttagatttaacctaaaatttaacaccaccatgtgacccaatgaaatggctcgagacgagccagctttagaagatagactagaaaataagcatgtcagttggcacgccaattagtttatagcccgtgtgtattttcttttataaaccatatattcaaaaggattatttaatgggttttaaatttttttgtttgtaaaatgttgtggaacaaatcaaggcagaattctaattagtggtcttgtcatgctgaacgactatttaatttcaggaaatggctaaagatgatatatattagtgaaaaaacttgttttatttatatgcatcattttttatacatgtaagtcatagatgttgcataattagtaggaaatacatatctaaataaatgtgtatttgattacccatttcattttctagaaataaaaataaaggacaccaacatggtaaagatacttatcttgattttatatatccaggatatactaagtgtagatcggttggttacattccgtgtggtggaacatgtctattcaggattaaggtatagagttaacatgtgtggtcttatttacagctatttgttttttcagtggtaggtgatgtaccagccattatcaattcctagatatgaatgatgatttaatcttcaaagggacaaatatggattgaaatttcggaacaaatttcggaaatttcagtaattttgcccccaccggcaagcacatatcttgcccgaaactttcctttttttttgcaaatttatgtgaatttggtaaaagtttatttacattcatttaaagttagttaaattttcaaataatttaggccaaaaaataccaaaacttccgaaattttggtgatttcgtgaattcggaacccctggcaaaaaaaaaccctgttcaaaattgaaaaccctgggtacagtagtggtaggatgtgtatgtggtgtgtctataggtatgggtgtacattacatagtagtttcacacgcttagaaattcctttaagaaggacatattacgggaatttaattttgtgtttgtcaaagaatgagaaaaaccaaattatgttaattgtgacaaacatgtaattaggggtgccaaaattacttctttcgtttattttttatgatgttttttatatattcaaatatttttacgaaattatttgtatttatttttccctactatttcttctcctatttctgtttgctcatgggtgcctgttagtggccacgaggagccaacgtccaacgtgcgaattctagcatgaacagcatgaaacgaccagcccaggtacacatgattgggctgtatagcccacagctcggtgtcaacctcagccctgtgcgtgcgcccgttcttccttttttttttcctttttgccggtgttacgtccagtttaaaccgctgctagctagagatgcgtattcacgagtcacttcgcaaaatacggcgccacgtggaccaatcaaacttagaaagaatggccagctttagattagtagactagaaaaaaacacgcgtgcaacactcgatgggccacactatttggtcgtattgagacagaatgatcagtttaacaacaatgcaagttgtagcaaaatactatattgcacaatcatgattactacagcagagtattaaattttaaaaattaatctatggcatataatgtgatatagactgtataatctgaacaaaacacaatagttatcctatatacttatatagttcatctccattaagtgtagttaatgctatttctctcttctcattaacccacatcaccctaattatttctagcctttggatgatagatctatggtctaaattatttcttctttcttctctcttaaaaacatgcaatctcaattacttttaggctcaaaattgtatcaaattgtttttagttttgtacatattatgcaacttaattttccgcagcaacgccgcggggtatgagtatgtgacatattatagacatttgatctggaacttaaataatggaagattttaataaagctccctatcaattttgtattagagtaactggaaagtagatgagtgtaggttcttggtgagtgctaaatacatcaaaaataaattggctggtagatgagaggataacaaaagtatccagcttgggctataaatagcaaaagtcagtgttttcttcttcattattttcccaaaaaaaacaataattagaatccttgtcaaagtatgttactgaggaaccagcaattctttctcatgcagtacttaacacgatgcagtagctaggttgggcaagtatgaggtttctatgtagtgtcaggtatatatgtgaatactacatgtaaacagggtatctggtaggtaaccgtgaaattgaagcagccatataaggtaatacacttgcttgaaatggtgccaagcttatgcacagtacagtagtaggttaattatatgattgaaaaacaaatgattttaaatatgagcaattgtttacctgatcattactgttcggatcttcataagctcttttgcctgacaaactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgccaacgtcgtcctcgcggtgcaggacgtgctcgccgcagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattgtagaagaccaagagtcgtgacccttccggaaacatcaggtggctttgcactttttgattttactccaacgtaagattgttttttatattttagtccttctcaagtgtgggagcgcacgcacgaaccacgctgtgccacgtggcatcgctaattgctcgataatttgcacggatttcgatagtaagagattagcgatgcctagaaaatcagcgtgccgggcggcaaatttgcacaaaattcgtgttataagattagagattgaccgcatatatggcaatattgcgtggagaccgattccgtgagtgaagacgtgcgccaacgattaatttatacagaatttgtgttataatattattaaaggttgaccacatgtatggctggttgtggtaaatctggattctttctgatttctctagaatcgtctagtgatattccatattttgcaagggattctttctgatttctctagaatcgtccagtgatatttcatattttgcacggcctgttaattttgcagttgtccgtgggcctattttttagcaaaagtcacgccaacacaagtgcgaggtaggagctctttccggcgaaaccagttaagccacatggcacgagcagctgctagagttttgcacaaatttcggtattagagattagtgatgccttgttgagttccacggtgaaattcgcgagagctgtggtcgatctcgacgagagttcatcactaacacacaactagctattgccgatcgaaatcacaccaactagatgtgcacaaggttgttgtaaagaatcatatttgccgccaagcatcgggaaaatcacaagattttacaagttactccctctataaaaaaaaagtgaatataggactagatatgatatattttagtacaacgaatctgaacaaatgtatgtctagattagttgtactaggatgtatcacagtactagattttttttatgggacatagggagtagttagctacagtggacgatggacagaaaagtagaagaaaaagaagaatggacgagctggggggttttgggacgagctggggtttttgagagagcatcggcgaggagtgccttgcttgtctcggaaatctgcctcacgggcctcctcgtcctgacccaagactaagctgcaaggtgaacagacctctacattcgccacgcactgtatcgcctcaaatactataaggtataaatacttacatgtaatacttctactcgtaatacttctacttatgtttgttggtttcactaacctccaattattttcattgaataataataatatcttttctgatcaatctcattgccatcatcatcacttgtcaaaacagcgactacagaagaacaagcagcatggtgacgataagctgaaggaggattattgccttctgtatgttctcctggataaggataactatgcattaaggatgatggcagtaagctgcggcttcttcagaagcatggatattttaagcactctgaggaagatggcatattagattggtcctttcgccctgaatactgcttgcttgcttccctggatgactatcaacgcctagtccctctggacactgtaagtagttctgattatattcatcataacactatttgatcttgtactgtattccgtagtgttagtaagatattatgacctacttgtggttagtggttaatatttaataacagttccaaactatgaatttaagatagtttttttctcagaaatttaattagtggtacattcttattgtgaatatctgggtgatctggtttctgcaccaatcgcaaagttatttaaggacccaaattgtcgatatatatgtggactcatgatgagcttttttgtggaaaatgtcatgctatgtccgctgaatgtaattgtatagcattatttgggtcgtaaaggaaaataaattgaattacacctcaagactataaacgaattatccctcccaaattaaataccaaacatttcacacccctaattcttcaaatggaacgagttacccactaaataaatcaggagtggttttggttctacgtggcagtttattcaacaaaagtaatattttaaaaataggttgacacacatgttagtatattctcccctatattaactattcatatctccaataccttgcaagtgacgccggtgaggcgaggttagcgcaacaccgttctcgcacggaggaggctatgttggatcgagatatcgactagagggggtgaatatgcgattgttgggttcttaaaatatgaccatatcagtaaaactctgctacggattaaccttaccacccataaacagatttaggacttggatgttagcgcaacaccgctctcgcacggaggaggctatgttggatcgagatatcgactagaggggatgaatatgcgattgttgggttcttaaatatgaccatatcagtaaaactctactacggattaaccttaccacccataaacagatttaagacttggaaaaaaatcttgctccaaaagcttttaggggtaacctcaccacccataagaacaagtatctacacacaagatgtacccatccaactaaacaacatatcttgtatgcaaccatcccatcctccctttgctacaaccaaccaaacaacattttatcatatccagctatatgtcatgcaagcaatcaaacacctgcatgtgtatcccacatacacgtacttcagcttcacaagatgcaacggctgtaccaacccagccgttcgattaactgatcactcaagcccttgtcactttatcaacgtagattagcacattcatgcaacacaacttcaattgcaaggcccgattagtaacaactttagatatatagctggagttgcaacgatgttagtagtagcatcttaagaagaagctggaggaggaggaggaaatggcacctccaaacggccttgcagcatcaagatgacaccattcatggatggccgagactgcggctccgcttggacgcaccacatggccaccctcaccaccctctccacctctgccgcctccaccgtctcgtcgctgctcatggcgctctttgcctcgctcttcaccagcagccactcgtacgcccactccgccagcgtccgctcctcctcgccggcggcctcctccatctccatgctcctcctgcacgccaccgtctcgagcagcaccacgccgtagctgtacacgtcggccttcaccatcaccgggccggcgccgcggtaccactccgacgcgaggtacccgcgcgtgccacgcacgctggtgaaggtgcgcgtctggtcgggctggagcagcttggccagcccgaagtcggagatcttcgtcgtgccggccgcgtccatcaggatgttctgcggcttcacgtcgcagtggatcacccagctgtcgagctcgtcgtggaggtagtggagaccccgcgccacgtcgagcgcgaccgatatgcgaacaaacgataaagaacaatagatcaatcacagaagacacgagatttaacgtggaaaaccctcccaaaacaggagagaaaaaaccacgggcgctagccagcaaaatatcttcactatatctggggtgaggttacaacgccgcacgacggcttacaagaggtatatatatggtagaaccctaaaagggatgacgatccgtttcgcccaagcctcccggcgacgggcctccgctccactacggcagaagctggcctttattaagtgcaaatgaatttggatcacaactcaacaaactccaccttgagacaaattccttcttgtagcatgaaccaatccttcaccctgaacacaacaaagacaaaaaacactttcggcgccaaatagcctcttgggctaaaccactataccaactaagcttgagcaaagctcaaacttagcaacaggaacatgctttatcatcatatcagcaggattatcatgagtacttatcttgcatacctttagcttaccttgcgcgactacatcgcgaacataatggtacttgatatcaatgtgctttgtcctctcatgaaacatctgatctttagtaaggcatatagcactttgactatcacaaaacaagttaatgcaagaatcaactccacaaagctcagcaaacaatcctttcaaccaaactgattctttacatgcttcagcagtagccatgtattctgcttcagtggtagactgggcaacaacaggctgcaatgttgcattccaactcacagcacaactgccaatggtaaacacataacctgtgagtgaccttctcttatccaaatctgcagcaaaatcagaatccacatattcaacaagccccttatcagtcctgccaaacttcaagcaagcatcagctgtgcctatgaggtacctgaaaatccactgaacagctttccagtgttctttaccaggattagccatgtatctactaaccaaactcatagcatgagataaatctggacgggagcaaactatggcatacatcaaagaacccacagcactagaatatggaactctagacatgtattctacatcctcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagcagcaccaagatccttcatatcaaactcactactcaactgtttcttcaatgtagtgatttgttccttgctcttggcagcaatcagcatatcatcaacatataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggtactatgaacccttctggctggtccatgtatatctcctcctcaagctctccatgtaaaaatgttgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcactaggagataagccctcctttctcttgaagatccatttacaacgaacaggcttcttctattttggaaagtgcacaagctcccatgtgccattcttctcaagagactgcatctcctcctgcatagctgagatccacttctcacggtctccagaaacaacagcttcaatatatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacaatatcattaacatcattaccaacaatttcagtttcctgatcatccacgtgctccacctgcacgctaacatattgctgctcctcatcagaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattatcaacatgagcataagcagtgcatccaaaaactctcaactgtgaataattagcgggcataccagaccataccccaataggagttttcttattaagtgggatagaaggcgacatgttgatcaagtagcaggcggtgttagcagcctctgcccaaaaacgcttgttcatgtgaacgttggacagcatacaacgagccttggagatgattgttctgttcatgcgctcagccacaccattctgctgtggagtgtacgggatggtgtgatgcctaacgatgccttccttcctgcagtaatcatcaaaagcatccgaacaaaattcaccaccattgtcagtgcgaagtacttttacctccttttcagtttgcctttctatcatgactttccactctttaaaagcagcaaatgtatcatctttatgtttcaggaaataaggccacactcttctagagtaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtacagccatccagcaggttcctcttcatcaattctgtcataccaagttcactcatatgtccaagatgcatatgccacaggttagtcttactaggttcatctttagaaacagcagcagcggtaacaaaaccatgtaatgtacttcctctaaggacatataagtttgtagaattcatatcaccaatcatataaacgagagaacctttcgatacctttacaactccacctgaaccagagtatttgtatccttctgcatcaagtgtgctgagagagatgagatttctcgccatccctggtatgtgtctcacatcttttagcgtgcgtgtcatgccatcatgtatcttgatctgtacggagccaatgcccacaatctcacgtgggttatcatctcccatgcgcacaacatctctattctgcacagacttgtaagaactaaaccaatctctgttaatgcagatatgaaacgaacatgcagtatcaagaatccattcatcataactagcaacacaaccagcaaaaacgacaagacaatctcctgaatcagagttttcagcactggtaacaacagaggccttaccatcagatttccttttctccttattctgtagcttccaacattcttcaatgaagtgatttttctttttgcaatacttacagaactttttacctctggacttggaacggcctctactttggctcttgtcacgatcattgttgtcgttgtaggttctctgctcagatctgcctctgacctgcaatgcttcgcccttagaggacgacgcattagactgaaccatacctttcatcttttccctattttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccgatatatggttcaacacagaaccactctcctacaacttgtgcgagaacaacttcatcttgatatgcatcttactggttagatctttagacatgcaaatcgattccagtttgagccaaagttctgtagcagtcttttcctacaacacttcttgcaaaatatcattagatagatgaagttggatcagcgacagagccttacgatctttccgcttctccatagcggtccattcagtcgatttcttcttcccgaagctttccagcgcctcatcaagatccgaagtttgtgctagaacaacccgcatcttgacttgccacaacgagaatctcgtcttatagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaccacgggcgccagccagcaaaatatctccactatatatggggtgaggttacaacgccgcacggcggcttacaagatgtgtatatatatatatggtggaaccctaaaaaggatgacgatccgtttcgccccaacctcccggcgacgggcctccgctccactacggtagaagctggtctttattaagtgcaattgaatttggatcacaactcaacaggtagccgccgccgccgctgttgaagaggaagtcggcgagggagccgttgctcatgtagtcgtagacgaggaggcggttggcgcccacgtggcgcgcacctccctctggaactcacgctcgccgtcctccaccagcttctccagccgcttcacggcgacggtcctctctccgccgcgccgcagcgtccccttgaacaccgtgccgaacgcgccgcggccgagggggtgtcggaagctgtacgtcgcgtgctccagctcctcgtagctgtacgagcggagcggcgcctcctcgtccagggcctcggcgtcggcgagcgcgacgcgccgtcgcaccatcctctggttcagccagagcagccgcgccgacgcgaggagggcgcacagcgcgacgaacgtcaggagcccgacgcagaccagcgcga

SEQ ID NO: 37640 - DNA, 5038 bp, Oryza sativa
agacgccgtcgggatcaagcgtgacgcggtggtagtgagcttgctctacggcttgagctgcactggccttcgtcaagttcttggtgtagctgccattgttgccgacgaggtagagcacgccgctggcatcgaggcgcaaggtgagggggaagcctatctggaacgtgccggtgtcccagtacgcggcggcggcgacgttcatggtgcccgccgggtacatgacgaggttgccgtcgttgagctggttggtcagccggtacttgccggtggccctgctcgtggcggagacgctcgagaagagctgtgcgccgggggcgaggtcctggccggcgagcagggtgtcggtcggcgccgcgaacgtcgaccacgccaccgtcgcgttcgcggcgtacagcacgaagttgccgtcgtcgcgcatggccgccgcgacggccggctggggcggcgcggcgacggtcctgtcctggccgttcgcgccggtccagagcaggcggccgtcgtaggtgagccgcagcgcgccgccggtggccggcgtgtcgttgcggctcgccgtccacgtcaccgttatgctgggcgcggtggcgagccagacgcccacggcgaggccgccgtcggtggcgtagaagccgaagacaaagtggcccgacggcgaggaccagccggcgccggcgacggcctgcacggaggcgcccgaagtgacatttgtttgggcaaatgacacgctgatgaggataacaaccatgaccggtatcagcaacaacggcaaatctaatggtttggccatggccaagagcaagctaatcaatcaactgattaatcaagccaatctttgctcaattacaagcttcgatcatattcgattacaagtatcatgtagcagtgaatgctgaggtggttgcatacttttcttctgcgatgtgatgtgtataagattgttctattcttagtccaagatttgtgtgttgttttgacctgccaatgttgatttttgtaggtccaaggtgatctatgaaatacactactttagttgagctttccaagctcttaaattattcagttgttctgctaaatggctcgactggtcaatttcatattgacacgcgaggtagatggcgacctgcccgccttgacttgtgtagtactctctgttttcctggttataacaccttttgattttggttaaagtcaaactactttaagtttgactaagtttatagataaaatagtaatgtttataataccaaattagtttcattaaatcaatagttgaatatattttcataatatttttttgttgaaaaagttattatttttttctacaaacataatcaaacttaaagcagtttgactttgacaaaagtcaaaacgtcttataatctgaaacagaggtaacttcaacagcaggtgccatttctttgagtaatggaattcaacttgtataagacggtgcaaaattctattaatagagcaggagaaaaattacaagattacaaccctaggtcatgtcgtaaccagaaaaaaaatagcggcaaacctaacatgcaaatatagtatcagaaaatggcatcattggttagagtgttagacacgagctgattaagctgtaacgatttttttaattgagaagtcgtaacacttattagcgataaaaaataacttttaacgatttttctatatatatccgtagcgatttaaaaggtaatgctgaaaataataggctgaaaaaaatgaaaaatactctaaatgaattcgaaaattaagttttaaaatttaaattttgcctactacttattctttataggttaaacgatgaggccctgattttctaacgctagcagcagtgcatgcatgcaactcacaattatcagccaaatgtctttgctcctctttttttattttcctagatattactccctccgtttctaaatatttaacactgttgactttttagcatatgtttgatcgttcgtcttattaaaaacttttgtgaaatatgtaaaactatatgtatatatataaaaaagtatatataacaatgaatcaaatgataggaaaagaactaataattacttaaagtttttaaataagatgaactgtcagacatattttaaaaagtcaaccgtgtcaaatatttaaaaacggaaacggagggagtattcaaagtcaaatgaaagtttctcatgcataaacaattttgctacctaacgtatatggatctttatcgtcaactccttcataagccctccaatctttagtcaatctaatattaaattgtctcacctgcgtagctcggatatttatgattttttctccacttttatcaaggacaataacgacaatttgattgaacaatggcaatgacaattcactcaaaaactggtttagccaatgtccatatgttgctttcgtagcaactaatggctgatgttgattattgaaattaaagcaagagatgattggtcttcttttgttaaagcaaagcaaattctataaacatatacagttgatccctacctatataattgatccctacctagtttaggtattgctattttcctgacatatggtgcttctacatcaccccatttgtttggaccgttggatcttcattgcaaggttaggatgcaggattggctaacatgtacagtatctgcacgtagcatgtatgggccaacatttagggcacatcgtttgcctagaggctcataagctaaagccaaaatttaaattttaaaacttaattttaaaattgattttgatgtttttttaacatagttttttttcaactttagcttttactccttctgcctcaaaatataagagcttttgggtggatgagacacatcctagtgctacgaatctggacatgagcctatctagattcaaattactaggatgtgtcacattcgcccaaaagcctttatattgtggaacggagggagtaagtcgctaagtacatatatacaaaagttttattcacggatcaatttttaatcattaataagccgtgagcaaccgatggggaccttatgcccaatttagatcacacctataagcccatcagttagagttctgtttgcctcgtcccttcgagtcgttttgcattaaagccgaaagatgccttatcaaaattttggtaaatgtgcaagtttagattgaagccaaaacaattgatagtgaccactgaccatgctcaatttagctacattttagaaacttctttatcatgctactaaatttaaattgttatcaaaccaaatatgagctagctaactttaccttataaaaaaaagtagtatcaaaatttacctatatatataatatcttatgtccatctcccatgtaaatcgcgacctgagctcgaaactcgcctcctgaccgaatctctaaggaggagtgctcacttccccgttagaggagtttcatactcagacatatccattttcctattttccttgattatttatgttcagctgtattcacaagatatggaaagaaaggcgaatgttatcatactattttaatattcaatttgtttgtttttttacttgacacaactatgcatcttttctctccggttagtgtcaaatagtaaaaaaaaaaaagtcgtgtaccacactagaacctaaatagtgcatacttaaatgttaaaatatggttcaatatttcattattatttattttttagcaagtcaaaacttataaattaaacattatctctcgctgcaatacggggagttttatctagtatattcagaaattcacaacagctagccctagccattcatgcaaaatcctttaattagacctggcccagttttatgcatagcctcacacagtccacattctggcccatgataggcccaactgcatttaatttttctctcccaatttggggctcaacattatcaaatatcattgactcattttgtgcttaattatgtgtccttgtgttgtacagttagctcaactaacaacacaccactagcataagccattacatctcttatcattatcattgcctctttggcatgttcatgtctgcatccatggacaagaaaataattgtcttgcatgcttggaattttgcccaacttgtagctaatagcttgatctgttagaggggcaaaaaaaaaaggggagcaatttggaaagatcttatattgatatagtcctccctccgtcccattttaagtgtagctatagttatccgtgtccaaccttgaccgtccgtcttattttaaaaaaaattaaaaaaaatttaaaaacataagtctcgggtaaaatactattcatgttttatcatctcataacaacaaaaatattaattataaaaaaatttcaaataagacggacgattaaaattgaacgcgaaaacttatggttgtacttagacagagggactactacatagcagacgacatgaaatgcttagctttttcagttggcatttcatggttacggaagcacatgggtctcatcaagctgtgcccttaattacctacagattagaggccatggcccttaagtacatggaccatctaattctaagcacatgtgaccccaaaattcggatttcgtacaagcgtgtgaagcttttggtcttgttgttcaacaaccaaataatgatactactagctcaaggttagttagagaaaaagaaagagaaaaatatacagatatatggtttaataatctgtctgaataaacactcaaagcttgctgctttgttcagactctgaccaaaatgtaaacttcaagtaccagttatttgcatgaacctgacagaaaacttagatgaagcaaatgtcatgtgtactttaccttcagaagatgcaacggcaataccaacacagccatcatcatataatgtatgcttcattaattagtttttagcaagttgacaatttgtttagcaccccaaaacacaacagtgttctttctctagatgcaataagctactaaaaacgacaagcttgtttatgcaaatcttaccagtcgtcacctatttaggcataggtcaactacctaacctact

SEQ ID NO: 37641 - DNA, 1568 bp, Oryza sativa
ggaaactaaataaagcgacaccatgtagatggagattatacaatcagaaattaatccttattactaaacattcatccatggtgacgaaaatcttgtatccttgtttccttcaatagggcccagaatcgaaaccaacacttttgatttttattatagtttgtgaaatgagagatagttaattacttggtacatatataatgtgccaataacaaccgtgcacggtaagaacatcccacactggaaccaaactaaagctcaaatcaagatttgtgtagggatttgttgaaatgacaacactaagcgtgcacactaatacccatataaacaagacagtagaatctaaaattttatcctcactaacgatctgctgctcgttaatgggagacaagtgtgcaacacatcacagtttgattacttcatccgaagaaaagtatcatcatctaaaagacacctttttgctctctgctcttgtcttcctccataacaggtagctagcacaaacactcgattctatcaagctgtataattaagcttagtgcctgcattatcttgatctcctcaaaagcaacaccacacgattaaatttgtttagctcatctatctgaacaaacgataaaaaagcaaaagttttgtttaggtagtagtactgaatagaactggttggttgatacaaacaacatgtggtttacgcttatgtactacaccatacaccacatggatcttgacatgttagggaaaatagcttgtagaaactagtagaaagcagtgaacataagctgtcacagtttatctagaagcaattacaataaactgaattcctgaaaaaaaaaaaaggatatttgaactgaataggtcagtgtcccatttcttccttaatgactttgtttgtgctaaacctttcaaaacacaattgacatatcctaaatatatacttcctccgtcccataaaaaactaacttagaataagatatgacttttttatataataaaactgattttttttatgcgactaagagggtatcttaaaagtttgttcggaaggatatcgattttttaagatggccctagctagcccctagttggctaggtaggtcatgtgcaagccgtgcctttttctccttggaaagacatgatccggatccttgtgaaggaggacatacatggccatgttatcatgcttcatgccccgacaagtgggccccaccggatcaaagccatgtcaccagggtccatgatccagtcaaagacagaaaaaaatgaatagtaaaactcatcctctggcctggtccaaagtccaaaccttcggtaggttgtgctaattaatcaagtcagtgtcattaggacatttattaattgcttttctagaatggtgttttcgttacgttgatgttattactgcttcctccgtttcacgatgtaagtcattctagcatttcccacattcatatttgatgctaatgaatctagacatattttatttatatttatatatatatatatatatatatatatatatatatcaatatgaatgtggaaaatgctagtcattatatatatatatatatata

SEQ ID NO: 37642 - DNA, 5326 bp, Oryza sativa
tcccgctcctctggtgttgccgccgcgccgcgccgcgccgcttctcccccccaactcatccgccgctcgcccgacgacctcgtcggcggccggatctactcggcggcggagcgtccaggtccagcgcctggcggagcagagcttcgcgggccagcaagcgagcctctccggcggctgcgcgcttaggcaaggcgagaagctaaggccttgtgcaagaccaggctctcctctccgttctgcgtcgccgtctccgacgactccaccgcgcacgacgagctccaagagagagggggcaaagaggaatcaagagttggaatcggggagcttagcgcacagctttcccaaccccagcgtacggccgcggccgccggctttgtctggcctcttctgctcccctctccttcctgttcggttcggccggatctaggactcggagcagaggctgcgccgcgggcttagtagggatcgatccccggcgagctcgcccccccgtgactcctgcctcctctggtacggcgaaatccaatctgttctactcttcctgctatgttcggtgcggaaaatggctagaaaaggaggctcctctcagtggtttgtgccgtgtggttttagttgaggatgcgaggtttggggggcttagcttgtggcttctgttctgattgcttgattaggttagggcgaattttgtgagggctttgctgtctaagatttgctctgtggtagtggtagtggaatgagaaaaaactatggatgctttcttgttttttttgcttggacttggggttgctattactagcgagcttgtggatgaatgagcgtaggtgaattctagatgcaaggtatgtggaatggtcagggcagagggatttatgcatattgctattatgttgattccacttaggatgtgctggattctcgggataaaattgctatttatgtgtacacctggtaattttcacgatgtgttcttggttattattgctatgttaaaaatggtatgtttatggattttcctttttttcgagctttagctagcaacttttccaagcatgtaggaaggatttataagcgatagagaggatcaggattaacttgtatcatgtagtgctgtagtagtttgtggtcaatataagcgtaggaggagctgctgtgctactcagcagcctgatcctctttatgatgaaggtataatgtgaatttatgcatttcaacagaaccattctatgttgcttctgataactagtgtgtacagttttagagcgcggacctcaaactggttcatattataagatggacaaattagttcacaaacaacttttgtaattgctgtactataatgggatctaactatacctggccatagtcattttaaatcttgctctccagtaacagaagtgtgctttccccataacctccattattgctgccattcaggttcataggatgctgatactttgttcccgtaaccgcatccatgtattttattcacttgttcttatctgtaattttgtttcgttaaaactactgtatcaatttgatgatgcataatgagttttactgagttgctgttaaacatatgcagatttttcaatattaaatcagccttgttattccttcaatagcagttcttggagatcagatgtgataaatatgcacactaaaggggcttcttctgatgttatcagagtaagcacatctagtgcccctagtacatcaagtcacggttctgcacaagatgactgtgattcttcaggtgatgtgtatgtatggggtgaagttatctgtgataactctgtaagaactggttctgatactgtagttaggtcaactgttaggaccgatgtcctgcgacctaagcctttggaatctaatttagtccttgatgcgtatcatgtggattgtggagttaaacattctgctttggtcacaaaaaatggagaagtctttacatggggtgaagaatctggtggacgccttggccatggatcacgagaagattctattcatcctcgtctaattgagtcattagcagtttgcaatgtggatattgttgcttgtggggagttccatacttgtgctgtgacaacagctggggaactgtatacttggggagacggaacacataatgttggacttctaggccatggtaaagatgtaagccactggattccaaaaagaattgcaggagcattggaaggtcttgcagttgcttatgtatcttgtggaacatggcatacagctttgattacaacaatgggccagctatttacctttggtgatggcacatttggagttttaggccatggaaaccgagaaagcatttcatgcccaaaggaggtcgagtctttatcggggttgaaaacgatttctgttgcatgtggtgtatggcacactgctgccattgtagaagttatagtgactcagtcaagttcaagtatatcttctggaaagctcttcacatggggagatggtgataagcatcgacttggtcatggtgacaaagaaccacgactcaagcctacatgtgtggcttcacttattgattatgattttcacaggatagcatgtggccatagtttaactgtgggtctgacaacatctgggaaagttttgagcatgggtaatactgtttatggtcagcttggcaatcctcgttcagatggtaagattccatgtttagttgaagagattgtgggtgaaaatgttgtgcaagttgcctgtggttcctaccatgttgcagttttgacaattaagagcgaggtttttacatggggaaaaggagccaatggaagactaggtcatggagatatagaggacagaaaaatacctacactggttgaggcattgagagataggtctgttaggcacatagcctgtggagcaaacttcactgctgctatatgccagcataagtgggtctctggagccgagcagtcacagtgtgcttcatgtcgacaaccatttgggttcacccgaaagaggcataattgccataattgtggacttgtccattgtaatgcgtgcacctcgaggaaggctgtcagggcagctttggctcccaatcctgcaaaaccttaccgtgtttgtgattcctgtttcttgaaattgaacaatgctgtagactctagtgcaattagtaaaaagaaagagaatgtacttcgcgaaagcaactctgatggtagattgacaaaagcaattatacctagtaatctggatatgatcagaagtttggatagcaaggcagcaaaacaagggaaaaaaacagatgcactgtcgtttcttcgtacacctcaaatgaattcgcttcttcagcttagagatattgctctatctggtgggcttgatctgaacaggccagttccaagagcagtgcgcacaacggcagttcgatcggtaaatacttctagggctgtttcccctttctctcgcaagcctagtccgccccgttctaccacaccagttccaacaactcatggcctttctattggaaaaggtgctgctgataatcttgcgaaaacaaatgagatgttaaatcaggaagttgaaagactccgtgcacaggtatctctttatttatttatgcacaagtccaactttggtatcctctttattatgcgactaaagaatttaatgctgcacatatttaggttgataacctgaggcaccgatgtgaggttcaagaacttgagttgcagaaatcagccaagaaagtacaagaggccatgacactggttgcagaagaatcttcaaagtccaaagctgcaaaggaagtcataaaatcgctaacagcacaggtaaggcctattagcttattgtcctcctttattcataaaagccatgaaccgatacttaactaattaactgttggacacctgtagtattcctggcctgtgatatattgtggttaagaatgccaagctgtgttcatgcatgttattgtggtggacattttaaatgtataatcattctaccagaaacaaaagggatatgtttcagtttcacttcacttccattttgcaagagtagaaatttcttaatgttatgaattacatgcaatgtcaaaatcaaaatgtacaatacctaaatattcattttatcttttttaaaaaaactttaatctgaaagaaacttctgtatttggcacctaacctctcaaattattcatttgagttttcttcagttaagtatcacttactttagttttgttatggctatccttttccctgatggctattgtctgccttttgcttcggcttgtgcagctcaaggatatggctgaaagactgcctccagatcagggagcctatgatgggaatgaatcaaaacaaatgcattttccaaatggcacagagttgcatgctgctatctactcgagcacgaatggcatccaccagctacaaaatgagtctatcagtgctttaaacacgcctagcctgaacactggaagatccttgcatgcaaatggaatctcaagtcaacataaatcactgggtagtattagtgaacatagtgaagtgagcactcacagccatcgggtttcaagccctcatgacactgaactttcaaatcgaagggcacggatcagtagtgatgagttgttcagtgcaagcggtaaatcggatgatagcaataacagggatgctaggtcccttcaaaatggtgaagatggttacaaacctcgagggacagtatctctgtccagcaaccaagttcaggctgaatggattgaacagtatgaaccaggggtatacattacactgacaacattacgcgatgggactcgggatctgaagcgggtgcgcttcaggtaaatcaggatctctatcctctttcttaaatcctgtcatggtggttagtttttgtttgccccttagtaagatatggtatttcttgactaaaataaaaaaaatgctttcgcaaatcactgtgaacctgacagttggtttatgtttcgggatatgctccacagtataaaacagaatggtgtgttattccttaattcaactatttaatcaacagtcatactatagttgcaatgcaaagtaagctgcctcttggtgtcttttaacacagcaagtgcccctctaggctctaacgtgcactatgaatggtgcagtgtttgtgctgggatcatacaacatttcatacgcaatgcccaattcaactcacttctcttatccttgcagtcgcaggcggttcggggagcatcaagcagagaactggtggaacgagaaccgggagaaggtatatgagaggtacaacgtaagaagttccgaaagagtctcgtcagcagcatcaacccggtcagctcgatgacatgaggatg

SEQ ID NO: 37643 - DNA, 11164 bp, Oryza sativa
ctcctccgccatcatggtccccaaggagctcatcacccagcgcctccaatccggcgccgccaagggccgctcatggcaggtgctccttcagatcctccagaccgacggattcttcggcctctacgccggctacgccgccaccctcctccgcaacctccccgcgggggtcctcagctactcctccttcgagtacctcaaggcattcaccctcaagcaacgcaacaaggagagcctcacgccgggagagagtgtgctgtgcggcgctctcgcgggggccatatcggcggcgctcaccaccccgctcgacgtcgtcaagacgcgcctcatgaccagggtgggcaccgaggggagccgcaccgtggttgggacaatgcgggaggtcgtcgccgaggaggggctgatgggcttgtcccgggggattggtccgagggtgctgcacagcgcttgcttcgccgcgctgggatactgcgccttcgagacggcgaggcttgcgattctcaaatggtacattgaagactgcgagaggaaggctgcagcggagatgaaggctggagtaggcgctgcttgagtttgtgagtgctctttcaggaaagttggctgttgattttgctcccaatgatgccatgactgtctcaggagttttactgtacctacctagctatgctatgatgcagataatgcacctgcttaaattgtttgaaacttaagcatccttgaaagttcattgtagagttgaagtgcacaagcaataaaatcaggccattgttaatgtatcatcggttttgttcaatagccagctttgttgggcataggttccaggtaatgttttaaagtaacttttcatgcatcaccttttcttttgtgtttgtgcgcgtggttgcaactgaagcttgagaaaatggaagttttttttttcgcattttaagcaccacgaccacacaaacctttactcatgtacagcagtgtaactctccattgctactcattttctgttttgcaccgcattagtagaatatcatgcaacctatttgattcactagctcttagaagaatcagtggtagtttgaaaatttccatttaatggatgttttatgattctaccactactagatgtttcatcagcttcaaattcatagtgatatactgatatgctttgtctcaaaaagaaaaagaaatcatagtgatacgattcaacatgaaactctatataactgctaatgtttgagtgcgaggtctaggcgactaggcatcttattttagtggttgctgttaacttaaagggtacgtttgcctctttagagtaattcaacaatatagtatcagtcacaatgcaataaaaacattgaagtgtctaggcatttagtgtttttctgatgttcagtaatgagttcacagttactgaacatgtttgatcatactgaggtagagtagataagtttgtgggcaccaaatacaagttcacagttacagaacatgtttgatcatactgaggtagagtagataagtttgtgggcaccaaatacaagttcacagttacagaacatgtttgatcatactgaggtagagtagataagtttgtgggcaccagatacaagagtgcaacagaaatttaacgtgctatggttcatcatttgaagtactttctgcagaatgaatctgcagcatctgggtactgagctctgatgtagttctccaggcacttcttgtaggagaaatcttttctggatccatctgaggacatgacatataagcacctacttccatggaatacctgatgcctatcgacctataagcagcaaatgagtcctcatggttttccattttttggttcatctgacgcagaaagattcaagaaggcaagttgcttactgttatgtagttgccgttgccagctatcttcttcttcctctctgggtggtacatgagaacatttgtgacaataaacttctcatcatctggaggaagtttaataccgtccctgcaaaagtattgagagagatggactgtaagggatacaacagaaggaaccacctgggcggtgtttgaacatacacttaacttccatcttatcatctagctatcaacgtactagtggtcgaaaaatgaagaatcctagtacttgtgccttttcaagtttattggaccagaaaaatacctcgattcacggatgatcctctttacattctttgtgattggttcgatttgttcaaatatctgctgctccactggtgtaaaagcacaactcgctacctgcctcatactgcctccacggcgtgatgcctctgatttccacactgctctaccaccacctcgattcctattattgccactgcctcggtgtgatgcctctgatttccacactgctctaccaccaccttgattcctattactgctactgcctccacggtgtggtccctctgatttccacacttctctaccaccaccttgaccgcgattattattcttcctgttccattcacctggtcgggatgatcctgcaatggtgaagttctgtgtgcccgcgctatttgaactataccaacttggtttatcatcttgctgtgttgcatctgagttccagttactcttggtcttcagttgccttctctggaacacctgaccagtaaattctactgcagtagaatttggggaactcttggtgtttccttcatgccaatttggcttcctcggatgtttttggccagtgctgtgcatccctgccctcctaccctcagattccatcaggaattcagcttttggtttgtctgtccaggtgatctgattgttttcttctaaacatactttatcctctggaatgcagtcaacatcatataagcagtagttatgaggaacaattgccttatctttagttgctcctgttgtttctactgcttccaagaagtcatacagaccatacccaccaaggatactcttgcttgatgactgaaaagagataagaagttaaagtgatcttcaaaagtctctgtaaatatgagtggtgttaacaagtaaagttgtcaaatgtaccatgttctcgtcattccaaaggatttcaaaagctgaaccagttccaatttctgcattattgccccaagagcaggctgatacaacattgcccagctgatcggagtaggccttcgctgctgccttctcaaagcattgtattgatctctgcaacatgttttgttatatttgaattatgaccaagacttggttctggctcatttaagtgaggatttcaaaagagatgagagtgcatgacttactgatagtgtagcctccataaatggtgcctgaaccttcagagattgacatgtggccttgtagccagagttgttgaagccatgcaaatcgcctgtgcaggtcatgctacttgcaactgttgtcaggtgctcttggagaactgattttgtaatcattccaacagacttggaaaggtactgaaaggagcacaacacgagcaatgtttcagcagaagttacctgaatttcagctaaaaggagaaaggggaataactgaacctgtgtgactttttcgaatgcggaggaaatgccaaacacctgtcggacttgctgtatatcgtacggcatagacctggtggtgtcaatcagatccatcacagggatacatgcattcattgctactccccaggcattgccactctcagcagccgcagcctcttccacagtgatttccagtgccgcctcgcctttctgttctgcaccagagctctggacccaaaatgttgattctggttcaatccttactaggttggcttcctcaactcgaggatcacctgtgaagagaaggtgcagaattgattgtaagtaagcataattgcataggacattttcaccataactgtctggatgttcctcttgcattttttttaccttttataacagtgtctaaaattatagggaaaatggcattagtcatgaaatcgataactcgttcagtagattcagatatatttttagtgatgcttccagggaggaaaaactgcaagcaggaaacctgaaattttttatcatcatctgtatgttggtcgcacaaacttgtgctgcaaagaagaaacacatgatttagtttacaacaaaaatatagtcatacttccttaaaaatattcttttactcaaaatatggatggtagtcccaaatgcataaatacctaatggaagataatatatttactagagtctgaactgtgccataaagaacttagtggtctagcactgaacatatgacttaaattagtagactactggacctgaagttcagaagagcagtaaatctctattcatactgtctttattgctaaaataatagaagtttgaagcaccttgaaatgaaagtgactgtcttcaatatttcacgcatcgatcccttcttctttatgttattcctaaaagtctcctggcatttgtgaagaacactgtccataattgtttcaatctgattcaattgcttctgtaagagcaagagaaacttataatcttagtgattattatgaaatgacatggatataatttgagttactgaatgatagaccttgtcaaggtgaatatggccaacaagatgatgagctgcttgagttgcttgctgttgatacctgaaatattatcccaacaattctgagccttggacaatgtagaactactaaaagggaaatctaagaaactaatgctggactgaactgggcaagttcaacgaaatgctctttttccccaaaaagttcaataggatgccaaatcaatagttgctgtttaattgcttgcatcacatgaaataagttttgtagatttagtttaatttatagtccaggtaaagtagaatcaataggacttgtatctttacattgcagaagcataaataattggaaagcctgatagtacatacttgatggatatctctgtggtacaatcctctaatttgatcctccttaagcaggctcgaattgtgagtgctctctccatgcattcattttcacaagagcactggttcagatacaaaatgacctttcggtgattggcatcagctttagtgcttgccctagtaagcagtacttcctataacagtaacatttagtagtaaaaaaaacatatgaatttagtagtaaaacaaaatttagtagtcaaaattagtaaattacagtctacatatgaattgaactgaggcttggagtgaattgatctggtcagcttctcaccttcatcgagtcccaagaaattatattattctgattaggagccaacactgccttgtaagcagcatttgcaactgcagtggctgccaagataccaacggggtcacctggtgtcacacaatttgatgcatcccttgagccaaactgaagaactaagttaccagacgaagttcttatggatccatcatagcatgctgtgacatctcggagtcttgacatcatgttcttgaaaagactgccaggctccactagccctttagatgcacgcattatcttctccctttcacatatagaatgaagtagagcctcatatgggtttagtccatggtaaattgagctccttacagtaccatattcctctagagggttgcaacaattggtactcccgcaacatctgtgcagagacttagacaggcaatcctccactaacctgctactgtatagtcttccgttgtgttgtagttgaggccccaggaaaccaagctgctccactactttgttcatgttggaatcacttttgggatcaaccaacagtcctatggcagaagaatgggttatgaaatccataattggttccctgtacttatttagctcaagtggattattttgaatagcttccagaattggacttgggacagtgaaatctcccaaatttatgctgaagcaatcaataagcagtgactccattagtaagggctgcagaagattcagaaattctgtggcctcccttggaccctttgtagaaaggatcgatgagatggtggtaccagtagctaaggctccaacagattctctgtcaagatggtctgccagtgttattgcattagatttagtggtctctagaatctgaggaaaggtccagtaaggtccaccaatcagtggcttctgggggtacatccctgatgagaacattgcatttgtaatttggtttgcttccctctcagaatactccctaccacacatgatcttcagagctagtgagaaatcattcttgaactgaaagttcagtttcccattatgggagctcaccagctgcttatccacagtgtatagctctttagcttcagctcttgctgaaagcgaccttgggtagaagatttggacacagtcaccatcaaaatctgctccaagtgggtcacaaatgagtgggttgatctttatggtgtgatcattgtggacttggacatagaaggcctcaactgagtgcttatcagtgcttggtggcctgttgaggaagacaatatccccgtcgaaaacccttctgttgacaatttcgccgaccttcagtatggtgtgtttcttgttcggattgtccttccctgcatccaatgagtacgtgatggaattggcatctgtatatgtcaaacatagtcctttattcatcatgtcttgcaattgagcaatgttgtggtctgtgactttttcttctactgacattctctttgctacttcctcaggcaccccaacaacattgagaccaatgtatggatcaccagtaatcacaccacgggacgagaagcttgagctcttactgatgaacaatgtcttcattttttgcttccattgcattgctgttggttgacttgtgaacgtgtcatctccgtgacccttcaagagacatacgatgatgataaatttatgaagatgcaattatgatgaagaaggtaacctacactttatttactaatgaatcatgtacctttgttgttcctccgaggttgatgtagttggcaacatcgacctgaagatcatctgcaacttgatccacttggatgtttgaggaaccaatccttgaaccacgaatctgctgtatcttacgtagtgctttccttaataagtttgtcgatgtgccctgattaaagaagggacataaatcactaggtcagtggtaatgacatctagaagggaaaaaggcaaaaagaacttctaaacttcaatcaaatagtgtttgattaggatgaacttactgaacagctgaatgtatttccatccaaaacattggaaaccctcaggcagtttggtgggacgcagagatagctcagtataaaaccatcctgaggaatatatcccctaacagaaagccaccttcttgtttcttcagggatcttctttatgatgttttggacctgacaaacagaagaataaaatgcgaagggggacagatagtaagataaatgtgtgcaacaatttctatatgcaaagctactctatgtaagttctgaaacttatgcatttatctttgctttgttccaataggggtggctttcgcaacatgagcaagagtacctcttctgggagcaaaggacgacaatgagaggtacccctcgtgcaactgccaaactgatcaaggaagctccagaatccctcttccagttctttcttgataggtgctctcaactccaagccacgggcaccattggacttcttgacttctgcaacgcacagcggtgggagctcctggaataagatggattcaagaactaatgatgcctgtttgcattacttggcttttcacagttgagggaaaagcaacattgacccctaagaaacataaatggatgatcagctgcaaattacctgacagtgtgaacatgaagtgaatttgcttcccttaagagtgctcttctgtttgagttgttaagtgcagaaacatgtgttagcgatgacaatatagtatggcttatcgcatatgctgatgatatgcctgagcatggtttttgcagttgtacctttctgttcttgatcttgaggcatctcaggcatattaagttgagtatctggctcagctcggtgacatggctcgggtggaagatgggcatgggcagctcaatgaatctgaagtgaccttggaatcaatcatcaaaaaatgaattttatttccatcaaaggtacacaacagagtgaagagtgagcactgtctctgaaactgttctttgcaatatcttttcttttttttttccagaaacagattttcagacatcatgccatgcaaaataaacagtgaataacttcacaaaacttgctttcatttgcacccgtttggaaatctgaaagttattgtccaatgcaggatcgcacaaaagagattgcgactgactagcataccctcgcattcttcgatggcgttgctgccacacgactgacagctgccgacttgcagaggcaggcccaagtatggattgttcagcagctggctttgatgcgtgatggggatcggcttctcgagctcgttcaccggctgcgccttcagctgccgaatacacaggagtcacagcaatgggtaaaagaatatgataccaaataccattggcaggtgaaggtgatgatggtttgacagcttacaatttcctcgttgctggtgatactcaggttgatgcgtctgatcgaggcctcggggatcatggcagtagcagcagatgttggatcaggatgaccttccatttctgtacgactgtacctgtggaggcagaggttagtatgcaatcactgaaaccaaatggttcgtatgatcagtgtcatgtccaaccaaaaggagaatcaaacaactagatatcaaccgaagaaccctagaacatacctttgtttctttttttttaatatggttatggatggacaagatcaagagcttgctagtcgatcaatggcgacctcagatgccaaacaaacacaggaatgaagttttttgggaactgtattatctactggtttttactgtgttatacaaacctcttctgtaactgtaaccaaccggtagccacccaaagtgtaagtgtcaagtattgagaaagctcagaactcagaaggcaggaggcctctcttttactcactcaatactcaacagtcaacacgcatcttttactctctctctctctccatccaactttggtatcttgcctactccatatgttctatctactttgtgaataagggtgaggcctacatcactgtgtattttagttgttgttgtaattacaatggtgaaagaagaaaacagtaaaaaaatgtaaatactccatgtggggcttcttttttttaccgacgtttaatttccatcctttcaattctgaaagttttacctaccaaagcagtataaaaatctgtaaatactccacgtgggaccaatattatattttaaataatctaaatatttaacatcaaagttgtataattgtatttgttatcaagagcactttactaatatttcatttcctctatcctaaaatataaccatctggcattttaattttattttagaatatatcaattaatcatctcttatttcattccacctctctttaaattctgcgaaaatcagtactcatttaatttcaccattccttaatccccatgaaaaccatcacttatttaatatcacttctctccttaatcccagtaaaaatcatgtcttatttaatttcacctccatccccgtaaaaaaaaaggaagtacagaaatgctcatatttttttaacctagcgagtacatttaaataagaaatagatcaataccccgctgcgttgctgcgggaaattaagttatataatatatacaaatatgatgcaatatgattattaaaactaaaacaaattgatacttatgaattttgagtctataaattattgagattgtatggtgttatgagagaagaaaaaaaagacaatttgaaccataaatccatcatccaatggctaaaaataattcggatgatgtggcttaataagagaaaagagaaatagcaataactatatttagtggggataaacttacaagtatacagaggattactttctttccgtgctagttcgatcaccccttaagcaaaggccgtaccaaaacctccatcattctaaattaatcattactatcgattaatatgcttcgtcgcttcttatctaataaaaatcacttcgcattgggttgaatcaatagaaattaattttaaatgttgtatgggttgaatcaatagaaattaatctttggttggttgcatgtataaagttacatatatgcagtacatatttactcttgtataaataaacaaagaaccattgtgtcatatgatgattatttttttaaaaaaacacaaataataggtgatgatcaaactgatggggggagtaactgtcaaagctcatcaatgtccctcgcaaaaaaaaaaaaaaaaaaaaaaggctcatcgatgtcaccatttagggagaagtatacccaaggtccctcaacttgtcataaaaaacatcctcagaccgcaaaatcatatatgcgaggtatcttaactatacaaaaccggtcacctgagattctttggtggttttgaccccggttttgatacgtggcagctgagtcagcatgagacccacgtgtcagcgtgccacgtcaactttcccctttcttttttctcttctttttttttttttacttctctttgccgtgggggagtagcaacgcgcggcggcgagcggggctgagcggcggccggcggaggcggggtgcgagcgtgcggcggccggcgaagcggaggcgtgaagcggcggtggcggcaggcggccgcgcacgcggcggccggcggatggggagcgacggccagtaggcggaggcggtggaggtggcggccctcctagcggcgggcatggtggtcgtcggcgtcggcgtgccccgcgcccgctcctcccaatgggatcctctcctcctcgtcggcgtcgtcatccccctcgtccccgccggatcccgccgcggcgcggtggccggcgtcctccttctcctccgccgccgcatcgagggcgtgcccctcttctccctcccagccacctctgcccgggtcggcacgcacgcctccagcactttcaactccttctggccatcgtcgtcggtgcgtgaaatttcgacaatttgtacctgtttttctttcttttgttcagtattacttgggggatccactaggtctagaaaaaacaccccgcg

SEQ ID NO: 37644 - DNA, 7099 bp, Oryza sativa
aggatgggagaagggagagagaggaagaagaagaggggctctagttgaagagagggagatgctgagaatgacatgtggggcccacgtgggccccaccatttttttattaatttatgtgtgagactgacatgtgggtcccacgaagtttattattttttcggatcaaattgccacatatgcgccacgttaatgccacatcagatgaagaccaagtcaaatttgccacgtaggcgccatgtcagccaaaaccactctcaaaaccgtcgagggacctcatatgcactggttttgatagttgagggacccgtttatctggttttttggttgaaggacgaaaatcgtactcgttgacaagttaagggacctcagatgaacttattccctggtgtgccgatggcctgttgctctgcttggcccactaatgaacttgtatgggcccaattatagtggcagtaatagttgggcctaattgtagtgacagtaataactgggccaaattttagtggcagtaatattttgggcccaattatagtggcagtaaaaaaaaaatgggagaattgcatatttgccactactttcaccccctaactcaaaatagccattataaaatcatgaattgcaaatttaccactgaaaacagcatgagcagattccgtatgccattgccgttccaatttgtacgagtaagaggacaaaaataattcatgaaattaaattaaaaaacaaggcaacgtgataagaccatgttgcccttgccagattcgaccttatccgctttcttccccaactctaccgcatcagaaacatctgctcgaacttctctcctctcccacgatgaaccctacaagcccaatcctctcatcccttcattcaaatcaggagcaaatcgatcaaaaatcggtcacttgggagtagtagatgccaatgaaagaggtgcagatttcaacgagtagtgcagtaaggcaagcagcggcttgcggcgcgcggctccggcaggtgtcggcgtcgactgccgcgcttgcggctgcttggcgacggctacagcaggctgcatcaggctgcggagggtgtcggcgttgagtgcggtgggctgcggcgtcggctgcttcaggcggtgtggtggctacgatgggcagtagcagaaagaaacgtatatactctatactgaaatggttgtgacctgctatctctgtctatcgtgtaggcatttagatgtagattttcatctgttccttgttgatctactagaatatttctccttttttttttgcttatcctgtaggaatggccgaggttcttgacagccattgttagggttaagtcttatttcaccacatcgtttttttctttttgtcaaagggcatatgttaaaggaaacaatgtcaaaatttctatcgaaatgatgctagttgactatgttcttgcttgctgcctcaaatattgttttattgatgccaaaatgttgtcaatttcacaatttcatgggcaagggcatccttgtcctaattttcatgaaaaccagccatctaacggtgttagtctaagctgttagtccagtggcagttatgttagtttcatactgtttttgatggcaaatttacaattatagtttttttagtggcagatccacaatacctgatcaatccagtggcaaatatgcaattggcccaaaaaaaatctctgtgcgtgtgactataattacgtggctttccttcctgaagccgtcctcatcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttgggtacgtgattctgcactcggttggctccacggggtgttgttcttcgtggctgcggttgacgtgatgttttgtggtctcccccattgtgtttgtgccaatgcgtggtaacaatggcggagaactcgtatgtctgcgagtagcccccagcttttggccggccgccatcgccctgagacatggtcagcgcgtgcgagatgcgagatatgagaaggagcagtgtcgaccacccgagtcttagccgagcggaggccggaggcctgaagctttgggcggcgagttggccaccgaggttcgtggcggtgtgtgcggcggccgtacggggtggcacaccggcgtgtggaggggagcgaaatactgtaagaaatagaggacgaggcatttccccaaatattgcggtatttgctagattagtgtcttggagttggatgctaaattttgggtaggatatgttcagatatgtcagagaaattacaatagcgctctagcagaatctgtagactagtagcatgattccccttttacagtatcactatggaatggaagaattttctgttaaaattttacttctaaaatctcaatccaagaaatttacataggaattagtcttcagtcttttcttagtgtagttcctattgatgtcctattactttgtgattttttttcctgcgctgcgcgtttaatgttcaataaaatgaattttaatctattgccgatgcaatcttgaatggcgttggcactcaccgcgcctcattttccatacatcctctgccagcgacgacgccgtgccacacatcacaaggattagagattgtaatagatagtaagggtgtcactactgagttaacaaggatgaactagtggctatttagctgttaagtggcccaactaagacaaagacactatcatctctgaaaaaagcggtgtattatatatgagcacctttaaatactattgtgatgtcttcaagtcaaacttaaattatttgtgtgtgcaatacatctgcatggttcatgttcacaaatactaaactatgactgtgacttttccttatattctgttggaattggcagcttgccatcaaaatctgaggtcaattctgtaacaatgtatgttctttcaaattctgtagtagtttctttctgatgttgaatacagtctaattatggagtgagttattcctgataacgcatctccttttatttgacagaggtcaaacatcactgatgccaccattcagccttatgcttgatgaaggctctagatctaaaaagccatatagatggcaaagggtgttgcttaaagtaagtggggaggctcttgctggagatcacacagaaaatattgatccaaaggtgaggttgcttttagtggagcattatcaaatttaaaatactgaatatttgatggaacaggtcatgtaagtgtgtaatgttgttgcagatcacgatggcaattgcaagagaggttgcttctgtcaccagactaggtgtagaggtgtgccagtgcctttcattcttttattgcttatttacccgattaactgtttgaagattgaaattaaatcaagtgaaacataattaggcatgtacatagtagacatttaaagttcaacaactaaaccgccctgtgttccaacgaagtggtattatgctatgtgtatgttcctcttgtcttctctattgtagaaacatatgctgtacattaaagatcgggaacccttgcaggttgctattgttgttggtggcggcaatatcttccgcggggcctcttgggctggatgtagtggactcgaccgctcatcagcagattacattgggtatgatgttcagttttctaatgtctttcataattgaaccatcgtaacatcctgtggttggcaatcgagaatgcattaaatgaagtggaagcgccatgagggttaacctaataatgacacaagaacacccaactcggcatgccttagtagttgcatgcaaccatgcaaatatgctaatttatgtaatccatgctaacttttttttttggctatttaaacatctataataccacgcctgattgtgcctatcggcccatcacgtagaacacatctaaatttcatagaacaaaattccataacaaatttccaagcagaatagtgtactgagtgtaaacttatagttcgattttacaaaccatacaatcaataagtatatactgttctctgtaagtgcaaacttacatgtaagtatttaacatatggtctatatcctttgcccataacgtttttaaaaatgttttttaggttttgttttaaaaaaaagaagacatcattcctgttataagtgatttcataatttctcagcataaaatagttcaccactttatcttactcttttcctaattcagcatgttggctactgtgatgaatgccatatttcttcaagcaacaatggagagcattggaataccaacccgtgtccaaactgcatttcgtatgtcagaagttgcagaaccatacatacgccgaagagctgtcaggcatttagagaaaggaagagttgttatatttgctgctggtacagggaacccattctttacaactgatacagctgctgctcttcgttgtgcagaaagtgagtttatcctccgtttctcactaatgaactggtgtaattgtaatcataaaatctcaacaaaagtagtattggagatacgtgaatacttttatattttaaagccaagtgcttataagctgcaatttcatgtcgtatatttaacaatatatagtactgcaaaacattcaaggtacttttgcgagtttgtcatttatgttagtcatcatgcccctgtcagttgctggtaatagaactagagttctacccacaatagctcgtaatgttagtagcctcacctctgagtttatcccatgaattcatgaagacccttgtgcgccctaaatggttaagctagacagttaggctagacaaggatcgatcatttattttcaaccttgcttcccagaaactagagacatgatgcagagattgttatacatgccatgttagggtgtgtttaactattctatttcacaagaaatcattagtcacagtttccattatgcatgtagaatcattttatcatgaattgagtttgaacttgtctttctataatgatttctcaaataaacatcattgtctcattttgtttattccatcttacaatggctttttttctttcattttgcagtcaatgcagaggtagtacttaaggcaacaaatgttgacggtgtgtacgacgcagaccccaagcgtaacccaaatgcccgccttcttgaggctgtgagctaccatgaggtgcaaacaagagacctctcagtaatggacatgactgccattacgctatgccaagaaaacaacattcctggtaaggagagagctgtcagtttctgagacttgatacagtgtttgatttgcattctttttaatttggcctgtaatcttgcagttgtcgtgtttaatttgcaaaaacctggaaatattgcgaaagctattgttggtgagaaggttggcacgtttataggctgcacaaaagatcaggaccagattgtggggaatgcactggatcaagaaagaagattggtgaacgagttatgatttcactggagctctctgtcgctagctgtgtagctgcattgcctattgcttggtaacatgtggatctctagagtttttaggctagaatagcttatccaaatcctggttccttgtacaacctttgagcaaaaataaaaaaaccaatggtaacagagattttccagctgatatagctgctatgttgtcatactatgtacaatggaatctagagcaatctgataaatcacatttatatcttaaaatcattgcatgtggcatgtatgatgtcttcacctaaaaacagtttcttccttacattcatgtgcagctgaagaaaaaagttagaaaagcgactacggagaaagcgagggatctaatgaaaagttcaaaaccgtagtggacaaatctggaagatggtaaaaactgcctctaagcacaataggaaatcaattaatgaaattaatataaggacttgatcattttgttgtccaaatcaaccataccaaattttgatactccctctggttctatattaattgacgttttgaacaaggttgagattaaacttttataactttgaccatcaataactttaaaaatatttagtttaaagaaactagaaaaacatatatagatttgtctttcaaaacactgtaataaaagtaaacatgcatttatttattgtatatattataatagaaaaataaggttaaaggtatatcttgtagagcgtgtcattgtccaaagcgtcaattaaaatgaaactggaggtagtacataataataaaaaagatagtgttgtctttgtttggtttaatatctttaccaaattttccgtttagaaataccaaaatttgttaaggtactaacagtacaaatgtgtttagtttgttacctcgataataccaagatttaacaaagttgaaagcggtcataaactgaacagtacctaaaatgaggggggaaatagggaaagaaaaagaggatcagacaaggaagaaagaatggaagggtggtgagaaaatcccaattagcaacggtcacctgatcacctcgggaggctattacactaaccattaaccaacctcgcgtcatctctcccatctcccatattcccatccaagagtagaggagagaagagaagacgcagctcacgcgcgaggcgagtgagcccaccaccgcccccctcctcctcgccaccgccacgtcatctccccaccctcctcctcttcctccctccgccgccatgggccgccgcgcgctgccgccgtcgtcgtcgtcgtcgtcgtcgtcgtcgacgacgaccacctcgccggagctgcggcggaagcgcacggccgcgccgcccccgccgccgtcgccgcggaggtaccgctcgatctccgacgtcatgcgccgctcgctgcccgtcgacgcggcgccccccgtggcgcgcgcctacgagagcacgcggtgcgacgtgtgcgggtccggggagcgggacgaggagctgctg

SEQ ID NO: 37645 - DNA, 5251 bp, Oryza sativa
  unsure (1)..(5251): unsure at all n locations
tagtggatcccccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcgcgagtctcgagcttttttgacagccctactcggaatgcttgcccatcaatgaaacctcattccactcctagttatgtgacaagagggaaaccttaccgagctctcaacggcgaggtttcaataccattgctactctcgcaacatggactatctggaaggagcgaaataacagggtgttcaaccagaagcacagaagctggacagaagtggcaagggcaatggcggaagaggcagcgctgtggcggctcgccaatactgccataccggccacgcctttagagcgctcaggtcgcaacattgtatcgcgagattagggtttaatgttcttgggtgacttcctataatcccgtctcctgctgtgttttccctttaacctgtacagacttttactcctcttaatacaaagatgcgcttcttacgtattcccgaaaaaaaaaatatcccttcttctctttcattctttctttcattccagggttaagcagatcaaatcggccttctacacactccccaaggtaacatcatatctgtcatgttccacctccacacaaccaaaacttatttcaaactgaattctctgtaatatactatgcctgtatgattcatcagttattcggtgaatccaaaatcgtggagtacacaattacagaaaacgaaaccgcgcccggaaaagtcgaggtaactaatcaacccaaacttcatcgacagtgtttgactatcatgctgatcactaacagaggaattaacaatcaatcgatctgtttcagatactgatcgacaacaagcagcactacaagttcctgggcagggccatcgacctggcgtcgctcatcacgctcgacgtcgaggacggcaaggttgtgaagcaccaagactggtgggacaagaagcctctcaagaacagggacacggtgagcttcccggtggtcggccggctggcggaggcgacccgccgcggcgccatgctgctcactcacgctctcatgggctgcggcaaggacccataggccatcgcctccgacagccctacaagtggacaatctcgctacccgtataaaaatatgtttaatatagtttattctctattcactagtactacctcctttcctaaatatataaagttggtttgtttaattttaaacgaatcaacgtcatacaaataacacggagggagtacattttaggtggactgtaaattaaagattgtactccagatgagtatgacgtttttttgcctcatatcactattatgtaatatcatttgtatctactacagtacaatgtttgctttacaataatgaatgtagtactacgttgtatgtagcgcaaattagtgcaagaaaaattgtggcaggggaacactgtgctaccactgtgctacaccctgcaagtgaagtctctgcattgtttctttcagagaagccgtaggctgcaatgctgcacctgaatagaatttgccgtgtaggtgaatgcgtcggcaccgacgactgcgtccacgagatccgagttaaaggcacttgcttttactttgcttgcgctgtaaattaattttcgctaaagcctaaagaggtcgtagtcgtagtagtaaaagatcacaaactaaagagctaaagtgttgtgtgcagtgtggtgtcgttccttctgcaatgatcgatacacagattaatttcatttctatcttcctgtctaacctcagttcacaaatcaatcagcttgattccttcaatatgcctaatcagccctaatctatttaccgttaatactactcctgtttttttaacaacactttaatctttcttgttttgcacgtataagactaaaaacgaagttattttgggggaaaaaatactccctctatttcaagatgtataacgctgttaattttttcataatatttaaccatttgtttcatttagaaaaaaatataaatattatttattttattgtgacttgtttttatcatcaaataaaatataaccttgacttatatttatacacatttatactaaatctttaattaagacgaatgatcaaacgttaaaaaaaaagttaacggtgtcatccaatttaaaaatgatgtagtactgtttagcattagctttatatttttttaggaaatactactagttccctgacctcctggctactgcatactgtacgtactgaccgagtctgcagcagcagcaatcaactgccatgaatagagatgtttttcatatggacaccgaaatgcacgttatttagcgaccagttcgtcgtgcccttcaatttcatgccatgcaggcgatgagttggcaaaacaccacatcaatcaagctaaacaaacacaacacatatcctctgatctttttcagccggattctggatatgagtcgctggcaactgggccccactctgataacgcaaagtcgaaatcccaaaagtacccctcctcctttctctcccactaaccatcgccgggaaatattcgacttaaagttaaagaagccaacgttaaagacatcaaaaaatcaaaaaagaagagacataaattctctttgctcacagggagtcatctcgttggccatatatccaaaaacacatttcacttcatcgtctcgatcgatcgagcttcgagcagagtgatttagcgagagtgattagttagccgctgacaatgagacgccaggctgtcgtcgagctcgtcgtcgtcgcggcggcgctcgccgccctcgccgccggcatcctcgcggcgtcgctcctcctgctctggcgctgccgccgccgatcagcggcagcaaacaggcagcaaccagccgtcgtcgtcgcctccgacgccgagctcacggtccagagcccgaagaagccggcgccggcccggcgccgcggcggcggcagcgcgctccggcgagcgctgctccgcctcctgttctgctcccgccgccgcctcacccgcgtggagccggccgactccgccgccgccgccacgcagggggaggaaggggagcaggcggcggggcccgacgaggaggaggtgaacacgtggagggatcggtggttcgggccagccaccgccgccgcctcgcgcgcgctctacaccatcgacgaggagtccggcgccggcagcgagggcgaggaggagccggagcccgagacgccgttctacacgccgccggcctccccgccccggctcggcggcggcggccactcgccggaagccaccgtgtgaaggtgaagctagcagctggtgttcgtccacggtccaccgcgacatgattacccgaccgttttcttgttttcttgttggctagtagcaggcttggatttttgttgtcttctttgatttttagttttttgctcatgtcaaaacgacatttttttagccaggttgcatggtgcacaggtacagtgcagttagtactagtgcttagtgtagttgttactacttaatgcacgagcaggatggtgattaagatctaatctcgtatgctagccagcttgcaccagttgatggagttgcataggtgcgcatgttggagacaaatttaatctctttgttcaaacattattcaaattatcatgagaaaatcttaaaaaaagttgaaaattcatatataaaacataaatatacaacttcgcaaaataacatccacaaataatagaaaaagataaaatccaacttatgagttatgaatagcattgctgcaatatatacgtgcgtggatttgtctgtttgatatactgagcgagtctgaacctaggccggcgtccgttttcttacatcgcggagatttccagcgcacgcgaaacgagaaggttgattgagcacatgctcaataattaattaagcattaattattataaacttaaaaaataatttatttaatttttaaaacaacttctacatagaaaagttcgtaaaaaacatttaacggtttaaaaaacgtgctaacgaaaatggaggaaattaaagtttggagtcgaagataagtgttgttggagtggtaaatgttactgaaatctacattgtcattttttttaaagaacttttcacgatcatttgtattgaatttaatttaaaaaatagtagatgaggggagatctacaaggaattaaggggtgaaaatggtcggaatcggtaacatctcttcggaaacgacgctcgatcgaccgtaattaaccatatttatcatttaaattattcaatgtcaacattaattgctgaaaaagaaattagaaaaaaaataaaatttatataacaaaaagggtaacagtgttatgtcgatccgaaatttccatcgcacattttcatccccctccatgcgcatgcaccaaacactagtcaatgttggacctttttcttctctgctctgtgatctcttgaccagaaaattaagcccctctatttctgttgcctgttgcatgtatccgaggaccgaggtaattagtaattaaaaaggttccaattgcaatctactccccagtatacgccaaataaattgttccactagatcttttgcagatgggcgcttagatgaaagctacgcagtgatctatcgctgtctcctccatgagtcaccaggaaatactggagtatacattaatattaggtgggtgtttggtctgtgtgcaaaaatgtagaactactacaaatggagtatatcactaagtaagttatgccttgagagtgctctagctagctagaaatcacagctacctaacctaacattgttcggtaacctgtactatgtctgtaccatgctgatgaataatcatcatctcatcaactccattgacaatgacacactgacacttgctgcttgtgacccaggacaagaacaccaaattttagtctcgactctcaactatgcatacgcacacctgactgaaattagtcgcacttttaaaa

SEQ ID NO: 37646 - DNA, 3341 bp, Oryza sativa
cccccgtttagatattactccgtagtactaaaatgttctttagaaacgaatgagttgcaggcagagctgcatctcgtcgatcacttcatgccgcggagaagctggagacccgtcgggtagacgcctccggccaacaggtcggtgaagctgcacaagggtgccatctccaggaatgccagctcgtcgtcggtcaggcgagccgccgtcgtcgtcatctgctcctcctcttccttgctgctgccggtgaccgtcgccggagcagacgcgcgcttgcttctgctgctgctgctacctttccgggatggaactggttgctgctgatgagcagagatgggtttctgcagcagcgtcgtcccggtgatggcgaccaagctcagcttcttggcttcgtccctgacctctgcctgcattggcctgaaggagaaggatctcttccaggtttccactagatcagcgacggccgggatcactagattttccacttgcaacgacgccaacacctatcaaattcaatgtacagtatgagtctgacaagcggcaccaacaattgctgaatctctttgcagtgaaaaattaactgaatgaatgataaatggatggaggattggtgattcagtaggttatgcaccttttcaacagccttgacaaggcgacgcatcattccttgtttctggtaagctggcagcgtgcctgcgaaaggcatctcagccagtttcctgccatggaacctgtaacagaaaaacagggcaggacattggtttgatagtagtagctgaaaaaggtacaaaaaggcatttttaccaaggcattcgagtatcacaaattctgaactttataattgcaactatactggttattctcttgccatgtagaaatcctaaactatgaaaaacagcagcactgacgctaacagtaaagtgtcaaaagtgaaagacactgatactgactgaagtaagctagagcaaagtaatcagaaaataaatataagacatgaactatcgctaagagaaaaaaaactgaagagagaatggatccaaacctcagcaaggctactgaaatgatttctccatccttctcaagaaccatggtgtagaatccctcatagtttactcgtttgaactctgatctgttcgagtacaaatgaaagttgtgtgacaatgtacaaatctatctcatatgtttctgaagttatcttcttgctcttacatatattttgccagagaaacatataactgatgttcagtgctaaaccatacaaaattactaaatatatgacacgtacatatcagggtttgcatattttaggatgaaacattgaagcagttgaattagcaatttgatgcctagcagcacataccctagactgtagacagcttggtggagcatatcgatcttagtccttcgatcttgcacaggattaaagcattcattgagtacacccagagctactgcaagcttcacattgctctcaagaatgacaggcatgtcctcagaagtgactagctcatccttctgaatcttcaggagggcccaagaaaagccatcttcagtatggttcatgactcctatcatatctgatagatgagaggacatctgaaaaacggattcagaacaagcataactgagatgtgctccattaataaagcagaatttcagaagctctgtatttgtaccgcataatgtacagaatttggagtctatctatcagacatttatattttgaaaacagtactaaaaggaccattgcatctattagaaaattacgacattaattatatagaaaaaaaactacacctcccgatcatcggaggtctaaattatagtggtgtagattaattttctttagattagggcacacttctacaaccatattagaaatacagttgtgtctccataaataaacacaatagttgcgtagcaaatacagtactccgcactaattttaaggaaaaccggttagtgttggactattgctgagctagcatatgctatgggaaaaaaatatcaataactaattttcacctttttgcaggtttcgctgcagtatgcgccgatctcgaacccagggctttgcaaaggacggcagtactgatgatctgcagattaatgtgtttccagtgaagctcatcagttactattcggaaacacaaggttgatcagatgctaaaatgaagggacatgtacaatgagattaattacattttcgtgtacactgttggcatgttgataaaccctgaacatcatgtgacatgcagagcacgcaccggcagaaatggcagctccaggagccgtctggagcctgaaatcaagcaaacaaaacacccaaccaagatttcatcatgaattcaaaatgccgcaaaaaccacggttgctggccgtaaattgttgtcagttgctgtctgtcaaacagtaaccaagatttgatcatgaactggacatgaaccaaaaaatgtaaaatagtaaccaaggtttgaccatgaactgaaaaatgtaaaatagtaaccaggatttgaccatgaactgaaaattgtaaaacagtaaccaagatttaatcatgaactggacatgaaccgaaaaaagtaaaacagtaaccaagataatcttgaccatgaactgaaaaatgtaaaacagtaaccaggatttgatcatgaactgaacatgctacaaaatcaatcacagtttctgtctgaaaattattcagtcttgtgacctggatggcgaggcaatctggatggaaggtggaggggcaggtgtcgcagcagagcagctggccgccgtcggcgcagacgccgcaggcgtcgtcgctgcaatccttgccgccgccgttcttcttcacctgatgacgaggagaagaggtggagacgacgacgacgccgtcgaggagctgcatcttcttcgtcttcgcgagcttcctcttggcctgcgagctcttctccttctcctgctccagcgacgccatggccttctcccgggcgcgcatggcggtcacccgctcctgcgcccacgcctcctgcatgcacttcgacagcggcttcccggacatgagcagcagcttctcccatggctgccctggccgctcgcacctggcgtgggtttcgaacacagccacggggacgacggtgttgcagcagcggcagcggattcccgtcttggtgaccatgccggagatgaccttctcggcggcgccggcgtcgcccggcacgtagaacaccttcgctttgtccttgaggaagccggtgtctatcagccaggtcagcacggtgtgcttcttcgcctccggtggtggtggtgtcgccgtcgtgccggtcgctgtggcgttgttcttcttcctggcggcgatg

SEQ ID NO: 37647 - DNA, 4361 bp, Oryza sativa
gatatatcaaatccttaatttgtcctatactgactctaatgatcagcaatctgtgcacctgacgatcgacatgcgttttctgaatgaacgaaaatatgtattgagagacactgagaattaatgcgttatgattcatgaacaaatttaacaaccaattacgcgttgtttgccacattattaatttgccatatactataaacttccttcctgctgtcatttgcagatgtaaaagctaaaaagctgaatgataattgtgaaacgtactccaatattcagataatttatcacgatatactgatctgattttttgggccatatttagttcaggtctgcaagttgaattcacctctacaaatgttgggatgaatgacaatatttggtaacggagttcagcagtagcatacattttcaaggcattgattatagatgcacctccttgatgtagcataattgttgcgtatcaacaactttagactggcaacaccatctcacgaaagttttgatacgtttaaggtgagagttcacggtggagtttgtcggagattgccacctcatgaaccacagagctaaggacacattctttttttacaattttaccacaagtattctacaaaaggccatatatcaaaaatccagttttatatgtgctaaaaaatgtaatgtggttttctcaaatttataattcatcatatttcaatccgctactcacttttatgataattggttgtaacttttttgaagcaaatgtcagaataaattcaattgtttaagtacccaaaaccattgagttactcggttgtaacttctaaatagaaaccgatttgaaatactccctccgtccaaaaaaaaaactcactttaagtaagttgtttttttgttatggagtctagattcaaggggttattcagtttgatgtcatttctaaccatactaatttttaactaagttgctatagatgtacctacatttagttccttttttttttaccaaaatttggtaaatacattagaaataccaaaaatttgttagtattatcaacttattaaaattagcattgctaaaatttaataagatttgttttggctataatccgaacaacccctcgagctaaagtatttttttaaggagggagtggtaggggaaaaaaaagaaaaagcaaaatggcgaggccgctgcctgacaaatgggcccctttgacgacgactggaggcctttctgcgccgtcgatccatccatccggcctcgccgatccccatcacctgcgacggcgagcagcgtcgccggcgtccggctgcctccgccgcatactcggctcggtcgtcttctcgaccttcactctccggaggtctcctcgctagccccgccgcgccgatttccatccatccctcccgcgaggtgggtgccgccgtcctgccgcttccgcctccgctccggtgagctcccgcacatcccccttcctttcgaatttgccctaacctttaatatcttatcttctagatctggaagctatagttttttctctttttcctattaaaccttaatactctcaatactaagaacagtttttttccccaactcccctgaaatgtttattttctgaacttatggtggatataggttggctcctgaagttgattaggtggtgccatgggttcaaaggattctcaagtcgaagctactttacaagatgggaacaaagaagatgaagaggatggtactgtttcttttttttttttttggagcatctactttctataattctttgggacaatttggacaaaactgtgaccctgttgtgttgtgttgttgctgtggtgcatgcagattgggaggcgattgcagatcgtggtgaaaacgatgagacgctaacgctagcgcgttctctcgagcagcaagcaaaggtttctcctagtagttcttctgagaaaattagcactccatcttcagggcccaagaggaggggaaggggttcgtttctttacgacaagagtgttctatacagtgatcagtgtggtctagaaaatgatatggatgaacaagagtctaatgatcagagtggatcaaagggccgtgtggatgagcagaaacacaagagtaatgcaggtatgatcaggggatccatttctacgtgtccaggtagcctgttcattgtgaataaatgaagaacttagttttttgcttgattttgtagctgcgaaacaatatgggacaaggcatgtccttgttctttatgacttcccacctagcacactcgcagcagatttggaaaagattttcgacaagtttggggaccatggagttgccattcgctgggttaatgatactgttgcacttgcagtttttcggactccatcagctggtaatttgattgttgtagcaatttcttattgacttaatttaggtattccaacttttagatgagccattcatgtggttctctccaaggaaccagattgaacatgtgtcatatatggctactgtgtttacttagaaatttagaattttctgattgcttggaaatgtattacattgactcatgcctgtatcgaggaacatggcattgtttgcagtttgcatacatgaatggcacatggcatgctcatacctgagcaagttttcttgtaatgaatcgacataattcacatgcaaaactgtccaaattgtgtagagcgaaagcaagagattgctccttccatgatgatccattgttcctgtgattgacttgttgctggtcttagtgcaccagatcactggcatggcaggaaaatggggaggacaacacgttttgggcaaggctaagttacccaagattagtgacaacctccttttgtagtgaaacatagtaacttgaacaaggaaaaaatattgcaccccccttcttgaaaagaggttgtcataacctgctagagtgctggtgcttattacgttctttccatccttaatgcaacccaacagcctcaacaatggatggttcatattttgtttgtcttacctcaaaatagatggtgacttattttcatttggtatgaaaaacagtacattctttgctctgcctccccacaatttttgaactgatatgttaggttgctgtgccataactaaaccagtaaaatacgaggggcaacccttattttgcttgcaaggagaagggcatcttatgatgtacgtttcagtttttatatgttgacctggatcaaaacattgtgtttttcaagttacatccagactgtcagatgcatacttaattcatgatcttgttcaattcaatgcggtctcgatctttttccctttctgttggtgtctagaacttattattgatgacatgaactgccaagctatcaattacttttgtttctgtaccttattctgttttctcaccaatcaacttgcagctaatgaggcacaagcttgtatacctccaagatataaagtgcggccactaaaagaggatgacgatctcttgacaaaaaatgatggcataggtatgtatcttaaatcctgtgactattctttcctgcttgatcttctttgcatggatgatctataggttatatagcttgtacttgagtattttattcctacgttctcgatggatactgcgtaccatgtcttgagttgcttcttccgcgttgcagaccttgaaccaccaactccaaggccgaagacatctgcaagaacagcacaaaggctgattgctcatggaatggggctaaggcagtttacaaacttcgggtcagacgagctgaagaaacaagaggaggcgaggaggagtcgaatcgctgctcgacaagctttgcgggacgacgcatggggttcagattgactgattcgccgccttcatggatcatcgcctctagcagccaggctgctcccaggcctggtgccattttgtgtgacctgtggctgtgggtgcttaagaccatgtctctgtacttgggttggtttgtgccgtttctttccgacagagaggaacagaggtagcgatcaagatatatagataaactcgcgtcgcccaagcaaatgtcaagcatggcggagtatgaatttactgtaagggaataccctgaattctggcggttttggtagaccgtaattccctggattgatacgtgcttctttcagaaattctggaaatgtgtcttatttccgtagttctgaaaggtgttctgcctggattgaaatgatccgtagttctgatcacacctccgctgccaaaactcatttcagaatttctacgccagcggaggctaagagtttctgaaatggtatactccctccggaccagtggcgtggctctaaaataaagatgggacagagatatagacaaaagaacagccgagagtataaaactaagagcaggt

SEQ ID NO: 37648 - DNA, 1079 bp, Oryza sativa
gatactatgaacctgctcttattggttaaggcattggataggcgggcaccacatcataggccacgggacaaactggtagaggcacggttgcgcgcccacaggcctgtacatggagcggtgtttgcacatacaaattggcattgatggctggcgtagttattggtgcagcgaatgcgatgagcgtcgaacatcaagcaatgtagacgaataattgaggcgaagaggcgcctagtcaccaaattagaagataaaattatgattgatcgcttcatgtctgatttgaactaatctagtgatttgatgggttgattgtaggctaatggggttgtctagtactacctccgtcctaaaataagtgcagccatgaaaatccacatctgatctttgaccgttcatcttatttaaaaatttatgaaaaaaattaaaaaaatgtcacacataaagtactttttttttagaattacacaatactacgtagacactcacaacgcacgccactcacccctatgaacacacgcacataaagtactattgatgttttatcatctaataacaataaaaatattaatcataaaaaaatttcaaataagatgaacggtcaaacgttaaatatgaacagtgcaaaattgcacgtattttgggatggatggagtataggaggagggcgtgagcaatgtgggccatagccggcccggttaacccaccacgcccaatgggcaagtcatatttgatgcgatagactttaaacatagtttgatcattcaccatattcaaaaggcaaaaaagctagtattcaaaaggcaaaaaagctagtatgtaatttattttgttgtgatttgttttattcgtaagtgtactttaagcatgacttgcactttaaaatatttacactaactttaaaataagatgaatgatcgaacatcatatctaaactctaaagttaattgtgttaaatatttatgatgagagagcaatctgaaatgctatgtgggcatagcataatatgaagtattgtgtatataacataattatgaaatgtgtgggtataacataattgcgacatgtgtggttataacata

SEQ ID NO: 37649 - DNA, 987 bp, Oryza sativa
ttttttctggtaactcaggaagcaaacacacccatctcgttttgattctttcctctggattacgacgtaagtgtggcagctatgtcgtcgtcggcggcgccggcgaggaaagcagcaatggcaccgtcgccgcccccgccggctcatccgccgccgccagcaacacgttccacgggctcaactccggcagcgccgccgccgccgtcgcagccggacgtgcgtatgttcagtcgccgcgagcgacggcgctgcggtcgcgcgaggtgcgagccagtcaccaactacggcatgttcccgaccaccggcgcttcggcggcgaggacggccatggcggggcgaacgatcaatggtggcgcgtcgatgctgacgacgacgacgacgacgacgacgccaccgcacctgatccagcagctcatggtgttggctggctggaccacccggagtccgtggctccagaaccacgcgtccatgtcgccgcggggctcgccgtcgtcgttctcctccgggagattctccgacccccgtgggatgccgtcgacgttcgcttaccgaacacccggagctagtagcggccgcgttatcgacaacggcgccgtcgccggccgtggcaagcagatggccggaactagccgctcacttgagattatcgccgttgataccggcgccggaagcagcaagaacgcgtcgccggccggcggccatgcaaatgccggcgtggtggtgaaacgtttggcccctgtgctcgcgatgccgagtgccggagccgccggcaaagggaaggaggaggcggcggcggcggcggcggctccgtcgccaaatggccgcggccgtaagcgcgcgccgcccaaggtgagcaatgatccggcggcgggatccgacaagaagccgaggaagagggccaagaaggcggcggccgctggcagcaaggtgaccgtcccggctgacgtgatcatcgtcgacgacgacgtcaaccagccgagctcgaac

SEQ ID NO: 37650 - DNA, 1252 bp, Oryza sativa
gcccctccgccccaccgccgctccgtccgccggcatgctcctgccgccgctcctgcgaggacgaggaagagcgaagaggaagagaaacgagagccgagaaggacatgtggggcccacgtgggccccaccattcttttattgatttatgtgtgagactgacatgtgggtcccatgaagtttattatttttccggatcaaattgccacgtatggcgccacgtcaatgccacatcaaaagaagactaagtcaaatttgccacgtaggcgccacgtcagccaaaaccaccctcaaaaccgccgaggggcctcatctgcactggttttgatagttgagaaacccgttgtatctggttttctggttgaaggacgaaaatcggattcattgacaaagttaagggacctcatatgtacttattccgcacccagccttggcagtaaatggtgggaaaaagtacaccgaaggtccctcaacttgtcatcgggatacagaaacatcctcgaaccataaaaccagatattcggcgtcccttaactatacaaaaccggccatatcaggtccttcggtgattttaacccggttttagcctacgtgggcgtgggacccacgtgggccccacatgtcagcatgccacatcaacttccctttcctctcttctttcccttcctcccctctctctctctctgccactcttctatcgcaggccaaccgacaggtagggagcagacggccgggcgacgagcggggctgagcggcggccggcggaggcggcgtgcgagcgcgcggcggccggtgaagcggaatggagcggaggcgcggagcggcggtggcggcaggcggccgagcgcgcagcggccgaccatgtgaccgttcgggagcatgcccttgtacacggtgccgaaaccgccggcgccgagccgagccaagtagttgttcgtgaatccggccaactgctgcgccgtgaaccggatgggcttctcgccggcgatctctttaagaaacctctcgatggtggcgttgcgtatctgggagtccggcaccaccgtgtacatcgccgccgggccgtccccggcgcgaagctcgtgttggtgttgatattgacggccgggaggccattcttcttgacacatctgtacatgaggtaaacaatggcgactgatccagcaatgctcaacaccgaaagcactgcatcaccagagatcaaaccaagcatcatctcagtgaaaccagttcatcatctcgaaacatgaaactg

SEQ ID NO: 37651 - DNA, 888 bp, Oryza sativa
gctagtcatatatatatatatatatatatatatatatatatatatatatatatatatattcattagtatcaatatgaatgtggaaaatgctagaatgacttacattgtgaaacgaagggagtactatacaccattaaaaagattctaaattgtgtttattgtaagaataattggggtataaatactgtctccagatggtatcaagcatgaaatgagtagacaacaagacccaccaagaaagctacatcagttgttgggaaccaaaagctttgaggtagaggaattgacacttagcagagacgctatatttttatttttatttttgtttactacctctgtcccaaaataagtgcagccatgagtttccgcgtccaactttaatcgttcgtcttatttaatttttttttataattagtatttttattgttataagatgataaagctttaatagtactttactcgtgacttgtgtttttaatttttttttaaaattttttaaataagacgaatggtcaaatttagacgcagaaaactatggctatacttattttgggacggagggagtagatcataaccgccctaatttactttagcatacgtggagtacaagataatagagttagtaaagatttaccatgccatatttgacattccaagccattagcttccgaaagtcatgttttactgttttcacatggaatgcattataaatagcattcacatttgataaaatttaggacacatattcttgaaagataacaattaattaaacacacaatatttttatatgtatcgcaatagcttccggtgatttcaaagtatatatagtagctatcaacaattcatatgtaagatacttttagaaaaaatgcagtaagatgcaagtca

SEQ ID NO: 37652 - DNA, 51533 bp, Oryza sativa
  unsure (1)..(51533): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggcgcgcaaaaacatacgctgttattcgcaccaaattaagacacgtatatgtgtagagatcgctcgatcatatcgtgtcccggtaacaaaatttaattagctttcaaaatctcatataaaatagtatagcaactttatttactttaatttatttatcgatcacaactaattactattatcatgtcttatttaatttcacttttagccaatcagaaatatttctcaattagctttaccctctttagttatgttcggattttgggacagaagggttacatgtttcagatcgattacttaatgaccaatcaagcttcatgtacgtaactaactgatttagctagctgcgttgatcggtcaaacgcacgcatacagctaaaataaaatgtactctgaccgacaaaaaggagaacaaacgccatcgtcgctacagatgtaagaactaaccacagttacataataatactcaggttgaacaagactagatcgtcagcctccgttctagttcggttctctgtgtacaccattggttggatcgatcgaaaaaagtttgatccgaactgtctaattcacagtagagataaaagaacaagcctgcaaaactttcaatatatctataattatatttggatcatggaaaagaaagtaaatcacaaaactaaaaaaatactctagtcaaactattgaaattattacaacagatttaagacgatgtatcattcaccaaaactatcccaaaatttaagtttggatattaaaatcttagcactattgttctgatagagttgtaaatatgtagttctgcaattgtctgcttaaatacataattttatgctaaagtttatactatatttgtagttctagaatatatagttaaatatgtagcttttcaataatatctttggaacataatgggctgtaatgctgctttgcagccggctgcagcagtagatgggttgtatatatagtaaagcaatattagctgccgcgatcgtatagccacatcaatctctccccaacactccaaataatcttgagagatggggctgggtgaatgtcatcatgtctaagctaaggtagagggtggatgattgagaatacatgagaccgtgatatactcttttcgttcgaaaatagatgttattttagaatttaaaatttgtttcaaaatgcttgttactttggaattgtgccttttttccatcccacccctaaatacataatttgataaagaacgctataatagttcttctaaatattagtttttaacggtaattatattaggacagagatatacaaactggcttgtgtactgatccatccaatcacctacatatatatgatacatacaacacgcagctacgcacgcattagctgcctgaaattaaaggtctgaaattaaaggtcgcgagaggccaacacagtacaggaacactacacgcgtaccgaccatgtacagactttaatttacatttctctcgacttgttgtgatttaatttagccgtgtgattattaacataacacaccccctacctggatggctggatactacggagtataaagcaaagctaagctggtacgtgcatgcagtctagctaagccctgcaactttgacttttctatgaattaaccggcggcaactaggagccacgtgaggtgcgccgtgatgacgtgtctcatgcccaccttttaactctttctcctcctccgtcaaattactctaatctcccccgcacaaaaccgaaattacacacaactccttcactccgttaacctagtactcctagccattttctcacatacccccctgagaggaaaaatcgagtccagcgcaggcagactcatcacggccacgcaatttcccatcagcttttgttcccaaccaagaatcacatttttcacaaaaccccccgtactttttctgttttacacgcctaggcgaagtcggtttccgccgagtcacgccgcacgcagcaaccacatgaccgattaactcccttcttcttccatcttaacccacacccacacacaaaaataaaaaataatactaataaaccaaccaaaaaaaatcgaggaagaaattagagagagagagagagagcacacgaaattaaccggcggccaacccatccacgccccgccgcctcgatccaatcagccatggagggatccctagcccggcgccggaagctaccgccgccggcggcggaggcggaggcggaggcggacggggagagcctggtgatgtctctgtcgtcgtcgccgaagcagcagcagcggttcacggcgctggagctggcggcggcggagcagctgatccacctgagcgagagcagctcgtccccgcggtcgtcgtccttctccttcacctccgcctccgcctccgcctcgtcgccgcgctccgtgagcaacgcgccgcggcgtgggggtggcctgggcgaggcggacgacgaggacgacgagcaggaggtgggcgggaggccgcggaggaaccggaggctccgcccgatcgccgagatctacgccgccacggcgccgatcggcggcggaaggaaggccaaggccaaggccgccggcgtagagtagtagtagccggccggggagggacttgtttgtaaatataagttatttgcagggactagcttgttgagtaagtaatatttaagggcgtgattagattaattgctagcgtagcttagttgtaaattatgttactactactagaggttttgagtttaatcaatcaatcgtcctactataaatattatcatgtttgttttctttacaagaggaatgaaaaacctatatataataacttttttgttcatcatcgatcttatcctatatatgtaatttgtataggacaaataaattaatcgatcaatgatctaacacgttgatcaatgcgatcccctggacgataacatcatgcaagggtttgcatctatccattctgatgatagctagctagcttttaataatcaaaccgcacgcatataattaagcacgtactgtgtgcaaatctttgaaagactttaattcggtcggcatggagggcaaatgtgaaacagcgattgatcgatccatatttgagttcattgcttaattttgttgatccaaattaagtgatcgatggatggggtcaggctgggaaacaaaaggaaaggaaaatatataatggatgaatgcatcgatatgatcgagaccgagatctagctacacaccgcgcgatatgatctatctatcgacgcccctgggagcttcagcttcttcggtggtgtttatcgtacgtgatttttttgtgaacgtacgtgaggacgattatagagtgtactgtagctagcagctagctaattccgatgcatatataattgcatatatagatcgaaatacgtagtatgcgcgtgatctcgctgtgtcgcctggatcggcgctttaatttggctagctaattacaaggtgttaattagtactcctacatgcatacacattcatatactgtcggaatgtaattaattaataaatcatgagtatataaatatactcctatatatatatactagcttagctatatatacatgttaaatcctatagatactgtcatgtatcgtgtccagtccaatgacgacccacgcatgcatccatgcagtgaccgcacaatatataaaactgtagggagtatatatacacagaactatggaggaggagactacaaggaaggaggagatcatcattaattagttattagcgaccagaaaaactttacagcaagctaggtatctgcagaattattattattttttgactaaagtatctgcagaatttgaagccaacaacatgttgtgatcgatcgactgaggtcgggaattatctagctatcgatctctacggtgcagaggctggctgggtggggaagaattaataatacttctacgcagcaatagaaagaaaaagtccaaccacactggcgttcgatcgtattctagccacttctagatgcttctccatacttcctcgtctccaattccggccatctgctagcttgtatcgatcccaatatacgcgagcttaccaccacctttgggtgaggcggtgagctattctccccggcccataaataaactcgcgccgccacctgctccagtgtaacggagagagtacttctttgcataaaccctttttttttttggaacgtatctttgataaccatgcatggattcagctaaacagaacacagtaattaacatctgcttgagtgacctgctcaaccattcattacagccacggcaattcacagatttgggcaacacaaaatattctactccatcatgacttctccttaatatagcttttaggtttcaactaaaattaacgttcttgggtcacttcctggaagaaaaaccaagagacgcgcacgatcaaacatgacaaaattactactaccactactacataagtacaggatgcataaagcgcacgcgcacacatgaaccacaatacatgaatgaagcagccgaatttcgcatggtacaaaagaaattctcgaatccatgatacaaggtgaaggtaaaagtaagttatccaactagacacatttggagtcataaatttctcatcgacataaatttccggcagatgaagcaaagggtttttgcatgactcaaatatcatttgtgagtggcatgtataggtgtgttacggtctctcagatcaaccaactcaacattgcaatttggcagcccaaagtgccaaagaagtggccagccagtctaaaaatcatcgtcatcttcctcagccatgtgttttgccagctcctcctcctgttggagcctctcacggcgcttctccgcactttccttttccttgtgagagttcggggggaaccgcattgctttcacagcttcattgtgcatgttgaggcaaaatgcaatccgagagttgaatgcaatctgtggttcatttgtcgagtagacatcgccagtttctttcgacaccatccagccgttggcatgatctatggtggcatcaattgcgccatcccttattgccttggctacaatgctctccgcatcagcaacaggattatcagagtcgagccttagcttcttggcaatatcagcaagggagatccgtgagtatgaaatgctaatattgcgcagtccggttcgaataacattgtggcgcaatctcacaatcaaattgcgagtcctgtcagcactaaaagtgctcacaaatttgtcggcgacagccctaaacaattcaagatcaccgatcctgacagcctagagaccacaaataagtcagtctgagttttccacctatgcaacacagtatttcaggaaagtctagttacttacatttgtaagctcgaagtagggtgtcagtgcttccttcattcccttctgcatgaacacagtcctctctggaatctctccgagaagtagtctcactataatagcccatttgttgcactgaatacgaaagccacgagctgtaatgggtgccttccgagcagcttgcagaaggctttccttagcatcagtgtactccaactgaattgtcctgattttacccaagtagaacaggtatcgacagaactgcaataaaaggcacttattagcatatgcccaagagtctgtcctgtgaattcagttggctgaaggatgatctcatacttcaataatcataaagcattaactaaaatgaaggtgtcttaacaacaacatgtagaaacaaatttaagtggagtatgaaacttcgcatgagcaacatccaaaacacaataaattcacaagctgtagagtaataaatggtgcaagcagatatatacttgttgattggagtgggcttcaaaacgaggagcttttgacctaagtttctctgcttgatcatacaaattataatggaggtaattgcgaagaagcaggttgagcaaagtttcctgcaatcaagaaaacaggtatatttacacagattacaagaattagatgacttaaaggttaataaatcaatgaggatatagaaaccaaaactacctggccaagttcatcgcggtgaagagttgccattctgtgtaaggctagcagattcctgaaaagagagtaaatgcaggaaaagtcgataaacatggtagtaagacactgaatagtgagcaactaagcattaaataagaccttgacgtacccacggatttcagcaaggctgttggtgagttcatgcacatatgagtaatagaagtacagtctagatgccagaacatcaacagttctcctgttcaagtttttcagacgagcaatgcttgcatttgcacatgctttagcctagagacaggtgagaactttaaattagaatgtctcactgagagcagaagataaaatcagtagtcttagacgtacatcgtcgtatttcttctggtcaataagaaaaatcaggacaagcaaatagcaatatatttcaatctcagggaggccatgcttgatcgaaatctgagttgctggagctgccatgtcaatgtccatctcagtgtcatcttcctaaaaagcaacaaataaggacatcagacaccgtgcatatgataacagtatgttttaccttactctccttattatatcattgtatacacaatgaaacaacaaagttaggcttccaggtcctgagccctaaattacaaaacaagtagcaaaaacagaaactacgccgaccatagtgcaacagcatattatgttcttcatataacagagtcatcacaaatgaaaaaaaaaaaaacaagtagagtgcagtatctcatactggtaatcaatttcttgggtatcatagagatactgctaaataaggcttaacgttacagctctagacttctaggaatagctttctaatatgttctaaaaatagatttcagcataaacatgcagaaataacataacgataatgaacaacgttgcaaatatacgatacatgaaaatatgatctttttgaaagtcgaagtgcgcagtgaaggagctcacttaacctctatttgcaagtgcttcctatcaagagatgaaagaaaatgacccatgctatatgttcagcgatttaggttgctaatcatggaatgacagacacaggcgatccaaaacagccatgagaaagtcaaacaccacagtgataaatcaaataacaagcatctatgaattacatcagtagtaccaatggaataattccagttttgataacaacaaaaataagaccacacccacccaaaattcctgtttaccagttaatttaaaattttaaccatatgattagcttatttaaagaaagaattccaaaataactacagagcggttgataatgcagtgatgataaatcaaatatccacagttagcatcacaggtaccaaggtttggaaattccagttttgccatagaaaacccagatccacacagaattactgatcactatgttaaattaaaccaactcaatgcaaatatctcagtgctggaaattttgtcagaggtacctacttaccaacgggaaactttccagaatcacacacatcatgcaagcatgtctagtaagtttatccatgccaacaactatatctaaacactgatagtttagttgcatcacatggaatattaagttgctcttacgctgagttatactagtaacagaagaagaacgcatgagaagtaattcaccttggggacgagggaggtgaggcgggtgtaggcctcggaggaaggcgggagcgcgaaggcgaggaaggcggagacgtcgcgggcggcgaggcggcggcggagggcgacggtgaggcggacggcgcgggagatccggcgcacctccttggacagcgagccggcctcgatcaccgaggcgatctccttcagatctgggacgaacagcgcgcaaccacatcagaaacaaatctgaggaattccacccgagggtttctgggggatgggggaggaccgcttacggtggagggcggaggccgccggcgccgcgggaggcgccgcctgcggctcggagtcgctcatctgcacgtccgtcatcgcggcggcggcgctggttggttcgtgacttctgcctcaagaaggtcgctccccttcccttccgagcttgggctacctctcctctgcttttcgttgtgtttcctgtattttctttgttttatattttgctgggctgagctgggccgtctgtgtgagggccgtgttggttttaaactgggcttgttcatcctagacggcttaggattcaggcccatcgcttcctccatacagcatcgctcgttgccaaaatttaaaatcttttatttaaagtttatttttcagtattggcatctaaatcactaagaacgtataaataaaaatcttacctataaatattattattttgctattatccgtacttggctaaacgataggggcctcagtttgctctcctacctcttcatgcaagtgtcattttgtcttatttcatcaaaatccaatggaaaaaaaaatggtcttatagcacggaaatatctttacttattttagttttatttatatagtagcaccaaaagccaattctgtcaaaaaaaattttccgtgagtaagtcactggagaacgaatgttgcttgcgttacatcatacacatccattgcccaagttccattgccattgacaaacagaatctgagaccaaactgccaaaacacagaaccacaatatcaacgcaactgcatttctttttacccactccgtttaatattataattcgttttaacttttttaaagtcaatttttaaatgtttgaccattatttttaaaaaaacagtaacacttataacattatttgttttatgttgaaaatattgttatgtttttctataaacttgatttagaaaaaaattgtatgaaatggagatactagtatataatatcatgctttattcatgatatttatctattctacacgcgcacgaatctccaatcaaatccaaacaaacaacaaggtgcacatacactgcataattgcatcgtggattgacattctcggatacacaaaaccacgacatatcaacacatctgcattttcttattgcaatccatgctacgcgcacgaatctcaaaccaaatccgacaacaggatgtacatgtacttgcattgtgcaggtacattacaaattcttacgccatggatggatgatgaagctcgctgtcgcttaactagatggggtcgtcgacggcgagcttggccgtgccaccccagtgctggatcctggcgtgcgcctcgctggcctccttgttccagttggtgcgcgccgtgatcgccaccaggatcgccgtctgcagcccgacgccagtgagcatcccgccccacatcccctgcacgccgcggcggagcgggaacgcgatggcgtagccgacggggatgccgacgcagtagtagcagcccaggttgatgtacgccaccagccactgccacccggcgccgacggccacgccggagagcaccggctggacgctgttgaggaggagcgagaaggcgaacaccacgcccaggctcgccaccgcgcgcaccacctccgggctgcccgtgaacggcgcgccgtacacgtcgcggagcagcagcaccgccgcgaagaaggcgacgccgatggcgaccgaggacacgagcaccaccgcgatcgcgagcctcgccgcccgcggccgccccgcgcccagctcgttcgacaccctcacgctgatcgccgcgttgaacccgaagaacaccatgatctgccacccaaacaggttcgtgctgcaaaatgcaaacagatcgagatcgacatcagctacgatccgagcataaaacagtgaagacgatgagtgattactgattagtgtgggtttttgtccctaaggggttattctctcattttgtgcatgccgttcaaaaaattatcaaaaaattatttaaaaattatcaagatagatcaatatatgatatatctttcacaaacatgcgagttaaaattcgacttatacaattcgaaacaaaaataataaatttaactgtgaattacacgttcactttatagtcaaatttgttatttttgtttctacttgtataaattgaatttgaatttgcatatttgtgaattgatatatcacatgttgatatatcctactatttttttcaatttttttatgactttttagtgacacaaaaataaagagatatccctctaagggatgatttgagttttcactaaccagatggagacggcggcgacggcgacctgggcattggggaggttaccgacaatgacgatgaggaacatgtagaaccagaactcgaggcagatcatgatggcggagccgagggagaggcgggcgaagctgaggaggtcggtgaacgcgagccagtcgaacccgttccaagctccagggcagtagcccatgacgatgtaggcgagctggccgagcacgacgagccaccacgacacgttgagcgcgacggcgaggccgacgaggcccatccggagcggcacgaggagaagccacgtgagcgcgacgtggaacagcagcaccgccgcggagacggccgccatggccatgaccttgctctgggcctggaggaacttctggatggggaagttgagggcgtaggcgaagagctgggggatcatgtagagggagaagcggctggcgaggacggcgatctcgtcgtcctggtggaagaagcggaggatcggggtggcgaagaggtagatggggaggaggatgacgctcatggcggtgaggatcacccatgagcgctgcaagtagatgcccagcatgtgatgctgcttcgcgccaaaagcttgcccgcatagcgtctccagcgcgctccccatcccgtactgcaccgcacacattcatacacacacaacacatttttaggagtaagctaaaacaaacagatagattattatgatagattattacaatttataaaccatattactatagtctgataatccattcgaaaggtgcttttttagattatttggtggctaacaactaacaaacagctaacaatttagagaaataaacatctaacaacttattctatatcggcttattataatccgacttataataatctggctcttagagaacgggtaacacgtgttgcgggaatcttcaagtggaggtcagaaattcaagcaagatttcccaaaaaaaatcttctaacatacttttgaaattttagttaaaactaatttaaatatgtccaaaattaaagttacatagccttccattcgttcttaagttgaattcgatcctcctaatctgggtagtaggcacatgatttataaataaaaaagacatactactagaagggtcaaaagtgatacataaacatatataaatcatgtgcgagtgtgtgcatatggtgttgtgtgtacagtagtgtgtgcatacgcgtccatgtaataaaaaaatgttgcgcaggtgatggagaaaacaaggaattaataaaaaagacatgtgcacttaactctctactgcaactatcgctgtgttcgtattaggggtgaaaacagtacggaattttccggattccggtcatgttttcggaaaccgaatcggccagtcggaattttttcggaatttctcggaatcggaatcgaaaacggaaatattttctcggaaacggaatcgaatatgataatagcagtttccgtcggaacccggaaacgatcggaaacattccagaaaaattgtcggaatttccgaagttaaaaagcccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcgtccagatcgcggcatcgcggcgccagcgtgccctcacgcccaccgcccgtggcgccggccccccaccgccctatgctggtcgcctggccggctggcccccgccgtcctcgcccccaccatctcgcgccgcccttgctcttcgtcgtttcgccgccggccgccgccaccatctcgcacggcgccggcgcgccctcgcgcctaccgctggtcgcctggctggctggcccccgccgtcctcgcgccgcccttgctcttcgttgtttcgccgccggccgccgccaccatctcgcacctccgccggcctgctcggtccccgccatctcaaggcgccgtcccaccgcgtctcgccgtttcaccatcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgaactattgctgttctgtgatgattgatgaactaagtgttgatggactgatgttctgttgttgttctcaaacccatttcctggagtgataggctgatagcagtatagcacctgaattgtgtataccttatagacttataccattctgttttgctgtattcttttagaatatttgttatgcaaattatatgaagttatagaagaatatatttttgctgttgagactaaacaattagacttgatataattgtgttttatgatgaattgttgactgttgagacttgcgaattggacttgacaaaagtttgaagctcagtttgaggggttattgtattccgataaatttttgttaccgtatccgcgctggttcgttttcgctccgttttcggtttcgatactattcgtttccgtttttgtttccgattccgattccgaaaaaaatatgaaaacgaaaacgataaagtttgtttccgtccgtttccgtaccgttttcacccctaagttcgtatgttgaagtttgggatccaatctctcgcgcacataaatggagtgattcattagcgtgtaattaattaaatatatgctatttttttaaatgggttaatatgattttttaaaaataactttcgtataaaaaatatttgcagtgattgttaatttggatgaagaaaattaaaatttgtcttaagaaaacaagttttaactaattacaaggaagttagactaagatttaataaaactttggatccaaataactgacataagcgcaaaaatgtacaactcaatcctgtgattaagataaagtttagacataatgaagaaaaaattgggaagctaatcaagcaaaattaactactgtacttccaaggtctctcgaaaagtgtactgtagtcaagttgatagttaaaaagacagtaaatttttacacaaattaaaaaaaggacagtacttttgagatggagatagtaatacacacgatcgatcggtgaacgagggtaattatattatactcccctcacttcgctctatctaaaaaattaatcaatattaaatttggtacatcttagtactataaatttaatatatatatatatatatatataaaagtattagaatgtatcatatttaatatttttttttgacggaggtggtaggtaagtaggaatagatgaatggaagtaactggagtaactattaaggaagtagccagccagctactccctactccctccgttttaaaatataaggcataaccgctcttaacccaaagaccaagaaataattattattatctcctagtttgaatcactctaataaatataatgcatgtatccaatagaattagagatattgaggatggagaatttaaaaaaataatagtttaatggagaagaggttctaattaattgtatgcatgcatgcataccttatattatgtaacatataaaaaatatagttgtgtcttatattatgaaacggagggagtactagctagtgagtgactaaccatgatcccgaaggcgaggccggcgatgaccatgttctcggtggagacggcgtcgagctcgagcgtggtgaggtgtccggcgaacacctgcgtgacggcgccgagcgagtactgcgccagcgacgtgaagatggccggaccggccaggtaccacagccgccggttctcctccgccgccagccgcatcagctcccccacgctccggatctcctccaggtcatcctgcttcttcacagcaatccccttaatctccctcgactccggcgacgacccgccgtcacccagcagcagcgcctccctcaactccggcgacccgccgcctccattgttgctgtgatcccatgcagatccactcgtactgctcattctctctctctctctcacgctgatctcgatctctctctgaatcgaccgatggagaggtttgacgcgacgatcgatatgagttggctcctactatatagcaactgggtctagaagacactggtgcaataactctcaaacttaatacatacaatggaccattgcatcttgcccgattcatttttcataattattttttttaaataatgcaaattaatctacatttctttttcattagaagatcgatgtatatgaccacttcatacacatactagttatattgcacacgtgtaaggcaaagttattagttatgactaatatgaattaatatattattttggatagagattcattagctaggaggattgctgaactgtgaccaatatggatttatatttgtcttctctttaccctttgttagctacgtactccactttcttttgttattggtcatgatgagcgacaattttgtaacgagtagttgtagcttttgttgaagccaatgtcagattttatccattaattatctaaaaataacttaataagaaaaaaaaacatgtttatcacctcacgatttggtggttaccgtgaaaaatatgcgattattatgaggtataccataattttaaaaccgagaaggttatcgtaaatataactacgtgataattatatggttctataaactctggtcgcatcacaatagtgtgatcgttaatagtgcgtatctagcacacggtcaatatataagtgggttgccacttgccagttgccacggtcgtcgcgatctcttatcaatattgcgttgatcgatttaatttgtgaataattcgatcgaggagtaatcgttaattatatagttgcgactgtcattgtcagatatcacgtttgctatgtacgtactgttcgattaccaaacgagagtattatatacaacacgtcaagtacaacttcacctacttgaaattaaaaccagctggagcgctgttgatgactgaatttaaaatcgaattttgaaaagaacaatatcggcgcaggctgattaattaattagagaagtagctagatatagcaaggactgtcagtatttattgtttaatcacgacatggttctcgtgtggcagctactacgacactaccacaaaaatttgacgacgaacgacgacggcgacgtgaccacctcggtggaccgatgcacgcagcagctggtacgtacatttggtgatttggagatcctctaatgtttacaaaaccaccgagaccgtctgtaaaaatcaatgggagtagcttgttcttttaggggatttttagatggtatttatacggataaaaagttattggtttttacttggttttccttaaacttgtgaggagcgttttcacttataagatatatggggaaatcttcacctttggaggtttagggcttgttcagattgatgtcatttcaaaccataccatttttttttgttagagttgtcaaatatatacatccatttagtttaattacatcagaatatccgaaatcctatcaaaattttgacaatattaccaaattgccaagcccttaatgtctttatttccatgcatatgtttcatgtgaggaagagataacagtatcacaattaatcctaattttattgaaattaaatctgatgtttacccggattatattaaaaacgaaatgataatattagattactatatttaaaacaaaaggagccaggagtcattagacaacgttaacagtgaagagaagggacagactggcggaaggttggatgagtgatgactgatgagtgtcagcgtcacatcacgtgcttcatgcagcattgactgtgcgtccccaagccaaacagtagcagcagtcgatcatgactgcgttctcacacgatcaaccgaccgaccaaccaaccaactgcgacatgcaaatgacatttctcttgaaagttattttagtacagcttgtggttagaagcattccatcatggtggtgatatcaatcaagagctatagctgctagctgatcatctatcactacagccgatctctcccagtttttttttttcttttggagtcggatggattttaatctctgctcttgtgagcaagaaattaagctaaaagaaatctcagcccatgtacataaatgggatggaattgaggcccatcaattagcccaaccaagtcaattaagccagaaagaagaagcccccagagaagcctgcggatcatatggtacacggcccaccacccggcgatgtgagtgggcctaacgctgaaatcaattgatgggctttcaactatggccctttatgtaggtgacctcataggaatcaggaaaccggtatcctcttgaggaggagggctttcgaacttaaaccgttcgccgtttgggttgagcacatatcacctctgtagctctagttggtaggattgtagttagtgcttctcagattcaataatgaactcaacaacaaacctttgaattatgctatttttatagaggcagacgaaagcgatcactagtttgtgaagcagtgtgcgcattaaaatagacttacagatgttattattgtgacaacgccgcagctccctatcgatattcttttttttctattgttagatttcattaggaagtatattttcctagttcagttaagcttttcttttgaaaaaaagtggttcaatactttcagctactaagattattcttctaaactctgtcttcttacaataagtactctagtaaattgagattttgtgattgagacttgtctttaaaaaagtactccagcgagcaaaccacaacacatatctcgcagaagaactcttaaaaatcctttgagttcaatgaagttcacaccaaaatctgtaactcaacaataaacctttgaactacgatatttccatgtaggcagtgtacatcaaaataggctcatggacgcggtcgtcgtgttttaagtatagagattaccctgtctatatgcctcttttctgctgttaggtttatttccttaggcatcgttcgtttaggggtgataggggagattggctctcgttttccgcgcgcacgcttttcaaactactaaacggtgcgttttttgcaaaaaatttcaataggaaagttgctttaaaaaatcatattaatccatttttggaatttaaaatagttaatactcaattaattatgagctaatggctcacctcgttttgcgtatcttcccaatctcctcaatccccttctcctcaaacactcccttagttcccttagcctttcatttggaaaaggatggttcagtgcttccagttactctgtttagcattgcactaaggattattattcttctgaactgtcttcaatgatcgattatgacttgtcttaaaacaaatagcaaaccacaatatgcatcttgcataagaacaagcgtgtgtttagattggtgtcattttaactatatcattgttttggtaaagttgacaaatatatggttgcatttaattttaccaaatatttgtaaagaaaattttggcacaacatatttgttccatcctatcaaaaattggcaattctataaatttataaaaaattcagcattgccaaattttggaggttgattttggtagtaatctgaataggcccaaaattagtgatgaaattaataactaagatagagacaaaatctggatctctctattatgttaatcacaaggtctccatgtacaagtatataaatctacaatacatacaagtgtgtgtgtatatactagtataatgcaagtatccgctacacatatgtactacgccaaaacgaatcaaggtatcaaaagaaggtgaggtagtaggtacacacacgcacgtcagtcgtgatcctcacgccgtcgccggcggcgtgccgtgcactgcacgcccttctcactaatcttctagcttaagcctaattaaccacgaacgagccaaccagatgcgagctcgcgccagctcagccgacgacgacgtcgtcgacggcgacggcggcggcgaccaccgtgcgccggcacagggggcacgacgcgtgcctgagcagccagctgtcgatgcagcggaggtggaacgtgtggccgcactccggcagcctccgcgcccgctcgccgtcctccaagtcctggaggcacacggagcagccggcgcggtcgtcgccgccggcggcggcggcgaacgtggtgaccgggagcgcggcgatggcgtccgccggcatgcccgtggcggcggcggcgacgccggggatgccggtgtcgaacatctccgccagcgtcggcgcgctctccctgaagggcgcgtcggcggcgttcatctggctgtccaccgcgttctgcaccgccggatccaccttctcccgcaccagccgccccgtcaggaggctccagatcacgtcaagctgaacacacaaacacaaccaaacttaattagctcccaaatttggtagagcaagcaagcaaaaagcttaattagcttgcaaattggtactatcaattagtagaacaaggaaagcttaatcatatctttttttagtacagcaaataaacttaattggattgctaattggtacgataagttggattagtaataagaatgaatgcaaattcatcgtctcagctgcgagatggaactgtaattgcagtaggggatgcagattttggcaggagattagtaaacgtacgacgtagagaacgctccagatcccggagtcgtgggagcaccacatggcgacggaggagtcgacgacctccatggcgaccaccgcgccggagatggccccgatcccggtgccccgcaccatgccgctctccgtcgccagcccgatcagcccgccggtgatcgcccccaggatcgtgcccactgtcaaccaatcgatcaattactcaagttaattacttccatgaaacagatcgagctcgaattaatcgaggcaaacaaaaagaagcaagaaaccaccaccacctacctgtggcgaagacgaaggtgacgatgccgcgagctacggcgccggcgacgcgagccggcaggcgggacatgctcctgctgctgctgctgctgccggcgtcgtcgcggccgccggcgaccaccggaggggagtaggacgagaagctggcgtgcactgctacggcctccatggatattgttggtttgtgctggatttggataaggggaaatatcactgatcgatcgatcgagcttgctctagcagagtgcagagaagaggaggatctagctagctagctttgtggatgttgggtacgtctctaaaaaaaatcttgttagcatataaatatgcttgcttggtgaatggtgattagtagtacacgacacatatgaattaatgaatcaagcgcgtgtataattcacaaggattagccgagggaaagggtacgcatgagatgatatgatatgaagcatatgcacttggcttgccagctcagccatgcaccgcttgcctgacaggctgccacgcaagcttaaagccttaaacactgatcttactacttttcttaaaaatgttaagaatttttttaatgaaaaaaccgtacgggcacttctttttccttgcatattagtatcacagactgacagacagtctccccaatattctaaacagtacggtttctacaaaagttctctgcataaatttgttagaatggttttttttaaaaaaataaataactttcaacttcgtaacagttaattcattcgtttacactctcaaatatactatcataaaatcagataatctatcatctcttcagcatttagggctcctttgatttgtaggaaaaatataggatttttggaggatttcaatcctatagaaaaaaaaatcctatgaaggcctttgaaacaaaggattgaatcatatccaatcctttaaaattcgttcctttaaaattcgtatggaatgggtaatcctatgcacattttggaggaaagttagcaagaggtctaacctcttggaacatttcctctgagtctatctctttcatctgattcctgcttttttcctgtggtccaatcaaaacggccattcctgtatttttcctgtgttttgcaattctctgttttacaattgtattcctatcagaatcctgtatttttcttatttctctgtttttttttcattcctacgattcaaatgggcccttaacccgtaagccaaaaggcactttgaagggcctactttcttcaccttaaaataaacgaatctaatacgggatgtgctcttgtccagatacttaatatatcacgccatgtactacgtttgcttaatggagagggagtactaacacagtccctctatcggggtggcgcaccaggtggttggaggaacgagtccatccacagccaccggcacccccgtgagcttaaagccataaggtcagacgtgccgctgcagaaacgggtgaccacgcgggagcgttgatggcaacgcgcggccagagtggttggggctagctacgtacgcctccagcatttctcctctcctttctctcttccttaattctttccttgcctcgctctctctcttaacggctaagcttcttctacatccctcttcttcctgtgtctctgtctgatgctctcagctacacacaagcacaagtgcagaaatagagagagagagagcagctcatgacatgagggccgagtttagttccaaactattcctttaaacttccaacttttccattacatcaaaactttactacacacacaaactttcaacttttccatcacatcgttccaatttcaaccaaacttccaattttagcgtaaactaaacacacccgaggcaagtgaaagcgaagtcagaaacttctcctatgctgcctgctgggaatctgtaatttgttttttgttttattattatactatgtttaatacttcaaatgtgtgtccgtatatccgatgcgacaaacaaacatagaaattttccccagctaaacaagaccaaacacaagtgcagaaatggagagagagcccctcatgacatgaggcgagtgaaagcgaattcagaaacttctcctatgatgcccgggcgacgggtgcagcgggacgtgtagggaggagtcaatttctgctagctgcagcgagcaattgtttcaacggaacattgattaggcgattaccaccaacaggggaggtgtgccacaggtttttctacggcgattgcgagctgcgtctcgatcgcaatttgtctgaccttttctttcttcagcatgagcaacatatgcaggtgaaggattcacggtgaaggcatctctactctaatatatggtgtcaatgttccacgcaagacctgaatgggcaaatggttttcgggtggttgggtgaatgacaccatgacagagacgtgtgcaagggagaaacacaatggtatggaactgtggatgccttgtatcggcaaaaacagaagttggcttcaacaggattgacaatgccgccgggcgccggttaatgctaaccgcgtgataatcccaccaaatttaaacaattttaaacagttttgaatttcttgattatttctttttccggtttttcatagcttgtgacagtcaccgtggttattgcgcttaccgtcgggataccataagctagctcggctgtaaggaagagttgtttaatctttcaagaaggaaaggaaggggggagcttacatagcttttgctacagacaggatggaattttcccaaccttttttctcagaaagaacataaattttccgattttatatgaataacatattgttctatatcttcagtaaagctgagctaaaatcttgacatgagagtcgcacattttctcttgccatcaaatttacaccattggacaacgattgcaacagataaacaacactggcagaaaataatactgccaactatgttgctcttttgatgtgaggccgtctatcgacggctgactcaattcaccgattgtttctccaaccgctgccgtaatctaagttattctctcctcccaatcttagctatagcaaggtgtcaaactagataaatactcagtttaacatatatcaagttgatatgcaaattatcaagttgtcccaaggtttatctagtttggtaccttgctatagctgggattaggaggaaaatttttgtgcattggttggtgagggagacgttttataaaatgtaacgaggagatccgggacgcacattttagatccaatggttcacaatatagtcctcagaaagagtcaatactcaataccatgtggaatcagtcaataggctacatgagttgaattcagaaaacatggagcctataaactgtgcatataatttgcaaccattcacaaatgaaaataatttacttcatttctaaacactagaacattacttaatgttataaattttgagaattatacagtataacgcagacactcaactcacgcacactcactcctatgagcattttcgaagactcgaccggccaatctatcctggagattgacgaagtcaccacaggatccatcctggagattgaaatcaccacatgcgcctcgctatcaacgggtacgtcgcttaccactgaaagcacaaagctgttaaatcctgaaaaaatcgcttccatggaaagtcaaacctagaacctaaggtgctacttaggctcgtgtaaccactaagccacatgccatttcgccataatgttgtaaatttggtccaaatgcccgtaccatgctagtccttccggtgacacttaatttactaaaaatgtgttccacacccaatactttatctcgatttaacctagtactacctctgtcccaaaataagcgcagttttgaccgttcgtcttatttgaaaattttttatgattactatttttattgttattagatgataaaacatgaatagtactttatgtgtgactaattttttttaaaattttcataaatttttcaaataagacggacggtcaaacgttggacacggatttcaacgactgcacttattttgggacggaggtagtacaatgcagcgtgctatatgaacttttgtgatgagtatttatatgctgctctagataaagaacccctaaaaacataacagtgctccgtacaaaatggttaacggcctactactaatatggagatcctattataaaggtttcagcatgggtaggcctggtaggctggtacaagcctgggaagccgtggtacaaaggcatgtacgtttatcatgtttgtctgctactagtaccatgccaggcatctactgctaccttgtagtacaaccatcgtttatcctgtttgtctgctattatgccaaaatatttttagcttttcctatttgttctaaaatatatttatttttagaataatcattatatcaaagtttgtgaaagtaggaaataattgtatttggaatagataaattgattaataattgcattaggatttaataaagtagagtcgttgtagttttcttagttttgtattggtatgtgtgggacaggaaaaaataaacttattttgggatgagatagtattatgcaaggcttctgctgctagcttggtacataaaagcatttataggttgtttaaaaaaaggtcagccacaagaggaaattaaaaccccttaaagtactttaattaagaagaagcactcgaaaccggggcaagagaaaagtcacaaatccccccccccccaccaacaacaatattcctcgttaaatgtgagatggttggaagtggaaagatagttaaatgtaagatgagaagaaacttgaatgtaattttttatatttatggacaaattttaaacccttgtaacgtttatatttatggatagagggagtatactttgggtgtgtttagttcacgccaaaattagaagtttgattgaaattggaacgatatgatgaaaaagttaaaagtttatgtgtatacgaaagttttgatgtgatggaaaaattgaaagtttgaagaaaaaattgggaactaaatcaggcctctattggcctctattggaaggtttcaaacctaccactagcaggtatgggtaacctggtagcctggtacaaaggcaccctcggtgcccatcatcatcccatttgtctgctgctgctagaggcttgtgctggactgctgctagtctctgattttatacttgccttctgtgacaaaacatgtgaatttacgcaccagagcaccttgcatctcctttggttaaaggggcaacggatgaataaagcgatgttagctaataggggagtacatctgatacgatctatcctcccgttcagttggcagcataataatgtttgtacctaggtagtgtccaagaagtagctttttattattttacctttgctctttaaaatcacaacgtgctggaaatagatatcgcagcaagggttggaataactaaagaacatcatcactgttcaaatctccatattttatttgctttaccttttgcttttttccctcccctttgttctctttaccttttccttttctttaattccattttatttcttactacatcatgtcacggtgtcacaacttttttctaggttctcactttaagcatcttctctttgcttctcgttggaggcagataagcttcttatattaaaaaattgtagggtggagttaccatacttacttgcatgccatatcattcaactcttcaaccagcaaacctgagctcttgctgtcatggcagggctagcaccggagcaggtgctccagttgtgaagttataccatgagaaatccatgatcatgcctgatgtgtccagagtgcttgcatgcctgtatgagaaaaacatcgagtttgagactgtcaaggattcttacaaggacatcctcaggctccaggtactttgctgccacatttatgtgttactttccgttttcggcaacacccagaatgtacaacaatagaagcagtttcttgggtttatatatttatatctcatttcgagtttttattttgttctgtgactgtaggcatcgaggagtgttccagttccattctacgatggacccacatttctacaaggtaacaatgtttgttgcacaatctagcctgtcttaatttggcaaggtgtgtgatgtatccatggtttaggtaagcttgcatggctaaaggaacatagctttttttttggttaatcacaaatcctagaatgagatgcttgttacctgtatcagcatgcgtgccttgtagatgagacatttttgaaccgaatcaaataagttgaattcaatttatgtcttgtgcatccaccctgcaaatgattggtgcaggaattttaaacctgtagatgaaatgaaattgacatgtcaatcaatagccatgtgatctcagaagattgacattattcattatttcaggatgaaaataattaatataacagtagacttaaaatgaaacaaagaaagaatgattctcagcattctggttttcagaaacttaggtgctacaccatatcatgtcccctttcatttcaaaattccatttaaagtggaaatagttggcagaccctgttcatcaaaatgtagtgccattgtgcaaccactgtgtaccatgtcgtgcattcatcattagcggcaatttgtttcatgattacggtttgaacatgaaatgaaatgctgaatgtatgtctaaaaactggttcgaaaataaaaacctcatgaagcactcaagtggaaagagaggtacatttcacattctagcaagtatatcatggttgtactagcaggattcatggtgccaaaataaacaaatgcttcttagcatgtattaatcatgtgaattggcaactgaaatcacactatctaaaactatctcaattttctcaactgaggttatgtaggacatacactgtccacagaaaccagaaatatagtaatggtgcatcttcagtcttcaatcagaatatggtactgacccttcttacctgcagaatcaagagcaatttgccgctacatagcagaaacctatgaacagcgtgggtatcctttcctgctgggaaaggatgttctggagagggcttccattgaacaatggctccgtcatgaggagcatgcgtttgatcctccgagccgggcattgttttgccacctggcctttcctgtgcaggatgacgacgatgatgatatcaacacagagaaaagaaaactggaagaagtccttgaagtctatgaacaaaggcttggtgagagtgagttccttgctgggaacaagttcacccttgctgaccttgttcacttgccaaacacccaccaccttgtgacatctgaatttgcctacctgtatgactcaaggaagaatgtgcagaggtggtgggatacaatctccaaccgccaatcttggaagcaggtgctgaaggatatgaacagagtggaggaggaataccaaatggaactagagcagcaggaggagcagtggcagacagagcttccccaaacatctgttggccacaccattcgcttagaccctcggcagacgactagcactgagtcacggacagtactagtcccacctcccagtgctggtatgatctcaacctcattttcatcacaaagagagcaacctctgccctctgaaacaatccgccaagataaaccctcacctagaaaagaaagcaacttctttactaccacagagaaaactccatcaaccccaaggtctagagctcctacaactcagaaacagcctagcagtaccttcttcaccccatctaccacccccaaaattcctcagagaacagatactgatatatccagctccaaagatgccccataccaaaccaaacctagtgaaacaacatcgaaagaagctcatgataaatcccatctctctggcttttttaaggctaggagccataccgatgaaacagcaactcctacaaaacatagtccacaagaagactcgaaaacttctaccaagatacccaaaacacgtgatatcagtgaggcagtcggtcctaatagtccaatatcaaccaaagctccccatgaaattgatgaacgtgccagtgttgatccccgctttgacaagccagctccatataccaagcctaccacaaacataccacaaacttcttctggaaggccttctgcacagagagatctaggcacttctcctggcactgaggcagacaaaacatcttctgatctgggaggtggtgttcagtctccttatgcacagggacgtgctgagcaagtgaagaaaacctcatctgatcagagaggttctgaaactgcacaaccagctcaaccccgtggcatccagcaattcaccaaggatgctagacaggctgatcaaaacaggatagctgcatcaccacgtcaacaaccatcaggtgagcaaaatgtccataagcaatttatagcaccaccaattctgaaaatacctgacttgtcaacaatgcaaccagagtctcaagaagacactcataacatcatgagtgaagatgaaagattctctaccaagaggctccggaagatgatggaggaaagtgaaaaggaagcacaagaagttaaatcacagcctacagattttcgaccttcaaaggaggaaacaccatctatctataagaatccctcagatgtgcaagacagaaccattttggatgatagaaaaagtggtagatctccgtcagctggcacacgagctcctgactatccaacaagtgctgctgaaagaagagttgcttcacaaccaaaagaaggaatgccatatgatgatcgtggtgccactaaaccacaaaaatcaccatccatcaatgagcaagaaaaaattccagtagtgccaagccaagcgccaccagccagttcagggaaagcttccgaatcattaaaggaagtttcccctgatgatggcttggctcaagtatccaccatcaatcaatggagacaaacctctgcacctcctccaaccaaactagcagctcctgatgctcctagaaatgttgggttggccaaaacagaaggtgttgacaagaggacacagccaagcacaacaaaggaaaccccaaggaatgatagaaatgttttagcaacagggcaaggagctgatcgtggagttggtaatgaacaatatgacaagaattccatcgatgaaagagcaccacaaatgacaccaaggcaagcagcaccttctgtcactcagcgtgcttcagcatcaatccaagaaagaattagtggtgcccgtggcgctagtgatgatatgtttggaaaaacatcaagtgctgatcaaagcaacactccagccataccaaagcaaacaacagttcaaggagcaacccctgatgttcgtggtactagttatgctgacagagagatgaaacttcctgctgatgaaaaggcaacagcaaacaagcagaagccagtttcaagttcccaacagacaattgaaccaattagaggaggaactcctacctcatatggcagtactgatgatgacttggccaagacatcaagagctaatgaaagacaaacgccaccttcaaaggcgcaagcaccagcatccaacagacagagtgcttctacagctctccaaggaggcacacctgatgctcgtggggaaaatacagcagtcaaaccatcagtcacttctccaacaggtatgcctacttcatcaagaagacaagaaccaactccatcagtcacttctccaacaggcgtgcctacttcaccaagaagacaagaaccaactcctgacactcaacgtcgtcgcgcagcaggtaaagtaacccccactaaaagaaaatttgctcaattcaatcaagtagagttccatgtatatgcatgctcagcagcaggtcaaggaatacggtggaacgactaaacatcaccacaaaacaggcagcaataccttctgcaaaaagatagtagtttccaaatttctagatgagtttgaaaatcccaaaatcttatagcaaaatgctgcatttatattggcactccagcattttcaacactgaaaaaatcatttctcatatttgcattttgttggaatgcttagctcaatgtcgatttggatatttggttcatcctctaaatttagtcacaatgtgctattgcctattaggattatgagtccctgtcctaaggaaagaaaatcctatatattcttttgaactgtatgtttaatgtgtgggttgatcatggcttattgatttgatgacataacacagatcaaatgccatcccaagctccacttccgtcttccttcagtacaaggaacaaggagaatggtatttctgaagctggtcaaaccaacacagtagcacctgatgggctgccaggtccgggagttcccaaagatgctggaccacaggttgcaggaccttcagtcgtgaaatcacagaagaacatgaatgaagcatacaacgatggaccatccacacagcagttgccaaatgatcagtataggtctcagccaagagaagccaaggaagagcaaggagctgatgcagcactaatcaatgaaattggcaaggcccaaaaggatgatttgttggcaaatccaaatcaaagtagcactggaagagttcaaccaacatcaactgaagaaacatccaagcagcaactgcaatccgggctgaacaagcctatatcatctaaagatggcaaagaaacagtaagctatggcagctcagcaacgtccagagaaatgctaccttctattcctgataagagcatgagagtgcagcaaccgcaaggtgacaagtccagctactccagtatatcacaagaagacaatgtgaagcaagggtctcaagctgcactgcagggatctggaaatgagcagcctaagaaaagggacctccttgcaaatgctgatgagaaaatcagaggaactacaggagaagccttacaaaagtctgatgaagggcggatctcctctaatactgagcaaatgaaaagcaacagaaataacagcaaaccagatggctcaactgaacccacttcatttgatggcaatgaaggtaatcttcctgagtcacagaggcgtggctcatcaagcaacccgtaaaatgcttcatcagctcattttctttcaccatctctgccgtactgctatctacttccctattttcacataataaggtcacctatacaccagcggaccagccataccagtccatgttgtctactctgcatgtttattattccttcccagtggtgcagtattgttcattacttgaacaatgacttgttcagatgtcaaagttcttaatttaatcttgttttgaataatgtgaatgcaatatagcattctccatatgaaccctatctctttgtaagttatccatgcgcattcaccttaattatctattatatggtattaattgttctggaatcacatccatgcattaccaatgtgtcattaacccattaccagttaggatatctcttaaccaaaaaaaacttggaaagattgcctccattccctagtaagtggcaagctacatagatgctcagccagaggtaaatatttaaatcaaacagaaaggtagggggaaatgaattcttcattgtatatatcgtcacatcacagatgcacacatgttagagtagcttaatttagtacttatgtcatagttaaagcttaagtgtggatattttgccaccttcctaacaacattaatttaactatctggaatacattgcagcatcctaggccttgctcgtggaaatatgattaactcctcaacagattgaccttagactgctaatataacaactgtacaataagctcaacaaacagcatagtggccactgttatgggcacaactcagcccatctcatgcattcagttagtttgttaggctttgttagatagggttgttaggagcctgctctatataaggagaggcatggcagtaaattggaatcaatcaagaaagaaagttaaacctatctctggtctcccccttctctgtttgtctcaccaggctccagggcggcgaggctgcaggcctcaccctcctgtccaagcaccagcgtatccacacccacaacagaccccaaattggatgttgtaggaatagtgttactcccgcctgtagactcatctgtgtgaatctgaaccaaaaattctccctaaggccttgttcggttacacaaggattcaatctgggctgggaatgacaagtatagtaagaaatttatgatagatacaacgagagaccgggatttattccgagccgggaaccaatttactcatgatagggacaataagagaccgggaatcaatccactagtcaagaggtgtggaactaatccagatgttttgttgtacctaatatgagtaaattggttcccgacccggaataaatcccggtctcttgttgtacctattataaatttcttgttatacctatcattcccagcccggaacgaatccttgtgtaaccgaacaaggcctaaatagatagatagaagtgcaaaaagatgggacctggtatgctgttgttgaaaatctccatatgaaacagaaaccagtagcattaataacaagttaacaacacatggaacaatgttactctatcagatgttggcttcactaattcttgatgactaacagcatagcaaaaccagcagcatagacaagtttgtcatcagccaactgaacttcagaaaattttaagttggataacatctccatgtgaagggaagaataatacatgcaaagcaaactacagttgaaaaatgataatccaacttaacataagggaggaatatgctaggtacttattgagttattgatttttttttcttgtttcatgaaaaaacacagcataaagaacttgttggacatacttgacatagagtgtgaaaaatcaccccaagtcttactcttttttattaacaaaagaacatatattaacaaacatgtgatgtgagacatgatgtacaaatcacttcttacatgttgtgagacaaatcatggaaaaatagcactgttgcaaagtttggaacaaataaaaatagtgaaatgaacaaaaaattattgaataataccgcacaaatcattctcaagtaatggatcaattcaagtagaatctgtgggatttatctataacttagtggacaacctacagaactcgagtcatgactaagcaatcagctgagaaaaatgcaccaaagtgacttactctaagaaacaaaaggatcattccattcctgaactcagcttttagcccaagattagagtcaatctaaagtccacaaaaatcatgagcccgagaataatggatttttaggaaaatacattcgctcctcatagggtcaaactgttttcgaactatattagccgaagccgacaattcatagcaaagtatgataaaaatctcaatcacaccatcatagtaaagtccacaaaaatcatgagccccagaataatggatttttaggaaaattcattcgctcctcatagggtcaaactgttttctaactatattagccgaagccgacaattcatagcaaagtatgataaaaatctcaatcacaccatcatagttgagaactcccattgcctaaatatgacatgtaaaatcagaatgaaatttgtgcgatggatcgactgggactcgatggggctcagattcagtaaactactccctggctggcattgctagcacacaagtcatagatcgaggaatctctctctcctagctccgagtaagacctatgacccccggactggttggatgaaagagggtgtgagccctgggaacgcgaatgaggaagggaggggggatggaggagggggacacgtacttacacccgcgaggcaacgggttcccctcatctgcatccgccagggccacggcgagcgagcatcgtcgccggtgcggcggagcagaccccaacttccgcgactccgacggccgcacggcgatgcacaattgcacatcgccgcctgcgaggggcatgccgcagccgcagccgccgccgccgctagacggctagacgcccacctccccgccacgcccgccgccgccaccggccactgcccgccacgcccgcgagccgacggcgtccttgagaggagaggtctcgggagagagggagaggtgggagagagcatgacggatgggcccacgtcaggggtattttggtcgggaaaaaaataaaattgagcaaaaactttctattcacaaaaaagaactaaaatggcattttggtaaacacatctcaatttagtgtgacattacaatgaatcagtttgaagcgatggcaatccagcgaaaccactcttttacgatggtataatcctaaatttctcgccaggagaatcggagaagagctccgcgccctcgtccatgctacggtgccgccgcggtgggcgatgagtagtatccccaattccccattggtaatcttgtctcaaagaggatgaatggatgtgcctatgtctcgcggttcatcatcttctccttaatttacgcttggctgggaagtggatttttgtccctcgaggggacatcctctcattttgtgcctgtcattaaaaagctatcaaaaaattttaaaaatttatcaagatagattaatatataatatatcttattgcaaacatgcgagttaaaattcgacttatacaattggaaaaaaataaatttgaccgtgaattacgcgttctattcatagtcaaatttattgttttttttctacttgtataagttgaatttgaatttacatgtttgtgaaagcaacatatctcatattgatctatcttactaaatttttttaaaaaaatttgatgattttttaagtggcatgtaaaaatgaggggataaccttgagggatgaatggagttttcaccttggtcactagctcactgctcagcccaactccaagaagatggctcattgcaatgcaacagacaacagtcgcgcgcggatggagccaggcggagcatgatgcgaaagccacctgcctattccggggcgaggcatcgtctccccggccaccgccaccacgagactcatggccgtccctccaatttctaccttttgcatgatgcatctatcgtgcatgcatgaacacgcggccggcgcagctagctagctagcacgtaaacacactgcacacacctgcaggaggccggaactaagtttgccgagcgatcaaacggcgagccggcgatcgccgtagccttcttcctcggcggcggtgcggccggctgccgatcggccggggcatatatgcaagcaagatggcaagatcctactacatttgctcccatatcgaccccctcgctctctcccccatccccggcatcgccctcgacacgctcttcctcgtcgccatccaggccctcgccgtcatcctcgtctccaagttcttccacctcttcctccgccgctacaaccagcccagcgtcatctcccagatcctcgtacgtaatactctctcggctcattgatcctcctagtacatttcttgaattcataatcgatcggatcgtgtgtgtccaggccggcgttgtggtcggcggcatggggctccgcagcgccatcgtgcacgtcgacgtggacaacgtggaggacatgtacggtggctacatctccgcggcgcgcatcctgtacatgttcctcgtcggcctcgacatggacatcgccgcgctgcgtcacgccacgcaccgctgcgtcgccttcacctacgccaccgtcgccgccagcctgctcctcgccgccgtcgtctccagcggcatgtacggcagcatgatgcactccccggtcaagacgcccgagctgctcgccgccaccctcatgctggcgctcaccaacacctcctccatagccgtcgcgcggatcgccgccgagctcaagctcaccgtcaccgagaacggccgcctcgtcgtcgccgccgggatcgccaccaacctcatctgcatcctcggcgacggcgtcctgtcgtccaccacccgcgccaagggcaagatcgagggcgtcgcccgcggcgagcaccagatcaggaaaggcttcctggcgctcgccgtggccgccggcgcggtgtggatggtgcgccccgccgtgacgcggatcaacaagcgcaacgtcggccagcaccacgtcggcgtccgcgacctggcggtcatgctcctggccatctggttcgtcggcaacatcccgcagttcctcggcttcgacggcatgccgacgagcttcgcgctggggctggcgttcccgcgggaaggcgccgcggcgaggtccgtcgccgacgcgctcgcgccgccggtgaagggcatcatgctgcccttctacttcgcgacgatcggcatgaggatgaacttcaactccatgtcgggcgccatcatcgtgcccggcgtgctcattacgctgctcggccttttcggcaaggccattggcgccgccgccgtcgcctcctacctcagcatgccgctctccgacgcgctccgcttcagcgtcctcctcaacatcaagggccacgtcgacaccatgaacatgaagttcgccaaatcagaaggggtaggtaaccggtcgaacacttgatgcgccatgacaacgtcggcaatggagcaactcatcggaattccggattatttgtttgcgcggcgcaggtgtgggcggagcaagcgctgtacgcgatgatcatcggcaacttgatcagcaccctcgtcgccggtccggtggtggcggtggtgcggcggaaggaggaggaggcgtacaggacgaggcaccaggccatggagtcgttgggcgcggagcaggagctccacatgctcgcctgcgtgcacagcgcgcacgccgcgccgggcatgctcagcttggtggagctcctggtgagcgagccgcaggagcagcccgccgtccatgtcctccacctgttcgacgtcggcgaagagcgcgtcgtccggatcccgtaccaccagcgaatccgtgacgacgacgacggcggaggacgagacgaacgcggcggcggccgcgacgccgtcacgcggatgaacacgatcgtcgacctcttctcccgcgccacgggcatctggttccgccagatcgacgtggtgtgccgcggcggcgcggccctggacgacgccggcgccgtctgccgcgcggcggagggcgtccacgcccgcctcctcctcgccccctgccacaaggagcagcgctacgacggcaagatgtggtgccgcctcggcgggcggcgggagctgaaccacggcgtgctgtcgcgggcgccgtgcaccgtggggctcctcgtcgaccgcccctaccggaacagcggcaccagcttcaacgtgcccagcagcgtggcggcggaggcggcggccacgagcggcggcggcaggacgctcctccacccgtgcagcgacagggcggtgacgcacgtcgtcgccgccgtgttcttcggcggcgccgacgaccgcgaggccgtgtcgctcgcctcccgcctcgccgagcacccgtccatcggcctcacggtgttccgcttcgtgaagcgcagcacgtacgacagcgtcacctccgccaaggtcgacgagctggacatggcgttccaggagggggacgtcgacgagcgcttcctgtggaggttctacgagaggtacgcggcgagggccggtctggctgaggacgtcgtgtaacaaaaactctattcttttagtatattgacgtacaatcattttgtgtgttcgtgaaaaaaggtacgcggcgacggagatggccatgtacgtggagaaggtcgtggagaggcccgccgacgtggaggagacgctggccgggatggccgggatgttctcgctggtcatcgtcggccggggagggaggcagccgccggagctcttggccgggctggaacggtgggcggacgccggcggcgagatgggccccgcggcggagatcctcgcgtccaacgactcgctggagatgggctcggtgctcgtcatgcagcagcacacggtagtgatcaagcaatgacacgcagacgtcataagaattattgttgtaagattattaataggttattacacacatgacacaacagcttgtgtatatttagatttctgcgactagaatttcttagagctaactttttttttcttaccatatgtggacatctccaagattttttaagtccaaatttgatctagtgctaaatttgactatcaacaaatgttaacatcttggctgagttctttccccaactttcctaactcacatccctcgttttccgtgcacatattttttaaactgttaaacgatgcgctttttgcaaaacaattctatgcgaaagttgctctaaaaaattatattgatccttttttaaaaaaataataaatactttattaattacatactaatagactattgcgtttttcgtgcaaaagatatttgttcccaacacaccaaacgaacacagacttagtattgtttcatatagggaaagtccattcatctctcaaggagatgttctatcgtgtttacatgtcgcttaaaatatcatttttttaatagaaaagtaagatagattaacatgtgatatactgatatgtcactccataaacataggtgttcatccctccataaacatgtcactcccgaaacaattatactcatttggctaaagacttttaaaacacgacataagctaaaccttactgacaaataaccataaatagggaaggtatattaaaagctgcgtgttttagtctggaaaagcaaagatcttaacacaacacaactccattattattccactgcatggaaatttagcctgatcctcttttctaatcacaatgctgtgattatttttacatgctccatctgtacacccgcagtaccttggaaaaacattgcacaaaaaaactgtgctccaaaggtacatttgggaaaaaagatggaaaaaaagaggaagaacaagctgaatatccctggagctcttcttcagacttcagatgctgtgtgattcttcagacttcagatgctgcatacagcaaaatgctggtgctgcgccatcctgcttgggtggtggctgcagggcatcacaatggaactgaggagagccttctcaacctcctccgaggcctctctcccgagcaaacacatgacatactccatcaccgcggcgtcgcacggcagtgtgatcctaccatcgctgctgaacccaaactcctcctgtgacatcctcaggagctccacgaacaccggcgtgcggaggtacgccagcgggatctcgaaccgcctcccgtcgcacgagtagacgacgcagttgcccttcccggcgacggatgagctgcaggatgagtggtggatgatctccttctccgatgccgtcaccctcttcctcccgatggcacccattccctgccacttcttggaaagctgaactagcttcttggagctgatcatgattgcttaattttgctttgctttccaaggaagtgatcagggaaaaaaagagaggaaatgtcaggttgtttttggtgaattggtgatggtttgtgtcaatggcaatgtatttacaggggagatatgtgatagggagatatgcaacttagtttcagatttttcagtagtaccaaacacgaagtagctagctggcaagggacaaggccatgaactcccatggtgagatgttgcaatccgtgttacaggatttcaatgcccacgatcattgtttctcccatggtggagccatatttcatttgccagatctgacatacattgaacccaactactggcttattatctcagatagtattagagtggttctaaaagaaatagtgtagttcctcgcaaaaaaaaaagtgtagttttatgaagattataggtttcatggcttattttttgggaatgtgtatcattattgcattgagatcaaagaggttcacacataaaaaacaacacaaaggaaaagaacatgtacatgtttcacaacacaaaggaaaagaagtacatctttcatggtttccgacgctaaatcctaccactaactcactaagagaaatttgacaaatggaagacatttaaaacctccttgaacgtagttagcgtataagttcaaattctgctaaacattatgatcatgatatgctgctttttgttaacagtgaaatttggtaagcccggagtagtcatcggcttcgaagtcttgagattagctgatgagagttgtcaagtcgtcagttgtcggattcttgctatattcggttaaggaaattgatatactaaaggaagcttatccagaagagaccgagttcaaagagaatgcggcatggcaagttatctattaattaggaatagtttgttagtttccttttatctttaggaaagtgtgtttagtgtcctataaagactttatcttttccttttatctttatgaaagtttctttttggtccaacaaggacttgtatcaacccatgggtataaatatgtacacccggggtctatgtaatctatcttcacaatcaatacaattcggcgcatcgccaccttttaccttttctactttatttttatcgtccggcgggacttggcacctgacgcggggctgcatcggtgttcgatctctggctaaggggtaagtccaatgttccactggcctaggtagttgtatcgtttatgtcggcgtcgttcaaggctgcatcagtacattcaacctcttggattgctctggtttagatgatatatttgcctacctatttatcatgtctctgttaatctagtcttagcatatcaatttagctctatcggctgcttctcgttttagggtttctgtcggtatcggctaaatcgcgttgctagattagattagcttagacatctaccaccctgaaaactcagtcaacggcttgattgtctagatattatgttttttttcatacttagtgttgcatcagttaagtttgatctactaagtcgtgcttagaaccataatctctagcctgcttcttgattgccaataagggtttcatcggggtttcagccggtgagttatctggacgttgcatcggctcataaggattgcatatacatataagttggatttagccgatgacaacaaatgtttcgctgtttaatctaatcttgtggatttcatgacatcggacctccagccgatgtgtgcttcaaccttcggatcgatgcttatttatcatatcattatttgccgattggtttatactggactatattgttattttattacatcatcatcagccgattgcctttatatcatcatctacattggacatatagccgattgcttaaaccctatcgctatcagctagtatcggcatcggctattattggatatcggctggaactactccatcggcttgtcagccgatcggctgttttgatctactatttgtaacgctccgcttttcatgagtcgttaaaaactaactcggcaaaatcctaattgcgaaaattttcgttctttgtgtgcgagtctaagtcgtgccaagatctcatttcaaatcccgttgttccccctcatcgaaatcaaaaatcctccacctcaagatttcctatccaaaattcaagtctccgaaatcaaattccgaaagtcaatcccttcctttgaatccttgccgaatattcgctccgactaaaaaaaaatatccaagttttcgttttgaatctctttcttgacttctcctcgagtctcccttgattccaacctaaaccatcgagttcgaatgtcaaatttgaattcaaatccaaaacctcaattcgaatccactccaaatcagtcttctctgcaaaagtctattttacctccctcgggtattgtgggccgttttccccttagcccacctccctccctcagccgtttcacctccctcttggtcgttgggccgtttttcccttttccggcccatcttctcctctcggccgctcctcctcctccccacacgtgcgctgcacgcgccgagcgagagaagcagcgcctctcttgtctccttcctctctctctctctctctctcgtcgaactcctctcctcggcgccgattcccgccgccgccgtttgaattcgccggtcgcccttcccgcgcgcgcgctcgccgcccggtcgccgccgccatcagcccttgcaccgccgacgccacgcgctgccgccttgcccccgctccatgccaaaccgaccaccaccgtcattgccgacgtcatccatggcccccgccactccacgccacatcgtccaagaatgggagaagcagctgcttcccctctcctcaatatggcaaaggaccaacctcctttcccccccttctttttccttttccccgaccaccgccggcgtcaccacctctgtgtcgcttgaccgctcgcgccacccgcctcatctccttgaccgccccaaggtcggttctctcaaaccgacatcgccacctacaaaacccacaccccctcccatacctcccgcttcctctcctccatcacaccactgccgtctcgccgttcgtcgtcgttctcgccctcctctgccgtcgtgcgtgtcggggagctagcgagcacgaggagtcgacaaggagctccgcgccgccccatccttgcacctctccatctcttcttccccggccgcgccctctcggtgccgcgccaccccgccgacgcgaccgcctcgccgcgactccatccgcgccgtcgacaccgtttctctcgtcggtgagctccccactgaaccccttttcccttgtcgcacgccgcgccgcgcccgccaccgttcgtcacatctcgccgcgcgcccttgctctgtcctggtcgtcgctcgccgtcgccggcctctctcggcgtcgcccgtgccctctcgaccggtggaatgagctcgcgacctcgcgtagatgctccaacttcaacgaatcgaacccccgttgccccggtgaagttttccccctttgctcgccgccgacgatcgccgtcgaaatccgccgccgtcggctcccctcttgtcaatccctcttgccaccacgctctcggggatccccttgatctcccccttgttgcctcatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccttttccacgacagctgaccctgagaccgcgcgcccttcgctctttccacgcgcggccacatcggcgtgtcggcgagattggccaccgccgtcggccgccgtcgttcttcccccggctaatccgctccgttgaatcgattccccttggcctcctctctcttccggtgctaaccccccaatccacctcgccgccgttcgccggttcgcgtcgctcatcgctagccatcggatcagcctgcccggcctcctctgcctccccatccgacgtggcttccacgtggacgccacctcaaccccgggccagcttgaccgagtcaagccggcgcccagtcagcccccctcctccctctccccgctcgtgggcttggcccgtcaaccatccccccttctcggcctaggggaaaatgaaaagtctacttttactccctctgtccaagcccagtgcccacacacatgaacaaaagtccacttaatccccccccatgtacagtacacccttggccccgcacgtcagtgactgtcaataatattcttgagaatattatttccataaatttcgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttattttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcatactaccctgattccttgtcgctccacccttgtggtacctcggtaatcgtgccctctgagcgcgtataccaaatatcccacatacaccgttgtttgtcgaaaacttgggaaataggtttgtgaagccttcaaaacccgacatgtggtgtcggtgtgtttgaaaataaaatgaattgtgaaaactcgcgatgcgggggttgtgcctgtgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaatgcaagaacgagaagcttgctgaattaccgatcgaggtggttggagtttgatttgtgaacgcctaaaatggcctatatttatgtgaggatttgatccttctatgtggcatgaggtatccctgggtcggcttgggaaaggctttgttgcgaacctccgataccgacgggtgttcggaataagttcgtatcttgtgggtaaagtgtacccctctgcagaggattaactaactgttcgaacagccgtgcccatggtcatgggcggatgtgaggtggttctcgttgcgtagatttgtttgcatgtgctttgtgaaaagttgttgtggtgtgggaatcgtaaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctctgaaagtcgaatcgagacgcaagtctcttttcggcccaaacttagaaagaaataaatcacttagtgatttcaaaatgtcttcaaataaaagatttgcaaaacaacattgcctctcttccaagcttgcattaaacacctaaattcccgtgacttgctgagtacgaaagtactcacccttgctctatataaatatatatagttcctccgccctgaagttgaagatgaggtgaagtgaagattagggtttcgtcctggttcccagccgtcgcctgtggtgttgggtgttagaccgttggttccgctgctgctgttgttgttggtgttcgcctcgtccgtgtcgtcggttgtattctcgggctgtctgagctgcaacctaagttaaggtaaataagtcctctatttattttaaggatttgcaatgattcatatttgtcaccgtgggtaccagcactatgtcctgggactggtaccgagatcgcggtttcgtaggaagcggtttgcgccgtttttcctacgacatgccccctatcaggtgccgttgtgcggcggtgccggattggggtgtgacactatttgcatatcttttcaattgcaggatcaaactgactggcacgcccgcatctcattaatctttagacctgcacaggagttaagcagatctcccaggccggtgtattcgatttttttcgtcaacactgttcattcaaaaagagagagagagctttatttctacgtacggactgaagctgcctccaagtcaagtcgttgcatgtgttccttggatctgatttggatcatggccatctttaaaagaaaatatatcaacttttcactttccagaggatatccattagtgctttgaatagatgagcaacaaattggtccatgacatgcacgcactcatcaatgacactagttggtgcgagcagcagggtcatgaatctggtagtgcaatgttggctacaatggaggcaacagttggtgcattggggtcctcttgtggagaccatagtactgaactggtttcagatgattgggtacgtacagcagcagtggttcagtgtaggatagaagcatatgcagaggcatttacttcaagctccagcatctgtcaacacaagaaacacaccgaaacatcagatggagagccacatcaagtgagatttcttaggatgcttcgtgtgtccttccttatctgatcattaggggttggttgaggaagacttgactagcattacaagcaacttgcatatggtatgtgctccatatttctacgatgatgtgatatcatcagatgtggcatccatatgttctccattttacatgcctttctgaactcttgcgcatttctggtttctgaactcgcaatgtgctgcaggttgcacttctgtaaagagttgttccaagaactacactgaagagttctttgctatacctcgctgtgttttcttgtcaattacaattgcaaagcaatccataaaaaaagaccaatcctgcaagggaaaggagtgaggttgtgagctgtttgatcaatgatcatgcaagtgatgcaactgtatactggtccgtaccgtactgtggataataaagagatcgacacgaggacagcatgtagcttcctagcttgcttgttaacttcaatggcgtaggaagagatcgatgggtgataggctagccgcagatcttttcgcccacatcaaatttgattagggttaggaaggtgttggttggttggcttcgatttgaacaacttcctcgacaaattcttatcgccaatgtaccttgtggtccaatccatctgcactgcagcatctcacatgcatcctccagaaaatggcgttcctctgtaaatctcacggagaagcagttcgatccgacacgcatggcggcggaggggatgggaggggagggcgtcgaggaaagcttgcctggtcaagctggagcggatgcggatctcctccccctcctccgccgcctgaccgcctccttccccatgcagacgggtgggcgcggctcatcgccattgccgctctctgcctcggcgttggcggtggcacccgccgccgccgccgtagtcgccgtcgatctggaggcgacgaggtctgtgtctgcttctgcttctggtttctctgcaagcagcccacacggtgtgggcctaggcccatccgagttaacagctcatttgtaaggcccaaatacagctcagatcaggcccagaggccggagcccgcttgttgggcctgaatgtctaaatgagccgtattgaagttgaggtttcttttctgattttttttttcaaaaggcaacttgtcatttggatatctcagcatggtcacttatctgaatactctgtgcagagattaattagaaggatttctttttttcccctaagaggaagttaatctctgcaactttgttactgtatagttatggttgctacctatatgttgtggaaattttcagattttaagcaaaaggttctctttgaataaagcttgtttctgtaactcatgattctgttgctagaaacagcgtgtacgatgaatatggtagtgtcgatagacgataggactacggattactgatgtcacgagagaaaatataatagtgggctgtaagaacgcttaatgctgaggtggatgagagatgaaaagtaagatgtaaacttacagtcggcttaggcataggaaaaaaaaatctgtaagacggataagtggaccatatatttatagtgaagagctaaccactatatgagtcagctgagataagctataatgatttatacagtaagcagttgcctgtattattagctttgctaggaggtagcgatacatacaaataattactccacatgaggtgacaacctttaaacaactaaagaaaagaaaagacagtactcctgtatagtggttaattagtactcctacactagcttagctctggctaacccctaagggcccctttgaatcgcagggtagaaaaaacggaggaataggaaaaacataggattctgacaggaattgaagtgtaaaacagaggattgcaaaacacaggaaaaacacaaaaatggtcgtttgattggagcgcaggaaaaacgcaggaatcggatgagagagatagactcaaaggaaattttccaagaggttggagctcttgctaaatttcctccaaaatctacatacaatgtgtcattccataggaatttcataggatttggaaagtttcaatcctttgaatcaaagggccaaataggaaaatttcctataggatttgaatcctatgaaattcctacataaatcctttgattcaaaggggccctaaacttttatttacaggagttgttattatctccaaaaggctaataacagcaaagcagctcgatgcaaataggcgtgagcttttcctttgtgcatcgccatgaaaggaagaaaccagtcaaatcaccatatactctactcctggcaaagcacattggtgtctgtctcggcctttgtccttggactggactcagtccatggaaagacgagaaagatagcagcagtacgagcaatctcagcagtcgccacaaagtcatctagagctgatcatgatcatgatgcagtgggacaccagtctatccagatttcgaaatctcgaattgcgcctctctgaatctctctgaataatcttttttcctcaccagatcgagtacgggaccaaagtccgaatcaagaacgtgttctgcatggacaatcatacaaggtttgattttcttggtcggcatgcagtggccaattgggcacattggctgccagtgcatttgctacgcgacgtttgttaaactgtaggcgaattcagattcacgtttcttatcgtcgcgcgcgtagttggattgattatatagagtcgtcgacctcggtggcgcgtctgcgtctccggtagtcatgatcaaaatgcatattcgtggagaagatgtggcgcaagacggcgacgacgagcatctcatctctccaacgacccaaccgtcgtcgtgccggaggagagagggtctacgtatacgacgacgtgagcacgacggagttcagctccggatgcttcacgtccggccatgcatgttatctcgccggcggcgtgggaggagaccacgagccgacgacgacagcgaccagctgatccacccgctgttcaagcgcagctggacctcggcgtccgggacttcgagagcgggacgttgcattgcaccatcgatccttggcgacgtgtggtggcatctccaccatccttggctgggttcgccgcctccactttggtttgcaccgtctcaaattttaagatgaaattgctaccagatcattgtgcacaacttaaccagtagaatataaatataaatatatgacactatctacctttaacgtgcgacttttacaactattttttctattaaaaatataataacaatactattaaacaaaattataatattttaaaattactttcaaagaaatacctaacaatatgatttttatatttttaaactaaatatcttgagagctactaacaagtcagagctttaataatggataagccaataatattatttgaagttttttttaaaaaaaactggtgactaatctttaagcaattccctatattaaatagggaggtaatatataatcatattcacttaagatggaaacaattctaaacccttgagaggacatccctctttatttacatactattcaaatttctataaaaaatcaataagatatattaatatacgatagatcattcctcaaatatacatgatcaaatttaatttatacacgtttaaataaaatgtaaatttacgttaactaagtatatagtttaatttttttttcgttgaaacttgtataagttaaattattttaacttatatatttgtgaaatgttatatatcacatatatttatgtatcttcttaattctttcttatatttttttcataattatttgaataacatgtaaataacaaaatctactcttatctaatattaaaagttggttggtgagagccatttataacgccattcctcatctgctgagagtgccgttgctgctagtgaaacggcgagaaagttggtagctccatcaattcaatgacgaatgtaatcttgactacaacgagtagtatagcaagaagaagatgatgaaagaaaaaggttgaacgaacaatagaaagccaaactatagttatgggatatttttttaaaaaaactagagttatgggtggaagcaataatggataccagcaagaacaaaaacacctgccaccggcatagtgccaagcttagcccagccagctactacaagctttgtttctttctggtgcgattgtggtcgtcacgtaccccacacacgtcacatgtgcaaccccatgtcctacccttttcaagtccagtgggggtcgagcgagccagaccatgcatgcatgcatatgcatggcctgcctcccgtgcgccgcccgcgtgacgaagcatgcacacaacatgaggtggagtcgcagaggccgcgtcgcgtcgcgtcgtgacgtcgtccccaccaccggagcaaagcaaagccgaataaggggggtgttttaatgcagggtataaagttttagcgtatcacgtagcatattatataagttatcatatgggtgttcaggcactaaaaaaactaattatagaatccgatagtaaaccgtgagatgaatttttttctaatatattgacgtgcaatccttttgcacgttcgtggaaaaaatcgtgagatgaatttattaagcctaattagcacattgttaaattatggagcaattaagattaaaagattcgtcttgcaaattaatcatgtaattagtttttttttatatatttaatactttgttcaaatgataggtgtaaaatttttgtacgtgaactcaacagggcctaacgcagcctttttcaccgccgcccacgtacggctgtcccccccgcttttgctcatctccgctcgccgccggcaaccgccaacccgcgctgtccagtccgtgacgttttcaccgtgcgccggcccgctcgactcgaggacgaagccgaaaagcgcgaagattctcgcgtcgccatcgcccatcgcccatcgccactgtacgtgctgctcccttgcttaagatctctcatctgcactgcactgcatgcgtccagtgtcgccgccgcgccgttaaaactttctaccgctgctgctgcgcccgccgcgcgccgaccatggggtgcggccagtccaagactgacgggggcgggggcgggggcggcgcggctgtggcgctgtgccgggaccgcgccgcgctgctggccgacgccatccgccaccgctacgcgctcgccgacgcccaccgcgcctacgccgcctcgctgcgggacgccgccgccgcgctgcacgacttcctc

SEQ ID NO: 37653 - DNA, 20159 bp, Oryza sativa
  unsure (1)..(20159): unsure at all n locations
ggcggccacatacatttcccctccgacgacgacgacgacgagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgcttcccggctctactacggcagcgccgcgccgccgccatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaaggtttattatgatgcattccttgctttcctgtctaaacttccaatcttttttgccattcaatgagacaagtggaaattttcataaccaaattgctgttgcagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaaggttctgatcgcgctctacaattttgaatttctagctgaatgattttaatccttcatgggtgtacttctttctcccctttagatgtctgttttgaacattcagttcaggaaagcaaagctgactgtttgctgttattaacttgtttttagctgcctaatattgtcaaagtatattcagttcgaatattttgagtaacaaactgtatttacataatgaacttggatataactatttcttgtcaaatatgcacatttctccttttcggaaacttgtcgtgtagttaattatagatgattaggagtttgcactacaaataagtgcaatctgatagttttaatgccactgaaattgtttgccgcatcccttatctgcattcgttgtcataatgacatgtgggatccaactctgcatatcagtattcccaagaaatgattatgccttacagttttactctgtagagggctttatgtttcttgtgctttgtctttaccattcctttcccttgctttggcatgtcatcccattattgttttacttttataggcttgttaaagaagacttgatttcttcttttattatgttcagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggtatgcgatatgcatctctttacatgaaattccacatgagttgtactactactactactaatgcatattttgcatacacaatgcacatacacatacatttttatgactttttcattgaatggagtagatcagggtaggcagtatggacaaatttagaatttggttcgcaagaaggcaagaatttagcattcttaagtacacatttagacacaactgttagtatgtgaaatatttggcatttcaggcatttagtgattactggtgagcagggtttcccataccaccggggccggggttaccgcgccccggcggtaagcacggttaccgcgcggttaccgtggtaaccgtgaaaaaccgtgcaaaatttatcaaaaattcaaattatttttaaaatttatttgaatttaaggaggttaccgcggtatttattaccatacccccgcagtaagcccggtaaccgcgcggttaccggcggtaacataaaccctgctggtgagcattaacagaatgcattgttacattttctcctcactttatggtgtactggcactgccatgtgattattagtttcgattattatgactttctacatgctgtcagtacaaattcgaaatgcttcttaaatcttaacgggtgttgttattcaactttaagttgtcaccttggattactttgttatttgcatgctaacttggacatacacaatggattttcaggttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctggtaagtacatagcaagtaactgaccttggaggtttggatgaacagcaacagtgtgcagagccatcacagattctcaattccagtctcacaaccgatgtgccttgcttttgcttggtttgggccctctgccaagtttcagggtcatccttaggcctgcagcaactgatgtgagatctgtgttggcctgcattctcagggttgaatgatcttcttttgtggtcataatcatactggagaaaactactgtcctgtaaagaagttaatcaccaattcaccacaatgttattgacaaaggggcacaaagcatcagactatcagagatacaaaacaatggacattatctataaaagaaagagactgagcaatggaagattctgacaaagaaacagagatcaagatatttcttcttagaggccctataattgcttgtagaaattctctatcaagaatcaaggcagtgtttaaggaggttggtactgtggatgaatcttagctgatactcgataatgagataatttttttagataatggatatcactcctgcctctacatcgataatgagacatgtttgatgctctgtttggagtctctactcgataattcccaccgaagcatttgggaattgggagcctcagcatgacagcattttaggcagacatggccctgatactgcaactcttcaatctcctaatttgattggctgtcgaaaaaaagtctctctctgtgtttatctgtatacacatgatatgattcatttgtacctgtgacactgtaactttgtacagcgagtgtaacttgagttgagcctttttctttcatctcttaacctgtctcagtatgcactgttcttgaatctggttgccaagctgttcttgaaagtgacaaccagatcagtacatatgaaacatgatgttgaagtttttttctaaattttttttgaaccttcttaattttaaaaataaaatctcgcaaaacctatttctaaatctaaacctattggtgtggcaaaacgatacagacacatccactacaggtagggtggcgtggctaaaatgttcagattcggaaaaaatatttttaaaattaaaaattaaaaaagaataaaaaaagtaataacaattccatgatgaattgagaaaacaaaagccaggatgtcagcatgttgtcatctgttgcatcagtggagacaagacaaaccagtttcacaaacctggtgagaaagtgacacgtacatgtattaggtgagagagacagcatcaatcagacgaaacacagcagagaaaaaccttaatcatgattatacttatacagatacagataatgctgtatcaggccagcgtatgaacgtatctgacgatgtcatgcacgtcagagcacaaattaatcaactttaattcgtttgtttaatccgattgcaggatccccaaagatctcctcctcccctccttcgctggtacggccgtgcaatcattcattcaaattcgcgcgcgaacccactcgtcggcttcgcgcgcttccgtggagacgcgccacgcgtccctagccgagctcgtcgtcaagctccaaccactcgtggttgcaactgctcgacgcttcctagtacgtacgtggtgcgtcgccgtcgtcgccgtcgcgcgctcgtgcggtgtgggtgccgcgcccacgggaggcatgccagccaggccttgccggcgaggcaggccgtaccgacatgccagcgatgagattcttccggcggctcaggatatatatcgcatctgtccatggtgcatgcattcgtcttcctcgatcgatcgccattaattcccaagaattgagggaagctagtgtggtgatctgcagctatggaggagcagcagctgtgcaggctgaggcagaacgtggcgtcgtcgtcgtcgtcttcctcggcggcggcggcgatggccggcgcgctggagggcgtggcgcgggtgtacgagcacgtcgggccgctcgtgcggttcgcctgcgccgagcaggtggaggaggagctggaggcgtcggtggcgctgctcgacgcgtgcgccgcagcgagggacagcctgcgggcgatgcgcgcctgcgcgcttgacctcgaggtggccgtccgccgaggcgacgccgccggcgcccagagcgcggcgagcgcctacgcgcgcctcgccaggaaggcgcgcgccgacgtcaagaagcagcagcgccgcctcacgaacagcaggaggcgcgagcggccaacccgcgacggcgacgacgcgcagtcgctgcaggaggcgcggcggctcgccgtggacgtgctcgaccgcgtcgtggcggcggcggcggcgggcggcgccaccgggccgagcaggtggtcgacgtgcgtggcgcgcgcgttcaggaacaggacgcgcgtggcgtgcgaggacgccgaggagatcgcggccgcctcgccgccggcgttggctcacctgtactgcagctcgttgccgtccaaagatctccacgacggcggcgagacggcggcgcgggtgcagaagcagctgagaacgctgggagacacgatccagaggctggaggatgggctggagctactcttcaggcgactcgtgcattgcagagtcttcttgctcaacatgtgcagctcactgtcagagtgtgtatgaacagatcagagctcaaaaaatgcaagagctgcatgtacagtagatagctgtcagctataattttgacacctggatatgagtatatggtgaacaataaaaaatagcagtagaaaattttgagccattctcttggactactgtgctctccgatgccatcatacccatcgaaaggaagaagaaaagatcagaattctcatgtcacatatgctgatgaacacaatttagctttgtttcataactactactcctttagtcttttacattcgtacatgtacgaaattatttgttgtgaaacaactttcacataaactggactaacaatcagtcattaactaaggctgcgttcgttcattggagataggggagattgtcactcgttttccgcgcgtacgcttttcaaactactaaccggtgcggtttttgcaaaaaatttctataaaaaagttatttaaaaaaatcatattaatccatttttgaagtttaaaataattaatactcaattaatcatgcgctaatgactcatctcgttttgcgtatcttcccaatcctctctccctcaaacacagcctaagttttggatgcacaacgtgcacaccatctaacaaattccacttaaaattctagaaaaaactgtacatgtgcttccaatagtactacacatacatgtaaagtctccgcttcaaagttatttttatttcatccgtttttttttataaaactaatagttttaagaatataagtaagttagaatttggtctctctctatatataatgaattttttaaagagacttcacacacaattacaatactattggaaatacatgtataattttttcaagaatttttgaggatgcacccgaaacttatttgcataggataggttacctccttaagtagactagtgtcagagtaatatattaccagctcagttttttcgcgaacgcgcaaaaggattacacgtcaatatattagaagaaaaagaatttttgttacaagggaagggagaaaaagcaaagccaaaaactgaagcttaggaactactgcggcagctaaaagcaactcctaaacagcgggaaggggcaaagccacgctatcagctcagcttcacatagttcttttcacttagccaaagtagagttattcacactgttccctgaagctggagcaaattagaggattgcatcttccggctgtctttttgatgtcacaaattttcagactatttgagatcatttgcagtatgaggaatctccgatgagcccgctggcatgatggagaagtcctacttagagttgtagacaaagcattggacataaaagaaaaaaaaatcctacagacagagcaacaggatcaacgagtagtgaacctccaatgttgccaaacaagtgatgatgtgttgcttcagatgttcatttgatcagatatgctcagatccttacaacttggcaggtgaatacaaatggtggatcctgcttacgatatctgaaacaagtttcaacaatcaacaccgatgaaacttccacgtacctctgttgtttcgttctttttgtgcttttgtcatccataagaacccaacagtacaatctcttgagcgtgcagcttactctgcttgcaatgcatgagacatgacaacacagcaaaggttagttagcagtgtacctggaattagacaacatctgaagggcatcaccttgtctgcagctgcattggccatgcaatcaaagagcagatgggagagcagagcagtggagattcctgctgtctctgcataatttgcctcataccatcttctcaacctcctgattataagtagggagagttggagcattagcaccaccagttcatcatctgctcccaacactcagagtctgaggcatagcaccaaatttcattccaaacatggctggccatcaaagatcgacaagcctgccgtctatgcctcaccccaactacatcaagatcgaagaagagctgcgcaacatatgctcaggcatctcatcgccatccgccaccatcgaaatggtgtctgacgctctgaggaggcttggtggcgtctacaactgcatcaacgagatcataagcttgcatagcaaccaagcacatggcaagaagctggaggaagagatggagcggtctctggaggtgctggatctttgcagcgccatgcaagagatgttcgctgacctgaagatgaccatccaagagctgcagatggttctcaacaggggagaccatgcagttgttcaagtgaaggctcagtcatacatccgcctggtgaagaaggctaagcatcacctgaagaaggccagcaacaagtctacctctgatgaggatggaaggcttgtcagtctgttgacaacagcgagagggatcactgcctcggtcctgaaatctgccctagagctcctgtcgaagcaaatctccacctgcaatccaagcaagtggtctcttatctccaaatcgttccagaaggccaaagtttcatgcgaggaggtgcaattgcaggcattagagttgggcatcgttggcctagagagcggagctgagaatctgttcaggagattgatccaaaccagggcttcccttctgaacactcttagctcatagatgctccattggcattggcatccaacttttataggacctgtcaatcaccacaaattttgaataatatgtacgtaagtctaaatgtatagcaagatacataattgagaaggcatgcattgcttccttgcaaaaagaaattacacagttttgttaacatgtgatttgttccttctctaccatcttggagcctgtgtttaccctatcaacttatgaacaagtggcacattatctctatccaggtgtacaatcggaagctacgcaaactgacttgactactgtgacaacgattgtttgatttctcaacacttccttgcacgcctgcaaactcttaaaatatctcaaaaaattttgccagatgatgattgcattcgtgtgcaagtgttgcatcctagaaagttcttgtcaaaatttaagctaactaatcaagtcacatttctgctgtatgcttagctgctcactgctaccttccctaataaatatgatttgacatgatcgtgtcatatctatccaaccgaaactttgatattacaagataaattatactggttgttgagtcaagaatgcgtgcacttgcatggtcatcctttctgtggatagctggaacatgccagcgatgctgctgctgctgctgctgcatgagagatgaatgttcaactcgtcctaatgtaggagtatcagaagaaaaccaaaataattatttcctcaccagcaccaaaaggctgcttttcctccttccttcctgatgatgtatctggatctgaaatcaaactaaaccctcgtgcaagtatactgtcatcaatagttgagacatgacaggctcataagctcactcattagcatttgttgcactaattaaaaatcagatgaataacaacatgtctaggcttgaatggctatgtttcagaacagatcacttattatgacaacgcacaatgcagggaggttagtagatgagattctttctgtcgattgctctgttcaaacccaatcacgtttttggttctgcttcttcagttataaataagagaggagccaaagtgtttgagtaccagcaaagtgcatcttctctcttccttgctcttctcttcccattcccacagaagaaaataacaccaaagcttcaatcccgacatggcttgccatcaaaggtctgcaagcgtgccttccagcccttgctcaaatgataccacaattgagcagcagctccagaccctaaacacagtcgtctcttcaccatcagcaaccatcgacacgatgtgcgatggtttgaggaagcttggagatatctacaactccattgaggagctgatttgcacacctagtaaccaagttagcctttgccagaagctgcaaaggaagttggtggaggaagagcttggacggtcactcgtcttgcttgacctctgcaatgccatgcaagaaagcttcatggagttgaggatgagtgtacaagagatgatgttggccatcaaaaggggagaagatgcgtctgctcaagtcaaggcatacatccggctagccaagaaggcgcggaagcaattcaagaaggtcagcaaaaagactgcttctgataagatggactgtagggtggtaaagctactagcagaagcaagagaaatcaccgtctcattgcttgagtctacatcctgtttcctgtcgaagaaaattgagacgcctaagtggtctcttgtctccgccacattccagaagagcaaagtcatgtgcgaagaggagcaattgcaggaattggagctcactatcaaagaccttgagagtggagcagaacttctgttcaggagattgatccagggcagagtttctcttctgaatactcttagctcataggcaacctgagctccaataccctgtgataggcctccactttttaaaggatcagtcgatcacaacaattttgcaacatgtatagtcttgtggatatgtatacaaagttcactaaattaaaaagaaagagaagcaattttgtcaatttcatgctatgagtctttggtattattcacatcatgactgattgacgtttctcataactaaaatataggtattgtgcctcaaacataccatccatttacagggcaaaagaacaacctaagatccgggccgttccagccaagtaaaattttgtgcctcttataattttttgatgttaaaacaaaagtgacatgtctccataaggttatcaacttgttattacagccttgcgggcttcacgttaatggtttttttttatgggaacaaaggttatgttaactcacatgttcctctagcggaagatccttctgaaatggatcttgctctactcagctgaaacatgccagctccaacacacgagctacaacccggtaattagcattatcatttatatttactgatggaaacacctactaatgtcaaagagcaacaagaattgaactaatacacatgcactaataatactcaattaagaacctgttaatggttttccttgcatttccctcaagacccatcgtgacggttggaacaaatgcagattcttgctacctataattgcaacatgacagagtgttaagaccagtttgtgaagtctagtgaactaaatatgtgtacttcacgtgaaaagccttgataatgcagcacttctgcagcattagcatgcaacttcaacagacagcatctgggaaatcaaatggcatgattctttctgtctacctttcaaaagatgctcgctctctcccatttcttaaaaaattgatgctgtctcagttgcttccagtgtataaataggcatcgcctgaggagtagagacatcaaacccaagtttcatctttcttccacatctcccaactctcgaatactccaatacaaagatggcttgccacctaagatcagtcagtttgccatccaagaggcaatccaatgaagctgaaatcgaggatgagctgcaaagcctagaggcaagcatctcttcaccctccacgaccattgatggtctgaggaggcttggagatgtctacaatcagatcgaggagatgatccacttgcccagcaaccaagttttctctgcacagcaaaggaaaatgttggatggggaaatggagtgctccctcgagctgatcgatctctgcagtgccatgcaagagaacttcaccgagttgaagaccatcatccaagatctgcacgcggctctcagaagaggagacagtgcaagcattcaggtcaagatccaatctttcacccgcttggccaagaaggcgcagaagcaatgcaagaagatgagcaagaagactacttctgacaaggaggactgcaagctgatcaagctattgatcaaggctagagtgctcaccgtctctctactcgagtcgacatcgtgccacctatcacagcaactagtggttcccaagatgtttcttgtctctaaggcattccaaaagaagagatcagttgtttgtgaggaggagcaattgcaggcattagagtgcatcattggagatcttgagaatggagccgaacttctgttcaggagaatgatccagagcagagtagcgctcctaaacactcttagctcatagattctcctaaagtgaagacactctaacaccctgtgattggcctccgccttttaaaggatctgccaatctttgtacatctgtaaatgtatagaacaaaaagagcaattgaaaacagcagttttgatctagccagtgtctcatctccaatcatttatacatgcttctgatttctgatttcagtggtatctgatgatgtgattttgtgatgtgctgatgtccataaaactatgggtaacaaaaaaaaaacatgaaaaaaacagaagatgtgaattattgttgcaagtgaaacacgatttctcttctcaggaagatagagaaaaaagagagagattcgactagaataagttataagtagatggaatcaactttcaactgcttaatgctgtccatttctgaacctaaatgtttgatttcaaagtggccatgtgacctcgcacttgtttaatcccataatcagcgcacgatccttcaatggtggatcatgctggcctgccctgcatacacgcagcatgccagatccaaccccacgaggtctgaccttgtgattagcaccaattagtctgtaatcattccctaacccaatcgctaatgcgataacgcaacagtggaaggacggcggtaacccactgcaacgctaataaaaaagtagggttccgaactgacctccggcgggaagcaggctgcgggggcttgagtgcttgaccctgcagatcgccggcgacggcggccggtggccctgtggcggcgccgccgccgatgcgcctctcgtgagttttttttttttttggtcttttatttcgttttatttttatttaggggcggaaatttgaagagacgcgtggtgggttatgggccgtgtgggctttactatgggcgtcacatgtcaatttcggcccaagctgatgaggaagatggaggagaatcagagaatgcgcatctcgggtcctttcactttgttgacactttcaattttatcaaaacttggtaatgacgaaatttgaccaattttggcattaatatattttgatatgtttggtttaaaaccttaaaaagattttggatttagaatcacctaaagatgcatgcacctgtttggcttagtaccagtgcgctactggtttcattctcgccaataactggaaaatgtatatgtggtaattaagctcttaagaggcaccaacattgtacttgaaaaaggatcaaacatgcataatatcaaaataaaaggcatatgaacatcaaatactaaccgcagacagctgaaacatactataacaaagactgatgccggaaactgatgttgaaaaaacataaactcatctacacgaacggcacctaatacactgaaaaaatgcactaaatgtggatcatatccataatgaacacttgaacagagaaatgtgctgtaccatacaactgaaacatgacagcaatgctgtgaagacaacagagtgatatataatggctgaaatgtcaatggaccaaggctgtcatttataagaacaacgaatcctctcacacaagcaagaaccaaccacgccctcgtgcagatgagtttgccactttgccaacacaacctaagacatgaagcatcaacttgttagagatggttgacaatgtcacaatgtgtccttattttgcagcatgacaactcacaactgataagaacattttgcagtttagcacggcaggcaggagtaacatgctagtgcagaaaccgcatgattgattctcccatttcattgcatgcttcattggtctcaccatcttgaacttgaattcaacactaagcaacccgctcgtgcagctgagtttgccgccaataatcgggacatgatggtacaatcattagctgagctagagatgcctcttacatgaaaaaaaacatcagcttgtcgaggagttgggtggcttctgttgcagcagcacaacaattccatggctgtctacacaatcagaaatgccattgcttgagctcctttcgttatatatacaggcaaaccatgcccaggtcgacaccattgcagcacagtttcctttctcttcctatccatctccagagaaaagaaaacaagagaaaaatataatggcattccatctcagatctgcgagtgcgccatccagcccacggtccagcgaaaccaatgtcgaagaacagctgcagagcctaaaggcaacaatctcctcaccttcttcaaccatcaggacgatgaacgatggcttgaagaggcttaagagcatctatgatagcatcgacgagatcatgtgcatgcctagcagccaagttctcctttgccagtcacagaacaggaaagcagtggagcaagagctcgagtgctctctcgtcttgcttgacctctgcaaggctatgcaacagaacttttctgagctcaaggcaagcatccaagacatgatgttggttatcaagagaggagaagacgcagctgttcaagccaatattccatcatgcatccgccttgccaagaaggcgcagaaacagtacaagaagattagcaagaagactctgtcacctgatcaggagagctgcagggtggtcaagctgttggctgaagcaagagagacagccttctcaatgcttgaaatctcatcacatctcctctcgaagcaaactgtgatgccgagttatagcaagtggtctctcgtctccaagacattccaaaagagaagaattatctgcgaggaggagcaattgcaggcgttggagttggacattgttgatcttgagagcggaatcgagaatctgttcagaaaatcgatccagagcagagtttctcttctaaacgctctcagcatgtagatagaatgatggaacattcccaactctgacacctgtgattggcgtccgcctattagaggatttgttgatcaccaaaacaattttgtatgttcacctacatcatacatgaggaaatgtacaggagttcattcaatgaatatttcactcttttgcctctaatttcccccttcacttgacgcatactgctctcaaacaatcaccggacatttggagcgcttcacctgaagcatgttcaagcaaaaaaataataaattagtcagaagacacataccatttttggctgtcataatatatgcaattagtaataagtacacagttcccaccttgccttcgtaaagccatgggatggtcatgtcaccagtattcacatgagacaggaacaggcacaagatcctttgctccccatataactaaatagttgttgataaattgctcagcaatcagatgcaatagcacacatggcaccaatactagttgattagcaatctccattaaatgggtgctggagcatacacgtatgacaaggctcagtaatagaataagctgccatgctgattcctgctgccaataactggaacatgacaatgtgactcagttaggcctaatgcatcagaaatttggacagcacgtggaatcatcttgagattgcagcagatgctgaatgctgtgagtgcagaaggcaggccagcgatgtgatgctgcacgaagaacgtaccagataagaacacatcatggaggtgaagtcaactgttgcttggccgagcaaaggaacagctcttgttctctttcgtggcaagctcatcaatcccatgatctggatctggatctaaatttaaactacatgctcgtgcaatgagtttgctgccaatagccaggacatgatagacacaagatgagctagacatgccacttgcactgttacacacacttgattaacaaacataaaattcatcagcttgtcgaggagatgggtggcatccgttgcagcagcacattacttaaatgtaattgagattccaatgctgtctacagagtagagatgccattgcctctgcttcttcttcttcttcttccgttatatatagagataaagctaaccgtgtcgacaccattgtagcataccttctcctcttccaacttcagagagaggaggaaaaaaaaagtattacagcttcctctgaagacatggcattccacctgagatctgcaagtgtgccatcgagccctcgctccaacgaaatcgatatcgaagggcagctccagaacctgaaggcaattgtttcttcatcgtcttcgaccattgagacaatgagtaatggcttgaagaggatcgggaatatctacagctgcatcaatgagatcatgtgcctgccaagcagccatgttgcaatttgccagccactgcagaggaaagcagtggagcaagagcttgagcgctctctcatcttgctcgatttctgcaatgccatgcaggagagcttttccaaccttaagcaaagcattcaagacatgcagctgattatgaagagaggagataatgcagctgtgcaagtgaagatccagtcttatatctgccttatcaagaaggcacaaaaacagttcaggaagatcagcaagaagtcttcttcagttgatctggaaagctgcagggtggtcaagctgttggctgaagcaagagagatagctatcttaatgcttgaaacctcattccatcttctctcaaggcaacttgcgatgccaagttctagcaagtggtctcttgtctccaagacattcaagaagagagcacttttctgccaagaggagcaattgcaagtgttggagtcgaacattgctgatttagacactggagtcaagaatctgttcaggaaatcgatccagagcagagtttctcttctcaacactctcagcttgtagatagatcatataccactttgatcccctgtgactggtgtccaaattttaaaggatctgctggtcactgcaacattttagcaatgtgtatatacattagaggaattgtacagatattaagttgagaaacaaagcacagtattttatctacttcttgttgcatttcatccatgctttgacagaagcacctaattttcttataagatgcttgccattattgcctgttatagaagtagttagcaaagactgttcactctgatctttgaaattatttactattgtatggccacgttattcagatgccatatgttgcaccagcaacaagcaaaggatccttgtgtagtggatcttgctaccacagaaaaaaacaagccagcttcaacacacgaggttgagcgtgtaagcagactgaattgtgcatagaaaaacacctatggaaattaacaactgcaacaaaactagagaacacgcatgccagcaataaaactcaattagcaccccattaaaataatacattgagcacacaaatatgtcaagatccaccagtcaagtgaactagcctgctgattcttgctgctaattgttggaacatgacaatgtgatagctcatcgggaggacacgtagtgcactaaaaatattgaactgcacatgagtgatggaaaagattctgcatgctgctgccagatctcaaaccttgagagcaagttcaatagtatagccaactactagctccaattcatctatagccaatctaatagctcattcatacaatagttacatactacactattaatacctagtcccacctgtcatagacatactgcgtcttggagtccgtgctacagctggctacaaatctgtagcccgctgctcttctctctcctgatttatcttcttaaaatatgtttgcagctggcttatagcctgctattgtacctgctctgacagacagcatctgggaggtgaactggcaggattctgtttgtctaccctccaaatgatgccatatcttacaaatcctctgtataaatagacctcagcacatagctagacacatcaaaccaaaactttcccttcctcatctctcagattcaacagagagacaaagttttagccacagacatggctttccaccaaagatcaattagcttgccttctaggcctctctccaaagttgaagaggagcttcacagcatagaggcatgcatctcttcaccctccctgaccattgagatgatctctgatggtttgaggaggcttgaggacatctacagctccattgaggagatcatgtgcctgcctagcaaccaagtttgctcatctgggcagaggaggttgttggatggagagatggaatgctcccttgagctactggatctctgcaacgctatgaatgaggtcttcaccgagttgaaggccatcatccaagatctgcaagtgtttctcagaaaaggagatgacgcagttcttcaagccaagatccagtcgtacatccacttggtgaagaaggcaaagaagcattccaagaagactttgaagaaggttgtgttagacaaggagtgcaggatagtcaagctcttgagcgaggctagagagaacaccacatctctattcgagtcaacaatgcacctcttgttgaagcaaatcgagatgccaaaattgtccctcatctccagggcattccagaagaaaaacccagtgatttgcaatgaggagcagttgcaggtgttagagtgctgcatcacagatcttgaggctggagcaggacttctgttcaggagattggtccagagcagggttactctcctgaacattcttagctcatagatgctcgtcaagatctgtcactcttaagaccctgtgattggcatccgccttttaaaggatttgctgatccttagtatatggttagacttatagtgtacagaaaaaagttatacatgaaagaaacagaaattttgatctaattcttgtcgtgcgctcaatcctcacatattattgagatatatgatgtgattatgcaacacgatgccagtattattgcctttgtgatgaatataatttgcacaacccaacacatgaactatgaaatatatgtgccaagtaatattgttttcctttattttattatttttatactccaaatgattgctgatatactgatatgccatatggcctcacacatttttcttctagacatgaatatttggaagcaaacaatttgcgctggtccacaactgcctagttgtttatatattcatgtggccatgttacttcacacccgcctaagccaataattagtacatgatcttagttttggtgcatctcacgctacattcatgaaacatgccaggcccaagctacaaagctaaaagcttgcaatcagcacaatattttgtgggtgtgtgttcttagaggtggatcagtgttgatccctccttttatatttgttttctttcttcttaatgcaatgaagcacaacacacctgtgttttcaaggaaaaaaaagttacatcctaaatttgctgcatgatcacatagcttacctagtattgtgttcttgtgtatatattatttttactgttttggagcactgatacacatcttgataataaagcacgttttaattaagttcagaagtaaagagaatttcttttaagcacagaaaaacagtataattatagtgtgcacagcaagacacagattatcttgagacacatctcaagtttatctcagcaaccacaatttaaccatgcaatgtccatgaaactcataactcattggctcaccaggtatgtgcctcgacttggagaaagacatatacttattgagaaagaacaagattttgtcaacttcttgattgattacactgtctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37654 - DNA, 1026 bp, Oryza sativa
ccagaacttgaagaagcaatctcatttgcacgaaaacaccttgaattgatgagtcaagacagtgttctcaaccctccattagctgagcaagtcaagcgtgcacttagcctaccactgccaaggactttcaagagagttgagactatttgctacatgtcggagtacgaacgagaggcaggaaatatcccaattcttcttgaactcgcgaagctagattttaacctcctgcaacatatccacttggaggaactcaaagcaatttctgagtatgcctatctatcaatctctttgagaattctccactggataaataatatgcggctctgtgcatcgtagatataacggctatgtgcatccattatctaaaaatataattaatatgttttttaataataatggaatgaactaaataacttaattattatgtgcaactgaattaacagtatcgatgtgtttttgcaaataaattattatgatagcatgaatatattgtcagtagtaatgcaggttattatataatctctgttttttttataatacctgtcattttagcgttgaattttatttgaagtaaatccacatccattattttggtcttatcacatatccaatacccacaagctagccgttaaaataaaacttagcaccttaattgtgaatataattaatggtcttgtcacacttttgaaataattaatttcagatggtggaaagatctttatggatatatggagctacgttacattagggatcgtacgatagaggcatacgcttggtcctacatgatgttctacgaagaagactttgcattcaccagaatgtttgttgccaaaataattgcactggatactgtgatggatgatacgtatgatgctcatgccaccgttgaggaatgccggcagctaaacacagccatacaaaggttggataagttcagtttgttttattgataacacatatatgataagtgaagacaaacagtaatatcttagcctacaaatattcaaaataagatatccaaatttg

SEQ ID NO: 37655 - DNA, 24632 bp, Oryza sativa
  unsure (1)..(24632): unsure at all n locations
ctaattctcatgcaaaactaattgcagatgggacaaaagcgctatttctattttgccggagtacctgaaaaagttctatattaaattgctaatcaactttgaggagtttgagcaccaagtgtccgacaacgaaaaatacaaggttacttacaccaaacaagaggtagaagcatccaaatatctctatgggaaattttttgttattaccactataagttatattcttatttagcgacaaccaactaaattttgaggtagcgcgtggcaaaaaaaaaaaggaaacttgattttgggtgagaaaagcgaaattacatacttttcaagtgtcaacataaaactaatttttgcacatatatgttcgggtattattatgttgtagttattaattttgttttatttgcttatagtttcaaaggcagtctacttattacctacaagaagctgaatggtcctaccagaaacacaagccaagctttaaagatcaggtggttttgtccaccaaatcctcggccgtgcaattagtgtgtgtggctgctatgattggctggggtaatgcagtgacgacagaagcattcgagtgggcagctagtggtaatgatgcagtcatagcatgcgcaaagattggacgttttatgaatgatattgctgcatttaaggtacatatatagtagtattactctcactgttctattcggcttctggattgtgaaatcaatactagctttatcccataatatgcatagccaaaatataacctcataatacgggacagactgagtagtctgtgattaatagacatttttgtcattgccttttctaatcaatatgtccatcaaaattgtaaaaagtaacaatatgaaattattttttacaataagtctactaatgtcattttcgcttgacaagtcttaataactgtaaatgtattaatttttcatgattttgtggctcgtctacgtatattaaaaacatcatctatttaagaacggaataagtaaaaaaaactcttttcaccaagtagttaaatataattctttttcacattttcatatgcattatacacatgcagtgtggaaagaacaagggagatgttgcgagctccgtagagtgttacatgaatgagaatagggtcacaagcgaggtcgcctttgcaaagattgattcactggtcgaagatgaatggagaaccacgaaccagacccgccttgagcatggtacactgctgcccatggtgcagcgagttgtgaacttcaccgtttctatggtactcttctacgatgacaggaatgatgcctacacatttgccacacttcttagggagattatagagtctctcttcgtgaggcctgctcccatctagaccttaatggttaactttctagccaatgtggcaatccatctgcatgtatacttgtattgaatatgcttttggcttctgttattcatgttaacaataaacttgtgtgctaagctacttaatctgcatgtgtttcattttgagtctgtatgcgtgagcccacgatctatgtggatagccatcgcgaggagtcagttgtgagggcatccgaggctagctcgctgtccgcgtcgtgcgccgaattcaaagacacgtcgtgtggctgtggggatggacgcagctagatcacggcggcagaatcggtcctggtggttgtatttccagtttttgagttgctttttttaaggaagtaaacagaaaagcagcaatggttgcgctccaccaaaatgatttcctctgtttcctctctctcagctatttgcaggtttagctacagttcgcgtgtgttgtgtttggccaaattcccgggctcgatcgttgggtaaatcctgacaattcatgttatcgagtaatggatccatgttttattacttcactaccgtgtacaaaaccagcgtgggccttatgtgattaggtgacggcctacattaccctggcccgttaagctatgttggtatatatcgacgaccggaaccatcctatgattttcgtggggtaagaacctaggtcgaaggcatagcgtgcctatgacccgggaacacggcgcgtgcacatctcccgcgacgtcatgttcgatgaggcttcacagtggaggtgggatggcgagacggcgtctgacctctacaccgactttgtcatcgagtacaacacggtgtaccacccaagcgctaaggctggacaacatcaaggccacaatggatcacccacgccggccgcgacctcgtcacggacgacatcaagctcaccagcacgcggttgaacaccttcggtgcacagagatgcatctgaggtggaatttgtgtcgccaccacttggagctaaagagaacctcgacgctgatcatgatgacgtgctgctccgttaccgcaccatcgagaatgtgttgggatcagccgcgccgctggggctcgcatgacgggaagttctggaagaactgatgttggtgagcggagaagagcatgtgtccttcaggcaggctgagcaagaggaggcttcgcgtcgcgccatgctcgacgaaattgcttcaattgaagaaaacaagacctggagactggttgatctaccgcctggacatcgaccgatcaggttgaagtgggtgtacaaattgaagaaagacgctcgaggggtcgtcatcaagcacaaggcgcgactggtggccaaaggctatgtgcagtgagccggaattgattttgatgaggtattcgctctagttactcgtctcgattctttacgcctgttgcttgcccttgccgcgcaggaaggtggaatgttcatcacatggacgtgaaatcagctttcttgaatggggagctagctgaggaggtatatgttgcccaaccaccgggattcgaagttgagggggaagaaaccaaagtgtactggctggtcaaggcactgtacgggctacgacaagtgccccgagcttggaataccaagctggactgtactctgaagaagctaggctttgtgcaaagcccgctggagcatggtttatatgcacgcggtgctggcggttcgagactgctggttagtgtttacgttgatgacttggtgatctttggagcagatgatgccatgattggtgattttaacaagcagatgatggttgaattcaagatgagttatcttggccctttaagtttttatctggggattcaggtgattcagaagggggtgccatcagtctgaaccaggcagcctatgcgacgaagatcgtggagaaggctggccttgtgggatgcaatccttgtgctacacccatggagccacggctgcggcttagcaaggaaagtacaacgccattggtagatgccactgaatatagaagtttggttgggagtctatgctatctagtgaacactagacccgatcttgcgttcgccgttggatatgtaagctggttcatggagagaccaacggacgaacacctggcagctgtgaagagaatcgtccggtatctggcgggaacgatccatctgggatgtcgctacacaaaaggtggggagaagaagctgcaaggctatagtgacagtgacatggctagcgacattgacactcgcaagagcattaccgtaccggcgtgctattctttcttggtgaaaatttgatcagctggcagtcacagaaacaacgggttaacactctcatcatatgagtctgaatacattgcaacaggaaccccctctagcaatggatttatgtattgctacaagtccatataagtgctgcaaaggtctacagcaacgcatttagtatgtgttgcctatgctggcattgctaggttatacacgttgctgctcggtagtaatatatagataagtgttgtaaatatccgttgcaagttagcaacaaagtgcaaaacaataccagaagatttatatgcactgctattttcaattgccagtgatcattactcacatgacaatatttctattaataattcaccgcaatatgatgtacaactgatttcattttaaaaaaaataattcatatattataagcataaatctcaatattctttacaaagacctcacagagatacaatttgtcaatacaccacaacataatactgactagtctagccttacactaaaaatattttatatcattttccacaaactttgcttcaatattcccgtgttataggcaaatgtccaaaatatgaaatcttcctgggactatttaggcgtgaaagatcaacatttacttgtaagtatcaaagactggaggagataacaaaaaccactgatagtagtaaacaaaatgaaagctagttgattaccttttagttcgaagcatcttcaggattatgtattgtatgtcttttgctgaagaaaatggcacattgaaaatctcagcacttatatactttatttgggaactaacaagaagcaggaacaccttcatcgtttcattaaatagtttttggaataaggtttacatatgaggatagtaggaaaagttgcatgatttctttctttctggtactgaagataaattatatccaagtgtgccgctatggtcttatatgatttccgactctacatgctcttctgtagcaataccaagttatagctgatctaatcaaatgaaattgccacaaaattgacgtgctcaaatttatcactgatgcagtattgtgatatattatgagtatgtatatatacgacaacacttttaaatgctacaagtctaggacaccaaacatgaaagagtttaagacagcaggctggaggcatctttgtaattttctatgttgttgtcccctgcaaaaagggttggcagatcaaaacaattagttgatccagaagttaatacatgtatttgagaattaatataatagatgtaaaaaatctgtgaagtatgtatatatgatcttggttcttgaattaatattactataacgcagtttcagtttcaggaattattatcataggacacaaccccattgtttatgaactccatatgctctcgtttcagtcagaacatggctttgtttgtgtaagtaacataggaaaaattattattagagcttagaagactagggcataggtttacaatatcaatcttataggccttgttatttagaatatcagtattatggaaaaagaagatgaacaatttctgcaatccacatctgcctgtatgtattaatcagcaagatgaaaatactgcttcctttttgacatgcatatgtatctttcgttgtggcatgctcatacccatatatctaagatgattagaggaagttgtagccttctccgtggaacaaaaattagcaacttaactactactggttgattgctgcagcaaggattcgtaaatcatatgcaccatcgacacaagaaaaaaaaaagaaacaaatgaagtagatctgcagaggaacagagcagctcagagcaagaaagaattcaggagcagagagcaaaccttgatctacagttctacacggtccttgtcgcacagctgccgtcgtttctagccagactggatgtcccccatgatctgtgcgtcgccgctcgcccgtcgctgcaccctgccaactcctcccatgacgccgtgcctagcgtcctacctgcgcatcccaccacaccatgcctagagaccatgccattcccggaggccgacggtcggcttgcagccaccgcgccgcaagagattggacgggatgggggattcagcgatacctttcgggatccgcatgcagcagggacttagggttggccagtttgggtgggcttagtgggctgggcaattggggagctcatatggtcaatgcgttgctggattgactcagttactggtagttgtggacccagcaacacatgagagatccgttgcaagccatgtgttggtggaggggggttcgtgttgttgtggctggggagatcctgtcaacactggaggggaacttgtagacatcctgacgagcaaaattccaggaactgcgggaacaaattggtatgatttcggtagactcagcacataaggcttagggggagttttgttaacaataaacttgtgtgctaacttagtttatctgcatgggtttcattttgagtctgtacgcgtgagcctatgatctgtgtgaatagccatcgtgagggcatctgaggctagctcgctgttcgcgtcgtgtgccggaatttgaggacacgttgtgtggctgtggggatagacgcagctagatcacggcagtagaatcggtcctagtggttgtatttccggtttttgagttgctctttttaaggaagtaaacaaaaaagcatcaatggttgcgctgcaccaaaatgatttcctctgtttcctctgtctcctctgtctcagcgatttgcaggtttagctaaagttcacgtgtgttgtgttccgtcaaattcccgtggtcgatccttgggtaagtccatgttttattacttcactatccgtgtacaaaaccagcatgggccttatgcgattaggtgacgggctacattgccctggcccgttaagctatgttggtatatatgcttttgcccacttctttttttccttctcactggtggtatacacacttgggctttctactgggagagtatgtgggctggaatgctggtttgagcagccacatggatttgctgactttacagtataggggatctttttttttttgaacttctacagtacaggggatcttgattttgtggttcgccatgttgatttgtttttggctccaatagcttgaaattctgatttatatgtttgacatgtggtcatgtggagatgaaatgggagctttgaaggagacgaggccaatttttgttagaggtatagcattttgcatggtgacatgaaaatatcattgtgtggattggcggcctttactcgccagatgcctatgaaaagcacttatttttttgtaagcagtgatatcgataagggggcattggtttgtggagcacaattgctctgatgtattttggtgttggtctgagttactttttggtacatcaaagtgattttggtcttaatatgggttactttttggggggttttgattccttttgatgaatggactgggacactttttggttgcaatgaactgctacatctctgcaccctgcacagtgcgggatccgggattttttgttttttgaacgtgaaccaaagaagctattgctatattcctggtggttctgtttgtaagtgaatttttctcgaatatgcaggagaactgcatatcattgcatacacgcaaaccctcacttcctcacaacggttcagcaaaccaccaaaaacaaaatatcaaaacaacaaatcgaagaacaatagcaacatgacctctagctggcagcagcctcaagctacaccaaacctctggtccaaaagtttccttcttcagcaatctgcactaaagctgtatggatattttgggtacaataccaataaatgtataatcattctcatacttccagaacattcatgcgccaatatatgatcagcgtatttatgccacgcttctagctggtcgggatcaccaagttaatcatcagccaccagctacataacacaatatcctccacccttggtgagaagtctggcaacagaaaagcgatagaagagggacaaccaaacatacctagctagagaagacaatgtttgcaaaattgtatggggttgtctcctgctcctggtcaaatcaagggcagtgatttgggtgaggcaaaccaagggtaagtatatcaaccgtccaacgccttgtgcgccgccaaccatcaaatttagaaattgtaagaaattacatggctggctccatattttgccatcaacgagtgctaattgcaagaaatttcatcgtacaggtgatttagtctaataaatgccatcaccgtcagttttctaccgccatctactaagtgataagaaaagaccattttaccccttggtactactagaaaaataatttatcgccacgaaaaaactcgtagtatcaatgctaaaattgtggcaatagattaatgttgctacaatcttaaaatcgttgctagccgtggtaataaatagcgtggtaataggtgttgtcgaaacgacaaccgcatacgtcgaaagacgtggttactcaacagtggttggaaagaaacgaagtgtgttaattttagaattttttactccggatccccccattacatggccccaggggactatttatagcttcattacaggttcttactactagggtttaggttatacaggggaatttatatggttgcccttacgaaagggacatttacaggggtacataatgttatggaggctcatgggtccctgatgggccgtcgggcgatcgccggccctatagcccctaggcttgatgggccggaaaggcttcttcggccctcgcgggggcgaactcgccatggcgaagtcgtcttccttcggcagatactcttcgccttgcacccttcgcctgggacgcctctggcttactcgcacgacccctcgcctctcgccgttcttgctccatagtcttcgccacgggtttcagcagatttggtcgaagggcctcatgccatccgccaacaagcccctcacgggcaagggtgagaatggagcttcggccgagaccgtgcacaccatgtggtatggtacgcggcgccccctttcgaccgatgctcctgccgaaacctacattgttcctgcaaataaagtttgttatttgtacggctggtattattttgccgctcttcgcctcctgcggtcagtggtatatatatttttttacttttcctgggccgaaaggaacagtattgggctttcccttcgtgggcttttttactgtgctgctcggtcgatgggaatttaccgttttgcctacccttgtgacacgtggcgctttcttactggtgggtaggcgaaccatcgcccgggtgagctatatattcccacccctctttccttttcatcaccacacttaccatttttaccgcgtgcgctctcttcctccgttctttccttccacagcgtttcctgacccctcaggtgcttcgcccattctcttccttcgccaacgcatacacaccgttcgccatggcccctcgcaagccaaaacctgctttggcgaaagggccggatcccggccgggttgatgacgacagcaccgcctttttgggggtttctcacgtggacgacgtcgagctggcgaatttggtcagctctggggcgttggttgaggggcaggctttcgccccagggaaagccgtggtgccgaagcctatcgacaatcggacggtggtgttcgccgtcttttttgaggcagggctacggtttccgtgcaacgtgttgttgccggagatccttcgccttttccagttgagcccatcggcgctagttcggatcttcatcttcgaatgggcgtgccggacttccgggtttgagcctagcgccgaactcttcggcgccatatttttcgccaccgtgaactcgaaaatggtgattaccccggctggaacaaagaagacagtgttcgggagcgtgaactttaacgttcgccctgagtggtccgatctctggccggtgaacgccgccatgtcgaagtgggaccaccattggatggcgaggtggttctttcacaccatccccttcgaggctggttctgactcggcgaaagcccttcggtgccgtcgcagggcgattgcgccgaaccggaaacccaagatcgccgtggacggcgctatggaggcacggttcgttctactccgtaaggtttgctcctgccttagttgccgtgacttggtggaggaattttgtatgcttcgcatctttcccctctcccagtcatggcaagtcacggttgatcaagacgaagagattgacggtttgccgaagttggttcttcttgagggaatgaacagtaagactgttatttcgctatgcactcctgtgctttgttatgttgccttgttcgacatttaatgtagctacaccctttacttttgcagtgttgactctcgaccaggctgaagccgaagcccgcaggatgatcggcgatgtatcggtcgtcaagtatagcgagctgctgacacgacaagcagctggccgggcaaactgggtttacaacagtgaattgcctccccgggcgaacccccacaaagccgacgacgatgcaggaccttcgcgaaagcgaacgcgcggacaagtgaagcttgtccctaggaagcgaagggttcctgcttcgtcggattccgacgccgacgacgaggatcatgccgaagagcatgacggcgaggaggaaggggaggaagaagaggaggtggaggccgtggcgaaaaggccgcaaacgaggcgatcgaagaccgcgtcgacacccctggctacactcctactccaagtcccggccacaacgagaccggggtggagtcgaacagctccccccttcgacgaaaggatgtggaaggggcgaaggccctagttgcgttctcgtcgagcaaggcggcgaagggaggtccggtcaagaagatctctaaaaagaaaggactcgtcgacatcgctcgcgtttttagtgacgacgagtcttctgacgagactccgacttcacccgctggccgcagcctggacctttcgatcgcccccattcttccactcggcgctaatggggcaggcagcagcgccatcaccggggcttcagcctccgccgaacggatcatgatggctgcggcgagggtcttcgggagccctctgcgtgaaccagctatttcgccgttagtcaagacgaaggggaagggtgcggccgccgaagcatctgcctcggagtattcccttgcggcgccccacttcgcccctggtgatttcgagacccgggcggaccttattccctttgtggagggagtaagcaatcttgtcctacctgccagcaccccgagcctattcaccgaactaaatgagttcgatgaggggtgttctgctattaaaagcttggtagttcgggtatgctttttctcccttcatcattttcctctccccttttcttttacctgtctcataattaacattttgttctcttcgcccgctcgtatcttgcatccagattcttgcggctcactgttcgacagagcgaaccgcgtgggcccgtcttgacggatttaagaaccgtcttcgggccaaggacgacgaaataagccgcagaacttggagatggaggcactcgccaacacactcaaagaggcgaaagctgaaatcaagcgcctccaatccgagttggagaaaggaaaaaaggctagggccgaggtcgattgcctcaaggccaaactggagaaggggagagaggccatagcggaggttgatcgcctgcaggccgaattgaaggaggaaaaggcccattccgccgtgctgactgattactataacctcactgagccgaagatggaagctcttcgcctgaaggttagcaaggccgaagcgagcgttgtggatgagtcgcagcggttttcgcgggagatggcgaaaaccatcgaatccgcgagaacggcttgccaaacgctccgcctcgcgcttactgacatgggcgcgaaggtgcgaggggtctctgccgaagatgcctcagctttcgacttctccgagtggacccagcaggctggcggttcggtttcggactgtgccactacgtacggcaattgctgtgcgcgtgtatcagcggccttcactttgggccttttgcaacagttcgtctgcgagcacgtcgccgagttccctaactatgcgaagggggactgggagattagtgcgcagaacattacgcctgctcttcgcgcgtggcgaaaacagttctggcagaaggacggcccgtccgctgccaaggcgcggcttttggagcaactagcaaaggcggaggcggcagaccggagcgaagaagaggacatggcaggcgaagagggtggaggcgatgcccaggatcacccagaggtgtgaggccctccgccctttccttagatttttgtagttttccttcttctttttgcgtttgcctgttgaggcgaacgatgtatattcggcaggctgccgctaaccctccttactgtagccaaaaaaggtctctcgtatatttggaatgtatgacacaatcttagccaccttttgatggtcgaagtctttggcgtattattatttcgctcatttcgcattatgccataccttccttttttttcacctattcttacaatgtaaattgtgttttgccctttctgcactgtctaccagggtgttcgccgaaagtcgtgcattcggcccccttctgggagctggcgaagtcaaaacgagaaatttgtggcattgaagggtctgccgaaggtccgatgcccattttggcctttttatcgcgaaatggagataaacagtcgcagctataaggtttttaaggttgccggctggctgcgggcgtaccccaggcgaaccttagaagactacgaccttgttcattcaagacgtttggaggatatggctcgcttttggcgaaaccatcagaagactaatcgtcaggaagcgatctctcagtgtcgttacagtttagtcagtgtttcgccccctactcctcttagggttgtgtatgatattagtagtgatgacgaacctagttcgcctgaccattccttagggagagatagtgactacgggggcgaagatgtaatttacttgtaagctgggctgtattgtattgtaaaccttctattcttcgattattttttcgaagttaataacgatgtgttttattcccttttcgctatttttcgcattgtcacattttgtgcttttgttaggtcggaacatgtcatcccctttgcgtatattagcgaaataggtgtactgacttttcagcttttcgtcgttcgttttcgatccgtagcgttctgtgctgcaagaaacgcttttgtttttatgttgatcgaatgtaacggcgttcggctagttatttttcgaaacaagctgtggcggtttcaacgttcagcgagcgatgcttcggccgattcgtttcgcccccctggcctttttcgttgatcaggtgtttgccttggggtttttccacaaattatcaatcacacaaaaataaaaagaaggcggaggacacaagggttttatactggttcgggcctccgtggtggataatagatctacatccaattttttttgtcttttttcattttcctcttttttttcttttttttttcttgccgaaaggcttacaaagtgtcgaagggcttacatgatgatatgtacatttttacaagttggcgatttggatgccacccgttctagacatagaagcgcttgagagaggcggcgttccaggaatggtcgaactcgtcaccttctagtgccgccaatcgaaaagatcccatcctagacttgtgcttgatgaggtatggtccttcccactttgattcaagcttgccaacagcaatcgggttcgctttcttccttaggacaagatgaccaggcatcagctccgtcggttgaacttttttgttgtaagttgccgaagtgcttgtggtatactggcgcatgtgcttcgactcttaccccctccaagagttcgagcgacacctcgcgcccctcttcgcccccagagaacatcacccttggtgagttagcctctagctccgctggggtcattgcctcatcgccacaaagaagcataaacgggttaaacttggttggtcttgtgggggtcgtccgaagggcccagagaacagatagcacttcctctggccatttgcccttcgctgccccctcgagccttttctttagtgcttctaggatcttgccatttgtacgttcgaccgccccatttgactgcgggtgcacgactgacgcgaacctgatttccaggttaagtccttcgcacatctctctgaacttgtcagagtcgaaccgcttgtcgttgtcagtgatgaactcttttggcactccaaaacggcaaacaatgtttttccatacaaacttttgtactgctgccgaagtgattgccccgaggggttcggcttcaatccatcgagagaaatattccacagccacaattgcgaacttatacccgtttcgcgccaccgggaacagcccaatgatgtccagtccccatctggcgaagggccagattggcgcaatgggctgcaaatcatactagggcacggtttggcttcggccatgacgctggcaactttcgcacttcttgattttctcaatacagactttcaacatagtgggccaataaactccttgtctaaacactttggaggccactgttcttgcggcttggtgcgcgccacatagcccctagtgtatctcctttgccatttcctcgccttcggcgaaagagatgcaacgaagtaagggttgaagtaccccggagcgatagcgctgggccgagaccatcttatacttcgtggctctgagttgcaagcgctttgcttctgcttcgtcttccggaagccagccagtttcaagatgtttcacaaacggggttcgccagtcgtatgggtcttcgctcagtttcacctgatcgattgccatgacctccaagctgtccacgggcacacttggtgcatacaggacttcgaaaaagatgccaggcgaatgtgggccactagaagcagcagatttcgccaaggcgtctccttcctcgttccggcctctaggtaagtgttcgaccgttatgccggtgaagcacttttccatggaccgaacggcctccaaatacctcttcattccttcttcttttgcctcgaaggatttgtcaacatggcctgccaccagcttggagtcggttcggattagcaagcgccggactcccagtgctttcgcctttcttaggcccagaagaacggcttcgtatcctgctgcgttgttggttgtgtcgaactgcagccttgcagcataccgaattggcacaccattcggcgaaatgagtactgccgcaatgcctacccccttgtgcgaccacgaaccgttggagcacatcacccagaattgttcgacaggcttgggctcgggggtgaatactggtgtccattcagctacgcagtcagctagcacttgagacttgacagcagtgcgtgcaacaaaacgcaaatcgaacggggatagctctgccgcccacttgctgagccggccagtaacttccttgtctcggagtatttcgcccaaggggtactatgatggcactatgactttgtgggcttggaagtagtgcttaagcttgcgcgaagccatcaccagggcgtaagcgagcttttccatttcaatgtatcttgtctttgctccttgcaatgcttcggagaccaaatagaccggtttctggccgaactctgtttcttggacgaggacagcactaactgccaccggcgaagctgctaagtatagtagcagtttgcttctcggtgctgggcttatcagagctgacgggctttgcaggtattgctttagctcgtcgaacgctgcttggcattctggtgtccaattgaactttcccgagccccggagggtcttgaagaagggcaaacctctttcggctgcctttgagaggaatcgactaagtgccacaattcggcccgcgagcttttgtacctcatgtacactcgacggaggcttcatttgctgaatggcgtcgattttcttgggattcgcctcgatgcctttttcagaaacaaggaagcccaacagcttgcctgcgcgaacgccgaaaacgcacttctcaggattcagttttatgcctgctgcgcgtaagttgtcaaaggtctcctgtaggttggacacatggtcgaaagccttgcggctttttacgacgatgtcgtcgacataagcttccacgtttcgccccaactgcttgcaaaggaccttgtacaccagcctggcgaaggttgctccggtattcctcaggccgaaaggcatcctgaggtgacaaaatgtgccgaatggagtgatgaaggctgttttggggatgtcgggcgggttcatgtggatctggtgatagccggaatatgcatccaggaaactcatgagttcgcagccagctgttgaatccacgagctgatcgatccgtggcaaggggaaatcgtctttcggacatgctttgttcaggtctgtgaaatcgacacacatgcgttttttgctggttgacttccgcaccagcactggattcgccagccactccggatggtcaatctcttgaatgaccccggccctgagtagtttttggacttcggctttcaccgcctcttggcgatcggcggacatcttgcgcaacttctgttttcttggcttggcatctagcttgactgccaggtgatgcatgatgagatctgtccaaacacctcccacttcgtcggggctccaggcgaagatatcaatgttctttttgagcacctctaggatgctcccagcttcttcttcacccatgtcgtcccctagtgatacgagctttgtggggttggcatcatcaatctgtacctttattatcttgctgtgaggggtgggctttggcgcgtgcttcggtcggtcatacggttcggcctcaacattgtgcacttctctgttgattatggccagatcgccttttgaagcggccgaaggctgaagccccttgaccactatcactcctgtcaggccgggcatcttgagcttgagataattgtggtgggaaatggcttcgaacttgttcagggttgcacggccaaagatggcgttgtagttgtacgggatgtcgacgacgtcgaacagtacttgctcttcacgtctgttctcccccgagccaaaagctatcagcaaaagtgcttggccaaggacttgaactgcctctccgccaaaaccgcgaagcgatgctggtgctggggtaagggcttgggtgggcaaccccatcttggcatatgcttcagcgaagataacatcggccgaactccctctgccgaccaggattcgtcggacttcgaagccagctctctcggctgagatcacaagaggatcttgatgcgggaacataactccttcggcgtcttccgacccaaaagaaattagctggttcagatactgcggcgtccctttacccgccgaagtgatgttgtggaccgttcggatccgcatcttcttctgccgtttggacaactggcttggcgggtcagcccttgtaatcacttggattacccttcgctgtgcatcttggcgttgttcggctgggggtgctttctcctgaactgcttcacgaggtgcttcgacagttgctccctgctacggccttggatcttgcatgttgccgcgttgcctaatgtttcggcattgctccgtggtgtgcgaagagcgtccgtggaaggcgtagtagaggtctttttggaccttcttgcggaccggctgctgatggttgcttgcttgctgggcgtcgaactccttgcggagggcttgcacttcttcaacagccatcacagccttgcctgcatggtcggttctgaacttcctccaggtcatgagggcttggccttgccttggcggctgtccttgaatcgccggctaaggctagcgaacagcgaggggaggtggttcggcaacttgaacttgtgcttgagcttgagcagtggcgacggaagctttatcgtactcagcttgtatagcttgccgtcgcttggaatcctcctcgccccttgcgaaaccgcaatgatgcgaagtaggtgctcaagtgtctgtggctccttggtggcgatttttcttgtgagttcgccctcgagcagaccagccgaagcggcatttatgaccgatgcctcggttatgtcttgaacttggcaccgggcttgcgagaagcgacgcatgtactcccttatcgactcccccggcctctagcaaatgccaagtagatgttgctacgtcttcggctcctcataggtgcctcgaaagttaaggacaaagacatcgcgcaattgctcccatgagtaaatgctattggctggcaaattgaaataccaagaacgggtgatgccgtctagagcgagatgtattacctttgccttggtattttcgtcgccatgagccgcttcaatcgcggactcgtagatggagaggaatttcttcgggtcagtttcgcctgagtagcgtgggacgggtgggaatttgaactgggctggaattggacgagtcttgattcctccactcagcggtagccccttttcgccccccgccctatttacggcaccttgctgtgggtacggcgtggcgaagggcgaaatcacggcttgtgcatggggttgggccatggatgggtcgaaagttggctgttaccatctcatggaggcttggattggtgcttggtttgctccgaagcctggagtttgtgcttgctaccgaacggttggcgcctgagcagcattgatgaagtcgaactgcggtccttgactccatggcgaagcccccagacctggctgatttgacggcaaccaactaggcgcaccttgacttgtattcccctccgggcgagccaatggggttgtacttgaaatgttgtggggttggttgagctgctgaaggaaagcttggagctgcgactgcagagccgaagccccttctgccattgtttgtggcacttggccaggtggctgatggtgcacttgggcagcgaccggctgagcttgcacttgcatgtgaggggccggatccgctgctgcgggcgatggctacccggcgaagtacattggcgcttgcgcgacttgtggcggaaggtgctaggtcggcacttgcggatggacttggagtgggacatatcctgtcgaatactggaggattggggcccacgtgagcttggttcgccttgccgcctcgtatgcttgttgttgttcttgcatttggcaaagcatgtcttggagccgtgccatgttctgccgcatggcttccatgtcggcttcggtttgtgcttcggggtcagggttgacttggacctgcccagcagcgagcggagctgaggccgctgccagctgcgatggggcggcttggggcaccagcagttggcttgtcgaaaggatctccgccctggtctggagtgcccttgccgccgcagccgccttcgccacgttggccacgttcgacacctgcacagaggcggcaagggccgaaggcagtagtgatggcgcagatgcggaagcagatggcgctcctccatcttcggccacgggcgccgaaggctctgcttcctcttcggcagccatgtccactccggcgtcgctttcctttcgccttgtaaccttctccttcacgaccttcttctgtggcattcgctctcagatgtttcgctcggaggtccccacggtcggcgccagctgttgtcgaaacgacaaccacataagtcggaagacgtggttactcaacagtggttggaaagaaacgaagtgtgttaattttagaattttttactccggatccccccattacatggccccaggggactatttatagccccattacaggttcttactactagggtttaggttatacaggggaatttacatggttgcccttacgaaagggacatttacagacaagaagcagaggaatgcacattaacagatggcgaactccgcttttctcggtgatggcgatcgtgatggcgattagccatgatgcctccctcgccgccgagtgggtgggatttccaccctggtaatgagatcagggatcagtgtcgtcgtctccatggtactccggtgcactcttcttctttctattgctttcatcctttcaaattggtggtggacgtcccccgttccacttttcgtcttgaggagtcctctgttgccattgctcttagagcttgtttgggaggttcccctgctggattttttgtttcgcatctcaatgatcggtgttacaatttctgtgttcgtgacaaatctgttggtttgtggatttacaacctccgatcatatatttgccgtgattatcacatgaggtttttcttatggcgtgatggtggtcctaattggaggtttgagtttcgtcggtgggaatctgagcagctcagtgagtggtctgttgttaagagaaagaaatctatgtctgttaaatcaaagtctgttactgttgcttcatcctccattccaatctctaaggtttttaaccgcttccatgttcatgattcctctcgttcatgttccaaatttctgattgcaagctcatcagatccgaactctcagaatccaatctctgggcctaaagtttcgaaggttgttgataaaccctctgatccgattcctaagcctactcccagtgctgggcctaaacccttgggtagtggtccattcaaacggttttcccctagggttcgaaaagtctgggttaaaaaatcggttgtcaagcctaagtccccccgtcttccactctctgctgctgcggaaaaccccttttctcgagaaagctctccgtcttcaatggcgaaccttcatccaaatcctctccgattcatccctcccggactgcatttgcacccagctgggcctcatcgacgccggcgagtggactcagttaacttcactccctcaatcatgagtcatgagcagtacgtcttggctctggtccttcctccgttgcctgaagatcaatcggatgagcatcgtgctgagattagggagtttcttgatcaggtcaggaatattcgtgtgcttgcttccttcccgcatccgaatgctgtcgctttattccagattagttcacctgttcatcgggatgctttagttcttggtgagcccattgcttatgatgcggttcatgaggtctgttttgttagacataatcagggtccgaattggcgtaatgctccctataatcatagaggttgggtcatgttgcttgatttcccgctggactatgttactttgcataatgtgaaacaagtcatttcaacctttggtgagctggactggtggtatgattctgatactctcaagggtagggttttggcaagagtatggtataaagatttagactctgtgccacagtatgttgtttgggagcaaccaaatgctccaaacggccagtcatggactatctatgtttataccctaaatggtgagtttgctgatgctttccctcttgatgatgatctgccgatgggtgaaggtcctgtgtatcctaatgttaattttgaggatgttccagcttggcaatttggtaatgtgcagaattttgatcaggaagagaatcagggttgggataattgggatgagggtcaggacaatgtgaatgacaatgttgattttttgcctgagattccacagcctactgatgtgctacaaattaattcctcctttgctagttctattttagctgtcaattcaggtaactctggttctattatcagtatttctagtagtgaagcaagtgagattggggctgacaatagcttgatggtccaggaagtttcctgttgatgctaatgttttaaagaatttatgccagaggtttcctcagattatgtttgataagaattttgtcaaggatgcatccttttggtctgccttaaactctggaagtgttcttggtacttctagctgggcttcagggaatgatgttcctgttgtttctggggctaatgaaattcttgatcctgttccacttgctgttgcgccgcctcctagtgtttttttagccctcactgattctgacgccccagttaaaccagcaaaaaggacttacaagaagagagcagttggatctgccactcctgttgttgctacaggattaagaagcagcaaaagactccttgctatttttgatgcacgcaaattgagttttaaggatgatattcttgttgagcctgatcctaatcaaggaattgggaaacctaggggcaagtctgtaaaaaagctcaagcaggttgctcatgaggtgggccttcttttctcaggaagttctctgcaagaatctgacttcatggaaggtacagctgaagtggaaggtcctgctgattgccctattcctctcctccagaaaatggccactgatctttgtggtgttgctcctcaggatgtgacacaggaaagcctcctggcttctgctccaaagtctgttgatgatgaatcttgagtttctaagtctggttctgtttaggtttcctaggaataaatctagaactttgtcttgttctatgttccttagccctagtggctttgtttatcttcagttatgttccttcgtgtcctatgtttcctctccagactattgctctgtagtctgttctagcttgccccctttattttttgcttggaccagtcagctcttggctttggaatgtaatttaattatgttctatttaccttgttccttatctactttctatgagtaatcttacaagaaattggaatattctgtgttggaatgtgagaggtgtaaattcagcggataaatgcagagctgtcaggcaagctgttgatgatagtagttgctcagttttttgtttacaggaaaccaagaaggaaagttttgatactgcttatgttaagaagttagctccgaaacgctttgattctttctctttctctccttccgttggagcttctggaggtatcttggtctgttgggttgttgcaatctttgctgctaatgttatttgtatcacccggtctgctgtgattgtaaagttctttccaaaacactctgctgagtcctggactcttgtttcagtctatggcccgtgtgttgatcctgatagatccctctttgcccagtggttgtttgatttgcaaattcctgacaatgaaaattggatcctcttgggtgactttaacttttacagatctgttgagaacaaaaatagggcaggttgggatatgaatgacatgatgattttcaataatataatcagtaatcttggtctccttgagttgcctttgaaaggtaggtcttacacgtggagtaatatgcagaattcacctctcttggagcaacttgactggttctttacgactgtttcttggactgcttcctatccaagcaccttggtaaagcctttggctagatctatttctgatcatgtcccatgtgtggtccaaatagaaacttcaatcccaaagtctaatctcattaggtttgagaatttctggatagagcatgagggtttctttcagttgatttcttcaatctggtctaatcatgggactggtttggatgctgctaagaatataacatcaaaatttaaatctcttagaaaaggtctcaaaaaatggagtaaaggcttgtccaagttgtcctcactcatagcaaactgtaatctggtcatagcctttattgataatcttgaggagataagagatttgaccttggctgaatggaatctcagattcattgttaaaaggaaagttttgcagtacctgagatataagcaaatgtactggcagaaaagatgcactataaggtgggcaacttttggtggtgagaatactaaattttttcatgcagcggctactgagaggtacagaaagaacttaataactcacttgcagacagatgatggaagagttttaacccagcacaatgaaaaggcgcagataatttttcaaacttttcagcagagaatgggagtgtctttgctacctgttatgcactttgacctgtagagtttggtttctcacaatgatagtcttacccacttgtctgaaaacttctccatctctgaaattgatgaggttgttaaaagaatgcctactgatagagcacccggtccagatggttttaatggatgctttattaaaagttgttgacctattattaggcaggatttttacaccctttgtgctcagttttgtgaaggtaacttggctttggaaagtttaaatagatctttcattactcttgttcccaagaaatcaacacctgagagggttaatgactacggaccgatttctctccaaagtgtggctctcaagcttttaacaaaggttcttgctgataggcttcagtctgtaattacagaactcatccatcaaaaccaatatggtttcatcaaaggcaggacaatacaggattgtctctcttggtcttttgagtacttacaccagtgccaacaatcaaaaagggagatagtgctgttgaagttggactttgagaaagcttttgatactatagagcactctactattttggacatcatgagacaaaaaggttttgattcaaagtggttgaattggattgatttgatcttttcttcagcatcttcttcagttcttctaaatggggttcctggaaggaatttttattgcaaaaggggtgtaaggcaaggggatccattatcacctcttttatttgtgctagatgctgatttactgcagtctgttgtcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37656 - DNA, 10221 bp, Oryza sativa
  unsure (1)..(10221): unsure at all n locations
tggttatgttggttgtcaccatcacattgccgccataatcaccctcattgttgccatcgcatccaccggctgttgctgcttccgcaaatgccgtcgccgtccgtatctgcagctcgagtgggaatggagaagaattgtccaccccccctccccgcgcgtcgcgatcaccgccaccgtcaccaccgcagatgctgacgccaacatacattgccacgctccaggagtcgattcgacgcacccacgcggtgccttgcccttcgaacatcgatgctctttggtcattgagacgcggttggtagcagcctaggtgataggcgcacaagcaagcagccctagcatatggcccactaagggctagacaaaaaactcgtggctcattaacttactcatctcgtgactggctcacttcgctcgggtcggctcattgggaattactaacaagtcaagccaagtattttgctcgttaggcataacgagctaactcgacttagcttgcaacctaaatgagctggaacccaacagcaggcaaccatgaaagcatggcctagtaacagcccaatcagccacaaggcccatcacaacccaagtaacagtgtcaaaaccctatgcaggcaaaacaacagacacaaataaaaaatgcggccggtgctggaaagtacaatcgcaaagagcatcaactgccacatacccttctgaattactatagcatcgatttgtaaaaatacaagtctcgtgatcatcacttttcctatctgaatgatgcgaaaattaactattttaaaattctaaaaatcatcccaactcggtttgatattgcaacctattttgtttggcatatagcaaaacttgctgcgacggtaattaaacatcttttagtaattctatctatggtatctcactgctgaagaatccttttgtactccctgttcataactgccaatagtcccggttttccaaccgggattaggaatccgggactaaagatgcccatctttagtcctggttaaaataacctggactaaagatgccaaccatgtttagtcccggttgatgttaccaaccatgaggactaattttttttcttttttttctccttcggttttttcttttatttttcctcctttcatatcttttagtaattctacctatggtatctcactactgaagaatccttctgtactccctgttcataactgccgatagtcccggttttccaaccggggctaggaatccgggactaaagatgctcatctttagtcctggttaaaataaccgggactaaagatgccaaccatgcttagtcccggttgatgttaccaaccgtgaggactaatttattttctttttttttctccttcggttttttcttttatttttcctcctttcatatcttctcattcacagcacgattcacagattcatcacaaatacatcacaaattcattcacaaacatcacagattcattcacaatatcgattcacatattcattcaaaacatccacaaatcaccacatccacaaatcataaacaaaataaaaaaactaaaaaaaaaatcaaatcaccgtccgaccaccgcccggcctcccatcctgccaccggccggccacccatcctactacttcccctccggccagatctggaggaggggagggcgaggctgccggtgaccagcctctatcccgccgggccaccgccggccggcctccatcccgctggcctgcgcccggccacccccagcccgcgcccggcctccatcccgccgccggctgcctctgcttccgccgccgcctgccggagggtagtanggggagggggaggggagggaaggggaggagganaggangtgagaaaaaaccagggtaggatggaaggagaaggatggagatgagggaggagaagaaaaagagataaagatgggagatggaggctgcgcatgcacaggatggagagagtgaagcaccggagatggtgcactcgtgcgggtggacatttttcttcctggttggtgttaccaaccgggtataaagatcaacttgatcttcaatccctgttggtgttaccaaccggaactaaagtttccatctttagttacggttggtaacatcaaccggactaaagatcccctggggcctgacaaactctaacacaatcccaactgggactaaaaatcatctttagtcctaattgttattaccaaccgatactaaagatcgcatagtcctggttggtattaccaaccgggactaaagatcacatagtcccgttgcacttataaactggaactatttagtcccggtttataagggaaccgggactattgtgaaatttggtcgaccgaccaaatatcatttctctagtagtgtctccaaaagaagtgtcatgactatacttctataagtatttaattttggtaaaaactatattcataactcacattttatgagaacatattgattcggctaagcatgtttgaactggggtggttttacaccacaactaagtagtagggtggacatttgtaagaaaaagacttatgaggtagaatgtcagaacttaagttatttttagagtggtttttataactttaagtcacttgtttcattcctactatgttttttttccctgagggtttagtcgttatcatagtgatgtctctctgccgcttcaagaataaaaaacgaaattataatttattttccatttctttaaattaatcattttcaccatttaatagattgattgtgggcctcctccgaagaggataaattataaaaacaaacgatattttaggtccattgtacatgagaacagtgtaatgcacattttcgtggcggaatattatatacgagtacctattattacaggaaatcgtcggtatcttcttaaacaatgtacatatatagactgataaattaaatcatacaaaattttacttatattaattcacggctttcatatcaatatcagaaagttattagtaaagctacaaatattcatacttattttgcaattagaaatctttgttttaatcgggtaaaaaatttgaaatcccatgttaaacaggaatacaaacatgttataaaccacgcctatgccattttttatagacatgaaaatttgattgttggatccacagaaaaaattatagcatcgattcctagttttgtagcactactacgaaaacattttttttctagatgataccccgcacgttgctgcgggacatgctcaaaattcagctattggttaagtaaaaaaaaagaatatgctatccattgggtaggacatgcatcctcaagctggaaaatttaaaagataataataaatagattttttgaatcaatatttttttagtagaggaacagaagttcttaaaaacaatatatgttaacacattttagctaaaacttcaaaagatgcgatattgtttgggatcatgagttaacatacaatgttgtgtgtttactcataaaacgttgtcacaatgtagtttacattatagagggatagtttacattgtacagtgacaatttatattgttctgtgaacgctagccaactaaaactcatttcaccgtcttcctgttaaatggtctacatattataattttggtgaggctttcaaatttattgtgtggatctacatataaccatgaatccaataaatattatttattaatccataagagaaaaaaatcaggaaatacaggaatttcagtaatacactctaatggtgatgacaccacaacacttaatcaacatttaaattttttattgttgggatctagggaacacataaaaaaggttgtggtaatctgcttgctttgttgcactgctccaactctagtatttgtttaaccgttcaagaaaaaaaaaactctgtttaatgaagagctgaaaggttgaaacagaggatcgcataacgataagagacggtggtacgaacaaactgaaaagcacagtgcctgcaatttcagaataacatcagaaattgacaacaatatatagaatgtgcaagcaatttaacatgtaaaaaagataaaattgaagcaagaaataggtgaatgcaaagcaaatatgtggccaactaaacatctaatagaaacttccaagtgatcaatctaacgaaaacatgcttcacaaaagataaaactgattggccaagcatgatcacaagtagcgatccatgcgcaatgggagatcgaggaccgatgaacgaacccgtgcggccgtgccaccgattgagcaaagaatagcgtgtgaatatatcccactggttccttacattggcgtgtgggtgtggatgactcatctggtcgcactttttataggttatgggtgttgccgtcgagtcgaatcctattgcagttacgaaagtccaatcaatctctaatggctaacggttccaagaagaggaagcgcaagggaggagatgggggtggcagaaaggcggtagccgaatggcgcggttggcggcgacgctcgcacgcaggcggaaggatgctttgttgccgagaatagggaacggcataagggtggtgggctgggccgatgagcaagatgggctaggagagaaggggaaagggaaatgggcttggagaaatacactggatggagcgatctaggccatccaagcttcatcctatggctaaatctaattagggatggaaaataggtattaattgcagtttttggatcaattgtacagatatataggatgtacgggcaaaaacagtttttatgtgcggaggtggcgcccgtctgcccggaagtgtcttcaaaaatcagggattctctgtgcgggtggcgcacccaaatgcggaaattggatttttgcgtgcgggtgcttatgtcgaccgtacgcgaaaataaaaatccgaaaaaaaattaaaatcacgaaaaaaaatagaaatcgcatattgccgttttccgatcgttactgcgctgctttaaataataaccgtcacctccaagaaacttcacaccgtcacttccgttttcaccgcctagaccatagctgtcttccacctctccggcgatcccctcggcgaagaaagcaatctcaaaagcaactcccgttccagcaaacttctgcctgcaacgatgtcgtcccccgctagttcatccgcagctccatcgcctgagtacgcagaggtaagcccttaccggccaaatcccttttcttgtgcagcagatcggttttcctcctctcagtttgttttcttctttgcatctgtagcacctttcaaatttggttgcgattccctgcttagcccacgaacatcagtttttcctcggtccgattagtgatctagatccaacagagctcatcatcgccgaaaccagtaggatctcatacagaataggcaaccccaacctaaaccattggaaaaacattttcaaatcttggccctcattggagaaaagctggcccgcatggtataagcatgtatcggctagcaagcaggttcactggaatgaactaggaatcagccaagcactagcccttaccctggaaaattcagctaaggacgaaactttgatggcttctgccacgtacttctggtccaacaccctcaacgccttcatgttcaaccaagggccgatgtcacgccttgaaaattgcataatttaataattcattctttaatgcatttttagaaattattttaaaaacctacaagttaaactctaattatctaggaaaaattgcaacataaaattgagttagataaaatttctttaaatactttgcatgtttatctattttctagatttttctgggaattatttgagcaagtaaagtatttttaataaatgaaacattatttcactaattattttaattgaaaaagtttttaaatcttcccctaagccgttgggctgattccacctcatctccctcctttaggtgcgcagctgtgcagcccaagtcagcccagccgagcttccccttctctttctttctttgttttattttcagccagccaaaactgaaagtctactttgcctccctttgcactgttcttcttcaacctctggcagccgatatgagaccgagttggttcggtttttctcctccaaatccggccttttctcttgtgttttcctaaaattagttgaggggaaatatttcccttatctccctctttcgtttccctcaaaaaccgaagtttaattccttgtattttacccgaatcaaattcgttttcgagtttatttctccaaactaaccatcggattttccggctcaaatcctctcgtatggagtccgatctccctcacccatgcctatataaagcatcccctagtcgtcctcttccgtttgcctcaagtcttagccgcagccgttgcctgtagcgccgccgccacgtgagccctagcgtcgctgccgccgtcgctgcttcagccgcgccgcagctgtggtcgccgctgccgccttccgtcgccaccgtcgggttcgccaggtggaggagcatcccgtccgccccttcgccgctgctgcatctcgcgtgagcgccgccgccgacatcaagccgagccgtgccgctgtcggagctcgtcgccggtcgtcgttcgtcgtatttctttgcaccggtgagttcgcgtcgttgtcctcttcgtgtaggtgccttcggtttagccgcccgagctctctatcgtcggcggagtcgtggtccagtgccatggctgcgatgatgtcatcgatgacatcataattcccttctaaatctctaaaagcttttctgtattagatgaaatctgattaaaacttcggaaattcataactaaatcatcgtaactcggattcaggtggttcaaattgctaatttcacctaaaatcgagatctacatgataaaaatatccacatgtactgtttatgcttgtttttttactgttttattgattttattcatttgctttagtttccgacgttccggaggagagcgtttacgttgaggaatgttcagaagcgtttgaagaagatcaaggcaagtcacacagatcccaaacaaccctttgagcatgttgaacatgtttaaagctaatgctttatttcaacttatgcattatttttcgaatgtcatcgggtagtgagactttcccagttaattatggccgaagatgactttattttcctatgggtaataaattgattagcttgaaccttatatattggtttggttcagctaaatgctatatatatataattgcttagccatgcttagaaacattagctcattaatgggatgattacactacattattacacatggatatatttaatggtagctcacgatggttaatcgtgttatgaaaattaattgataattaaaatttaatgaatgatgggttgtgagtacatggttttgatggtcatgctcagtcgtgagctactgttgtgcaacattaaccgtaccaacctcaagccagcgtgggcaacggctttaccttttgtgtagcatggttcattacggggtgccagactgagaagcggcaagaaatccatgggggtcgctggggagtccatgcctttggttgtagagggggttattatgattcaggtatggtgcactatggtgagttgtattgtacgaggggtactgtcacagttcctttccgaggtaccgtggtggtattgaggtgcatggtgacatgttgtggagctgtgtcttgtgggtacagtggtacatctctggctagagtaaaactattcaaatagccgtgcccgtggttatgggcaggtctaacaatgtttttcatgattagtctcacactacttatcattggtgataataatgtgataattaatttgactcctggtttggaatggtatattcctggtatggaggtttgatttgtacagccggggttggttgatttgtactcctggctttgttgtatagtgtttatttaatattgcttaattactcaactgttttactattctctcaaatgtttattaaatgttgtttatgcaaataagctatattgtgccatcctttgttatcttgtgcacttgcatatttgctgtgtggcttgttgagtatgtcatatgatcattcttgcaatattcattcatcagagaaggagtacttcagtgaaggtgatgatcaggaggattaggctttgttcgggtcaagttgcttgtggagtggagtcgccatagctgtttagtcttttgtttattttccgctgcgtagaattttattcttttgagaggaactatccacctctgtaataatttattattttgcgaatattaattagctgtttgatagtactctattatcaatttgttattgtgtgcctcggctgattcctggacgaggatttaacacacatgtaagcttttggaatttttgatagaaattctgggcgtgacaaattggtatcagagccaccttgaccttaggacaagtcaaatggtaaatcttaagtagccttcaaaatattttgaaaaataggactgctcttctctattatcttctaaattaattaagttggcagcacatgcaagttaggtacaaaattttctaaatcctactttaccaaaacagaacctgttcttttctaaaaaaagactttactgttcagggtattaaatagtttaattttatgatttcattggttagtcggcactgtagtatcgattcaatcaagatagcactagtactactcatccctgttaatggtgacactgtaccgtgcttatgatagatcctaagtatttagttttattttattaatttatctaaagcaatttatctctgtccattgttgatttttttcttccaaaacaaaaaattttgtttcgttatgttctggcgagtactgtacaaaaaaaatatatttgcttctttttgtctacttccaaagtctatactcctgtttaaataaaattctcgggaaaaaaagttctgaaaaagaaaaaaagaaaaaaacgaattgatttctgagaatttatgtttcggtcagaaaataaaaattcgaaatttaattaaaaaaacgaaaaaaaaattagttttgtttgctccttttcttttatttttctttttggttcaaattaattgagtctagattgtgcagctaacttaagtatatgcattaattcttcctttctatgttcctttagatgccgccccatccaccggaaagcttgatcgatgcggtaggattcgtcagggagctgagaatgatggcatttgaagtaggctacgacgttgcccccgagtatcgccaaatttcatgtgaccccaacgaggagaagtgtcgtgttcacgtgacattgactagtgatcgtgaagaccttccgtcaatgatgtttgaagctgggggaagaaagtacagtcatgcttgtcaggaggcagccttggtggccattcgagagctacgtcatcgctttgatgaggaattagtcatcagctttccagtatcatccacacaagcatcatgatcaaaactatggagaatacaactgctctgaagatgaagatagcaccactctgaagcatgccgtgtatatgctttgcgccatggatgcagttggcgtggagcgggagaaagcagctcatgagagggaaatctggaaccgtggcaagattttcaagctagagagcaaggtgtatcgcttgcagaaggaacttgccaagctcaagagagaagcaccgccgtcaactaccccaaaggaggaagatccagaagaaagagagctagctaccccagaggaagaagatccatctcttcgctccgacgcaaggcgggattagtgcctcgttagaccgttatcgtagttcgttgtgttagtttgcttgtgcgtgtgtgggtttagcgtgttgcttacatcattggtgggatgtaactacatgagcttagttcttttgcttgtcagagagtaaatttgctggtgagatagtgttaattcgatttaaatgtaatcatacacagttaagaacaatagaaattaaattaattaagttatccgttctaagggtatctctctgtcgttctcccctcttgcccgtgttttcttcagatggtgaacactcgcaccggaggaagtggaagtggaagtggtaacaatgaaggaattcctttcccatccaaacttatcttgctagaatccaagatcttgatgttatcttagggatggatgggctaacctgtcacagaggagttatagattgtgctaaccataaggtgactttatccagtagcaa

SEQ ID NO: 37657 - DNA, 1020 bp, Oryza sativa
gaggatataccaaagactgcctttacaacacggtatggtttgttcgagtgtaccgttatgtcgtttggactcactaacgccccggcctttttcatgaacttgatgaacaaagtgtatatggaatatctcgataagtttgtcgtggtgtttattgatgatatccttatctactccaagacaaaagaagagcatgaagagcatcttcgtcttgctttagagaaactacgtgagcatcagctctatgccaagtttagtaaatgtaaattttggttgcccgaagtgaagttccttggtcatgtcatctcagctggaggagttgtcgtggatccaagcaatgtggagtcactgctaaattggaagcaacccaagacggttaaagagattcgtagtttccttggtcttgcggggtacaccgcaggtttattgagaacttctcaaagattgctagaccaatgacttgactgcttcagaaggatgtgaagcataagtggacggatgagtgtgagcagagttttcaagaattgaataaaaggctagtgactgcgccagtgttagtcttgcatgatccatggaaaggtttccaggtgtattgtgatgcatctagacttggtttgggttgtgttttgatgcaagatgggaaggtggttgcctatgcatctaggaagttacgccctcatgagaataactatccaacacatgatctagagttggcagctatggttcatgcattgaagatttggcgtcattacgtttttggtaaccgtacgaagatgtatacggatcataaacgtttgaagtacattttcactcaacctgatctgaacatgcgtcaacgaagatggttagagttgattaaggattatgatatggaaattcattatcatccaggtaaagcaaatgctatagcggatgctctcagtaggaaaagctactgtaatatgtcagaaggacgacatctaccttgggagttatgccaagaattgtaaaagttgagcttgggaatagtcaagaatggttttg

SEQ ID NO: 37658 - DNA, 6327 bp, Oryza sativa
catcagaagctagccggtctgctgcaaccgttgaagataccagagtggaaatgggaggaaatagggatggatttcatcaccggtctacccagaacgtcgacaggacatgattctattttggtagtggttgacaggcttactaaagttgttcatttcatacctgtcaaaacaacctacttaggaaataagctcgcagagttacatatggcaagagttgtatgttcacatggtgttcccaagaaaataatgtcagacagaggtagtcagtttacttcaaagttttggcagaagctacaagaagagatgggtactcgttttaatttcagtgctgcctatcaccctcaaactgatggccagacagaaagagtgaatcaaattttagaagacatgttgagagcttgtgtttagatttcggtggaagttgggataagaatctgccgtacgctgaattctcttataacaacagttatcaagctagtcttcaaatggctccgtatgaagcgttatatggtcggaagtgtcgtacaccgcttcttcgggatcaaaccggtgagcgtcaagtttttgggacagacatgttgcgagaggcggaagaaatagtgaagattatccaagaaaggttgcgtgttgcccagtcgcgtcagaagagttatgcagacaatcgtcgcagggatttgactttcgaagaaggggattatgtatacctacgggttacgccgctgcggggagttcatcgttttcagaccaaagggaaattgtcaccgcaatttgtgggaccttataagattgtgagtcggagaggtgaagtagcttatcaactagagttgccttcgtcaatggcgggaatacatgacgtgttccatgtttcgcagttgaagaaatgtttgcgtgtacctacggaggaagcagatcctgagcgtatagagcttcaagaagatttaacttatgttgagaagccagtccgaatttcagaggtaaatgagagaaataccaggaatcgcgtcatacggttctgtaaagttcagtggagtaatcattcagaagaagaagccacttgggagcgagaagatgaattgaagtcagctcatcctcatctttttgccagttcttctgaatctcgaagatctgcttaacttcagtgcaggtccaaaatcttgcctttaggttcgtgagcgtaccggttgatttgatcatgcaatcaacaagaaatcgtttgtgtagtagtcaggggtttttatattccgattaatattcgtcaccgtattcgtttcgcttcgtattcgctccgtatttgtatttgataatattcaatttcgtttttatatcagagtttccgatttctatttcgatttcgaacaaaatataaaaacgaatatgatagagctagtttctaaccgtattcgatccgttttcatccctaaatgcgtgtaggctgccctcttttttctcagttggatgggatgctgctatcgtcgttattgctgtcagtctctccagcccagggttttctgtttcgaaaaagcaagaaaatttcggtgggcaccgaaattctgaaattttgaaaaattcggatattccgcacgaacttttttgaaatttaaacacatttttactgaatttgattaaattatgaccaaattcacaaatatttggaaaaaaaatccgaaatttcgcttgaaaaaatctgaaatttccatccctgctccagcccaccatgtcctcatcctctatgcctcatatcagccacactggagtcctcatcctctacgcctcctgctccagtcaccggcaaaaagcgtcctcagcgatctctggctgcatgtgccacgctgcctgccaccaccagccgtgagctcctatttctgcctccgtcggcttcacctgcagatgcacactcgctgctgccaatgatattggaatgtaggatgcctccaccactcgccttggctctttctgccaccgccctcgatcgactccggccatcgtcgccacacttagtcagttataacattaatattagcaactaaattctaactttcaacgaccaaaatttcatgtcattattaccggcacttgacaaatagcatctgtgaaatttgaatttaaacctggatccattactgaaataacatgaataacagaaatcgaaagaatatttgatataagtatatatgtagatggattgccatgttggctggaaaattaacaatcaaggtctagatgggaacaggcttgacaaagagagactcaacgatctccctaagaagtgtgccaaatgtgtatgcatccttcttgtcatcgtagaagagtgccatggaaacggtaaagttcacaattcgctgcaccatgggtagcagtgtacgatgctcaagtcgggtctggttcgtggatctccattcgtcttcgactagtgcattaatcttcgcaaaggcagcctcacttgtgaccccattctcattcatgtagcactctacggagctcgcgacatctctcttattctttccacgcttcacgtgtatattacatataaaaatataaaaagaatagaagtttaaatagaaaataactattggaaggcaatatttattttacttgttttgttcgtaatcagatcatgtttttaattattatatgtagtcaaggctcaaaatataactcactaatatatgcaaatatattaagatttattatgtgaaaatgccattataacttgtatgcttattgtaacaaataccttcatattgtaatgttttcataattttcatgaacatatattgattagaaatggcaatgttaaaaatgtgtattaattagaggttattgatttcataacacacaactaaaatagaaatgcaaaagtagtgacatatatgtaccttaaatgcagcaatatcattcatgaaacgcccaatcttagcacatgctatgactgcagcgttgccactagctacccactcgaatgcttctgtcgtcattgtcccaccccagccaaccatagcagccacacacaataattgcacagctgaggatttggtagacaaaaccacctggtctttgaagccaggcttgtatttctggttcgaccattcagcttcttgcagataataagtggactgcttttgaaactataagcaaaaaattaaatcaaaatcaataactacaggataatgccatcagaacatatatgtgcaaaaaatagtcttatctccacactcgaaaagtatgtaatatctatattttggtgtgtgtgcgcgcgcgtgtgtgaggaatatacagagagagagagcgtgtgtgtttctacctcttcttttgtgcaagcaaccatgtatttttcattgtctgtcacttgatcctgaaactccttaaagttgatcagcaatttactataatactttttgaggtactccggcagaatagaaatagcactcttgtcccatctgcactagttttgcacgagagttagtcgtgctagatacattatttctcattttaatgatccctcaattctttctttcttgtcaattaagacatttacatcaactgatccagagcatacatttaatcattatcttttctaatgatatgtccatacctcaaagtatttgaaatataactgcatgaaagtatttttcacgacaatctaatactccttctgatcccaaatataagtcgttttaatattcccaaatatttgccaaaatacaattcgtttcaggaattgtatgaacttcttttatattttcttacctcgacaattctctcacaaataattgacgatttctttccaatgcagaataaatgaaggacaacaaagtcatttgaactatttattagttcttgtatccaagtctaaaacaactatatttagaatcagagggagtaatgtcacgccatagaaatttgatatcttcttcgatatatttattagtaggctaagatgttacaatttgtcttcacttgtcaggatgttatctattttggaatggataaagtaccaataaacaattaaacatactgaactaatcctacctttgtatcgctgtgttaagctagtggcattcctcgatggtggcatgagcatcatatgtatcatccatcacagtaaccagtgcaattaatttggcaacaaacattctcgtgaatgcaaagccttcctcatagaacatcatgtaggaccaagtgtacccctctattgtacgatccctaatgtaacttagccccatgtatccataaagatctttccaccatctggaaaataatcattccaagagtgtgcttagacctttagttatatgaacagataaggagctaatcattgttttacagtgctagcttgtgggtattgggtatcccatggataatttttcaaaatatatacaatgtcagtgtagttttgcacacaacaagagcattcttctgctccaagataataagtgtatttactccgaataaaattgaatgctgaggtgacatatattcttaagaaccagatagtatatgataacatgcattcctacgaacacctcttgccatcaagtacatatgtgaaaggcatggactgttaatttatttgcacttaacaattttagttatttagtgcattccaatattatctcaaatgacctgttaattatccttttagataatggataaaccagttgttgtatctaagatgcacaaaaccatctatcatttatctatagtcaacaattatcaaagagatcgatcgacaggcatactcagaaattgctttgagttctttcaagtgaatatgttgcaggaggttaaaatccagccttgcgagatcaagaagaattgggatatttccttcctctagttggtactccaacatgtagcaaatagtctcaactctcttgaaagtccttggcagtggtaaggtaagtgcacgcctgacttggcaagctaaaggagggttgagaacattgtcttgactcatcaatttaaggtgctcccgtgcgaaagtgattgcttcttcaagctctggctcgccatgaatgaggaggtgagccgcgttgtataaacttagtagcccccttgggtcattcgctatctcatttcgaaacctcccatcatctcccttaaatttgttgaatgcatctgcatgacaaaaatatttctcattgataactagaaggttgggttattttttatccataatgcgactagtttttcccgcaatctacaaaacgctttttgctgtacccaacatcaaattagaaccctctgttaattttcttacgttgtgtaagctgtttgttttagactgacaaaaataaattattgtgtcttaaacaaattaacaaaatgtaagttttagcaactatcagcaaatgcaaagataaaaatatctaatcagggaataataaattgttggtatatataactgtagatacaaatagaaagagctgcaaacatctcctaaaaaaagttttaggttggctactaataactgtatatttgatcttattgaactacagaagaagcaaaaaccagcaagacctgtcccacaaagtttggatcgtctatggtgaatcagaatcaataacgatttttgttcggcacaaatttatctgttccatattcgtagatggatgtatgcagttggatacctggaggcacccaaaacccatgctccctaagcaggcgaaaccgaagagcaacctcatagagactagagcttgtgaattcactctcatggatgctcattagagcatcttctatctgctcttggaagaggtgaacgattccaagatgttgaatggaatccactaagttcatcctcgccgaaatgtcattgcaggtcccaaacaatgtccggatgtcccctttcaacttctcggccctctcctgcatacatgtctctgatctctgcttgaaattaagtatagattcatcagaacagttagttagcatcgcattaatcagaatgcaagggcaatgcatatatgggaaataacagtgtggtaatgcctgtaatggttgtggttcatagttgataaagaagtcgccccacacagagggctcaaagccgagtacctcctcatggacagcactgtctctcgacaccataatatgtaatacttacgagcaaatatgagagattagcttgatctttatgaatgcaaatgtgtggcacctcaccttatatatagacacaccagaatactgtagttatgtgctctgtccgtttttgttgtatgacgtgcttttgaacatgacattcaaccgtttatcttactcaaataaatattgcaaatatgcaagaatataaatcatgttgtttgtcaaaagacaacactgctctta

SEQ ID NO: 37659 - DNA, 17607 bp, Oryza sativa
attcctgcagccctattttcaaaaacctgcttattatggaaccatgggataatcctagagtttcctttacaagttgttctacattaatatcaattgattgggaaggttaaatggatactcactttctagccttcatggatctagtgggccgtagctgagctgcttctttttgatgggcaaagctgaaagctactttcctgtggccaactcatccgtagcgatcttgcccgcctatggtggttttcatcatcttcggtggtgcttcaccatctttggtaacctttggcatcctcaatgtccttggtagccttcgccacctttggctgccatcattacctctggtgggatttgccactcttgatggtcttcgtgatctttagtggtttcgaccatcgttagcggtctttcttaccttcggcctctacattcccttcagtagctgccagctgaagtagttcgtgacctcccaaaacaatgctaaaggacactgaatgataaaagaagtaaaagtaataataatatgggtggtcagacatcatgtccaaaggtgaaaaatgttatacatttgtaaattagagttatcactaattactttaaaggatcgtcaaagcacgtgtaggggcggcttatgcgggtgggcagccaattattgcttgcttgtaccattacccatacatgagagttgcaatcatgtcatatatcgagtcaaatgcgacgtctcttgtactccctccatttcaatctaattacgattcgagcaaccaaaagacaaattaggagtgtgattgaaaatgactttagatagctgtcatgacattacatatgggattgtcaggaatgggagcatgggcgaatttaatgttggggcttgttggggctaaagccccagctccaacaggacagggaatagcgtgtgctagagcacaaggcaggagaagcaggttgcagggaggagcactaagaccctgtttagatgagactaaaacttttaagtctctatcacatcaaatgtttggatactaatgataaatattaaacgtagattattaataaaacccatccaaaatcttggactaattcgcgagacgactttgttgagcctaattaatccatgattagcctatgtgatgctacagtaaacattctctaattatggattaattaggcttaaaaaattatctcgcaaattagcttttatttatgtaatattagttttgtaagtagtctatatttaatactctaaattagtgtctaaataaaaagactaaagttaagccctgaatccaaacaccacctaagaagaagctggtcaactagtttgctagtaggaagaagctggccaggctccatagcttggctttatccatttagacctgctaggcttatagggtgtaggtcatgataaaaatatgaaatcatttttttgggctttaggcataaacaaacaactaatttattctttattgtcaacatcacaaaccatttttatcttttttggtgttttgatactgatttgaaaatttgagtattacgttgctagcgtaaaaattatcttatgttatgtattaaactcaagagccccagcttaattttcattctagattctccactgattgggagagtgattgagaatatgatggagaaaattttgaataaggagaagttacattgcaagggaaaaatattactgtaagaatatgcttattttagaagaaagttctgatctaaaaaaatgcactttattagaaatgggtgtagcacatgaaacatcttcaccgacagctgtggatttttatatgcttttaattttggcgagtagctacaggagacaggcgactaaagtaacaagatacaggctgcacacctgatatgattggctgaatgttcacacgtgatatgaatgatgtattgtttatagctactgacgcggacggcgtctgctggcgtttctcggtgctgatcgacaggccgcctaccgatttctcaatccagcactacttaataaaaaactaatagaagacacccatatatatttggggaaaatccaaatacccccctacaagtcactgctctttctactctcccccctacaacttaatattgttcaaaacactacacataagttaatttctcttccaatttcccacccctattcggttttcacgctttctcgtgatgcgctcaatttctcgttatcatgggccttcagcgcaacccatggatggagttgcctcgtgccaccttggcggcaaaagtgcgcgcatctccatccgcttttaattctgcgagccatacgggtaggacgacatgacgctaacataaacacaggaaaacaatttttagtccaccagtgcaaaacaatagtgtctgcctcatgatttgtgattccacatcaatatgaagaatggcaacaccaagtcaaaaacacattccagaatatttaagacatgcttattgaagtagaatccccttaaaaatcacaattcaaatctgatagttagaagtacagaaaattatttgtcgtaaaaaagctggtactgagattaagaagggaccaacatcccctactaattgtagctaagaattttgatgtaaataatactactgcataaaaataggagatcagtttctcctaatttgcaactttcttccagtaggaccgatataaggcccatgtggcacatgatggtagagaccaacaccaaatgcattgtacatatatactggtggctatgtggatgttgttggaatatcatctcttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccattgtgtctcatcaggaacgggataaatcatcccacaatatgttctcgcatatgcatcctttgtcaatatgtcatcaacatagctctctggcctttgcatgaaaccttgaatagctgaaacagcatgcaaacatgggattccagttaaatcccattttctacacccacaagtgtgcttgttcaaatccactacatattgattaccaaatggggacacttgccaaatgcccctaccagcacacacagatttgcaatatcttgcctcgttcttctctgcctcaagcttctttaatatatttggtgggatttgccaattgtccctttctgcaccttccctcttattattgaaatcacccttcatttttgtccttatgtgctcaaccatggtaattatgggttcatctctagctcccagtatctttgaattgtatgtttcacttatgttgttaagaagaagatctgtctttgctctagaactgaacatatatctacaccaatgcttagttggaaccttgcttagccactcccatgccctcaaattgttagcctttagttattgcatagcagcattgaactcagattgtctatatgcatatgctgctcgttccatcaaacccttcagatattcccctctaaatcctgcttgggaaaaattggcatgtaggtgcctaaggcagtaacggtgctcagctcctgggaaaacttcagccactgccttgagtagtccctatatatggcagcaaaatgttaaaaaaacagttgacatgtattaatgcaaagtagacatatatgatagctattaccttttgtctatctgacatgaatacccagcccccaaactcttctccttttccaatggccttctccaaacatagtaagaaccatgtccaagattctgtgcactcagactccactaccgcaaaggcaatagggaaaagattattgttggcatccctaccttgtgctgctagtatttgagaaccattgttgagtttgatgtgacatccatctataccgatgaagggtctgcaaccacctaagaagccagtaatttgagcatcaaatgacaagaacaacctttgaaacctaggccttatttctggctcaggtgatacttcgcacttaacaaaaactttgcttcccggattagcagatagcacagcatgagcataatcttgaattcttttaaactgcaaatcatgatctcccataactttcttgtaggcctccctccttgccctatacgccttacttatgctgacttctacattggtatctcgcctgacacaatcttgaaaggcatgtgcatcccatttcttgtcagatctaaagaattccatgtattcattagtaagccatctccagtcaagctgtgctatattgtgtgatttcccacagctatgttttgaaacatacttctttattttaaaggtgtcttcaccaggcaattttgaagcatatatgtaccaaggacagttatctgccttacacttgacagaaacttgattcctatcattcttgcccttgaacacctccctccccatgttgatgatcatattcttcaaagcagctctaaaaagatcaacattactgaacaacatgccaacttgcatgtgtggacgccgtagggtggactcataaaaaattatatcttcaattcctcttgatctgtgcacatagataggtgcttcgtcattgaaatctattgtgtcatcattgggctcatctgacaaataatccacctcagctgattggcctatatccttctcttttctcttgttagtttttttccctactagttctttttcctgtgtagtttttccccgatgtggttctgcttggttaacctctacatctacctggttagtaccatataggtcctcagtatcagagtctccttggaagaacattactggctccttgccaataacaggttccttgccttttttcttttccctcaactgttgctgtacatactcttcatgcaatatcaaatcatctttatcaaaatcacctgggacactattatgatgtccaattaatgggatactacttgggcttacaaaccttgatgtgcttccattatcagtcaccaattcccgaggccttgcaaaaaagtacagtgagcactctgtttccgtcttatgatcatccaacatcatcttgatttgttcatcatttagaatctgtacaagaccttgtggagggacataagaaggcttcaagtagtatacaccatctcctttttgatatccatgtataagcaatgactcctccaaatcgataaatttcagagaatccctgtctaaaagataaatcgatgaacaaatcctttccccaccagatttcctagagcttccaccagttgtacaaccagtatgaacaatgaaggaaatactagttcgacccatctgcagagattataccaatttattggtttgcaacctaaatcaaagagcaaatattcgatgatctgaatctagtaagacaactacatgcataaaacatgatctaaccaaaaccagggagaaaaaacgaacctgtagaatgaattgacgaggtgatcgaagtacaggctgctttagtgcttcccttctatgacttctcttgccgggcaggagatttgatatcccttctctgtactatgcgatcatcgtcgtacttcgccgttgtaccgctgttctttcgccgccttagtgttgcagtagagatcgcgaaattaaagcagggaaagatggaaagtggaaggaggtgcgcgcgcttttgctgccaaggtggcacaaggcaactctacccgtgggcggcgctgaaggcccacgataacgagaaattgagcgcatcacgagaaagcgtgaaaaccgaataggggtgggaaattggaagagaaattaacttatgtgtagtgttttgaacaatattgagttgtaggggggatagtacaaagagcagtgacttgtaggggggtatttggattttcccctatatatttcggttcatctaataccagcataaatgaggcttttccttgttctcctgaccccttaaatggatgtaaaactaaaaaccagcacctatatataacactttcaagttgaattataaaaaaaaaccaactataataataaaagtgctatgttttaataaaccagcatctatataagcgttggtttaaaagaaactaacacttaaatggagccaagatgagtcgagtgcgtggagtgtggaagaaaaaaataattctttgttggtcttatccttatcctcccagagtattctcattcttatcatctccatctcacttgatccccccggcacggcgaggcctccttgatctcccaggtgcagcggtgtccgtgtcttcttccgctgcttcttcctctcccctgcatggcgaccatcgaatcaggctaatgggagctcgtccttactctcccagtcaatcttccctctgtcaatcttccctctcttctctagtgaggtagaggaggaggcacgggtgcctctggtggtaatgacagcttgtgctgaaggattgggcggcgacggcggcttgaacaggcaggatctagcggtggcgggggttctcacgtgtggatatggcggcaacgacaactctattagattaaatgggccaagcataatttaattctaataaattccatgccgcttaattaatgttaagggaataataccaccttagtaatcaacatggagggatctcaactaaaataggctgctatccgagggtaactgttgagcgcttgatctggtggtgggactgccacatgtgcacgcatgcgccgagccgagctgagccgtgggcgagggtgaggtgtaagggacgggacgagacaggacgggatggattcctctgtcgatgttatgatgagggagttaggtcccgatcttccgatagatattgataaacagtcgatttgggcgaagtcacgacacaactcgatccggcttttgaacgaacacgctactgagccctacaatcgcggcaccacgtctcctctggttatcaaccgtaccaaaacccggttgaactcaccaagaaggctaatcgctgcatgcgaatcgaagaacacaagcaagaacaagatagattgcaaccaaattgcatatgaatgattaagcactcgaatttggggttccacaaaccgatctagcggcgaaactgttcttgacagaataatctatgcaaaacccaactctaaatgatgatggctacaagtatgattagggacgtcctagggttgccctagggcgcacacccccatgggctaagcccacgacacaattaaaaggcccaaaaccgaaatcagattcggactggatgaaatacgtggcttgttttgcagatttccggcagctcggtaggaattttcatgtgggaccaaaaccatctgaaagtagactccataagctttccatcaagtactcatgggccccaaaattccttctagatcagcggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataacaagtaaatctaatatagaatatatgcacctttggttgattaatacgcaaggtagtcatggttatattcgagctagttgtgtcctcatcattctccccttcttgatttgaaaccgtcctcagttttaccttgtcatagagcgtattgaacttatcattatctgtctcaacatccggtgaggaacatttttcgatggccatatggttggatcctgaaatcttggtagtcgaaaaaccaccacactccccttcttgcagactaacatgtaactcatttaaacagctagaggaactagatagagaattacttatacgcatgtggtcctctagacaacacatttcatcatcaaaaggaggtatagtcaaattcgaacaaatatatactcgatgcacattatattctcctttactatcataattgccaataatatgaaaaatcacatcagaagggcatggcagttgagtggacaaagataatcaaattaaatataaccccaagtatttaaagaagatagcaatttaagctcttcattctcgctagcaatgtgaataacatgtttaaaatcaacacatggtggctctactatagaactaacatattcattcactagttgtggtatggatataagtgaagcatcgcacaactcttctttatcacaagaaacatgaaacaaattgttttgtgacaaaggtatttcaacaattgtttccactatgggttgctctaatgtagcataagtagtggacatagttggcacattataactatgcataccttgagcagttgtagcaccgttatctttaccatttttctcatcttcagaaattgtaggcgcttggtcaattaaacattcctcaagcatgcatgaagctatggataggtttttttcctcctcatctttcttctcttcctcattaccttggtttttctcagatgcttgcaaaatattagtattcaaagcaataggcacaacaatacgttggtttggtaataactcatacttagttaaaggcatcgcaatattagtatcattccaaatatctctgaaagtctcattgattctattcttcaacctttcaagatcatctttgaaaagtttagaaacactcattggtactaattttatttttcgaccattatgcctaaatgtgtatgtattggcaatatcattatgcaaaacattattatcatatatccatggttgacgaaacaacaaagaacatccttgcataggtacaagatcaaaatttgcaatatcatggtaacttccaatcgaaaattttattctcacagttctatttaccttgaacttaccacacgagttgaaccatttgatgtaatatggatgaggatgcagttgtatagacaactcaagttcctcaaccaaatctgaactcacaaaattattgcaactctcactatcgattataacacgacatgctctatccttaaccacaaacattgtttcaaataattcgtgatactgcctttgctccgctttctccatttgagaacttagcatttgttgcaccaaagtactttcatcacgtgcatctgcggaaggtgatgtagcagctatggtttgtctcccatccaactttatctcatgtccataagagatgtaacatgccattgtcagtagaaaaaagagaacaacataacattattgttcctattaactatagaacatggattgtagtggaggctagcaaatggaagcgtcttaccgagctcttacaagtgtcttaccagcaatgctaaggacagtacaaccggtggcaggttagtgacaccttgaaggacgtgatgtggcgattgcaaggatcaaagcggtgctgaccagaagaatatatgtggagcttgggaggcacaatatatagtagaaaaggaacgcaattgtgctaataagaaaatgcaaagttgaataatagttcaaagtactagtcaatgtgctggcctagcctagactcaactctagctcaagcaagcacccgacaacactaaggactagatatgaatcaatgcacaactctgcactctgaaaacatactcaaaggatgaatgattttttttctttcttggtgcaactttttttaagcacctttctgcctttttttcttttctttaggtgcggatttttctttctttttctttgcacctttctgcctttttttctttttttttattttttactattttttttcaacaagcactaacaactgacctcaaacagggactcaaatgtaaatatgaatattatagggactcaaacgcaaagtgaaaaactaaaattggatcacctcaaaaatggaatgctcatgtcacgtaggttctgtttttataaaaatatctctattctacaaccaccaaaatacccaacaatgtggtgaccgaggaggaggcagggaagaaaccgtgaagaggaggtggggtggttggccgtgaagtggaggtgttcggccaaagaggaattcggcagaagcactggcaaaccctagccgcaactccaaactcgaccgacaaaaacttctgaaaattacaaaaacggaatctcgacgacgaaacgattcaatatttcaaggtcccggcatcaactgacgacatacaaaactggtcccaaactgacggataactcacacgggcttgagtgatgaaccctagacctaagtgaagaacatatgcaatactcaaaagtagaaattaaatctaaaaactaaaccagcacacgacacgacgatgcaatctagaattcaacaaagcaaaatctaatagaacaatgcaactgctcaaattgtctaggtaaagaataactatttttgtgtgacaattttctggttatgggaagataaattacctaacgggcaacaacgctctgataccaactgatgagggtgttaggccccgatcttccgataggtattgataaacaaacgatttgggcggagtcgcgacacaacttgatccggcttctgaacgaacacgctactgagccctgcaatcgcagcaccacgtctcctctggttatcaaccatgccaaaacctggttgacctcgttgagaaggctaatccctgcatgcgaatcaaagaacacaagcaaagaacaagatagattgcaaccaaattgcatacaaatgattaagcactcgaatttggggttccacaaaccgatctagtggcgaaactgttcttgacagaataatctaagcaaaacccaactctaaacgatgacggctactgattaagtatgattagggatgtcctagggtttccctagggcgcacacccccatgggctaagcccacaacacaattaaaaggcccaaaaccgaaatcagattcggactggatgagatacgtggcttgttttgcagatttctggcagctcggtaggaattttgacgtgggaccaaaaccatctgaaaatagactccataagctttccatcaagtactatgggccccaaaatttcttctagatcaggggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataataagtaaatctaatatagaacatatgcacctttggttgattaatacataagatagtcatggtgatatccgagctagttgtgtcctcatcacgttacgatttgctttgatgaacaacaacgtaatctggtttctcgggaaaggtctctgttcttctgttcctgagttgcgcatttgtttccccggtgttcttgagttgtgcatttttttcctcagctccgagcatatatgcatacatgtacacaggatgagcaggcctctagaactccgtctgcttgagtacatgtataggtaggcagtcgatcaagtttttgggagcacgttctccgcatgactgctcgcggtactgcatcttgttcaccaaggtattctcctctacatcacgatgtctaccaccagcgctggcgctactggaggaggagggaacattagtactggaggaggcgaaactgagaacatcaacatcaacagaggcaataccaatgcctcatcatcctctgcagcttcactggtactagaggaggcgaaaccgagaatgtcaacatcaacggaggcaataccaatgcctcatcatcctctagagcttcactgcgtatttcactaccctcatcttagtgctaaacatattttcagatgctttgttccagctagcatattcatgtttatcaccatactaggatctagtgtttatgtcatatttattatactaatttctagattgtaatatgttgaattatgactagatttccgaaagactcgtgtggccaaattagttggcgcctggtgagctattgcggcggcagagttccccacagctgtggaggcatgaagttttgattgttgtattatgtgagtgacttcgtgatttgtttccttgcactggttgattcacatatatgctattgattgtaggatattcagttctgtgattgattatatgcttttgttcttgttcttgtgctttcactactaaaaaaacgttcactggtggccaaaatagcttgtcactggcagccgactgtaccgccagtaaccaaaggccagtgaaaataaattcatttgtgctgacggtacagccggccgctagcagccacgcaaagacagccgctagcgaaaatcgattttcgctggcagccaagctaagacgaccaccagcaaaaataggattttgttggcggcaatgttaagatacccgctagtgaaaatattttcttggagaaaaaataattccaatcacaaatccccaatccccaatccccaatcacaaatcacaaatcacaaatcacaaatccccaatccccaatcgccggttgctgtcgtcgagctgcgacggcaaaggagggagctcgctgcagatgtcgctgtggctgccgcggttgcaattgtcaccgtccgcggagccgcagttgcctcccgccgagccacggtcgtcaggtggccccgaactgctgcatcgtcgggagaggggagggggttggaggatcaatcgccgcggctgaatccgctgcccgcgccgctcccgcagccatctggcggccggtcgaccatcgccgcggccgaatccgccatccgcacgcttccctccaccgcccgcgcttgtcccgtgactgaatccgccggctggatccgctgcccgcgcaagccgcatcggctccacggggatggctcgacgaggaaaggggccatccaccgtcgccatcatcgtccctgccttggccgccgagaggaggaggagaggtgcggccgtgggggtcaaggacaggaggagggcacaggggagagggattggggtgaggaggtgaggcgcagggagagaggggttgaggaggaggagtcgaggaaatggggagatgggggaacgggaaaaggtgtgagtgaagttttaatgtagtgaaataaatatttgttggcagtggccattagcagccacgagcgaaaatcatattttcgttggcagtaagttaagaggtccacttgtaaaaatacctctatttttgcaagcggatctcttgagtgaccgccaacgaaaattgattttgctggcggttggtaaccggaatccattttcataagcgcattttcataaaacccgtcggtaaaaatgaaacggtgatgctatgaaaaatgatttttttagtatgtttcgttctggatgtggaagatgaatgtttggttgtagagatactccaagaaatgccattgacaagcgtccaagtcccagaaatgccatcgataagtgtaagttccaagaaataccatcgtacaaacgattttgtcccaaaaatgctatcgtcgttagggttctgtccattttgcgtcgttaaatacactgttcatcctatagaacttaatggcgcgaaatagacggaaccctaacggcgatggcattttttggacaaagtcgtttgtacgatagcatttctgggatttagacacttgtcaatggtattttttggattatctcttgattataggatttttcaatttatttttagtggatttgatgcatggagcctgctttttttttcaaatagtacgaaccagatgccttggttcttaaaccggcaccgttagacctcttatcagtcgcctgacaggtgctagttgtgaatccgacaccaaacatcgatttctatccggtatctaagtgggtttgtgtacaatagtgcaggctgaccaaaagctccccagcagttgaggtttttcgagtatttgtttcactagagtatttttccatgtttccagggtacacttaatcgttcagtgggaacagtatgtttcccgcatatcagaggcttttagtcctacaagtctagatagcgtatgtatccatggttgtaaaaaaaaaagaaaaaaaagaaagaagaagcttcagaatcgatcccactattgaggaaaaatacaataatattattttctatatcaagtaaacccgtgcatattaccattacatgcaacacagacaaaatgcattcagaaatacgtctcattgcaaagaaaactatagaatgttaacatccaaatttaacatctaagcacgaaataggaaatcattcgaatttggaaaggactgagttttcttcttggtgatagtcagaccgaagcctatgggctagtctgactagctggtggtgtgcagtggggctggtcggacagactgtatgtagctggtcagactagctaagttcggttccaagtcgaatttcatcaggtctagagttttcttgcctgcactgaggtttttcgagttctacttgatctctaccacaagtaaaacatggagaagaccatgcagaacagcagaaagcaagactaacccctttgtaagagctatgaccggtataatcgagcacacattctacttccaacttagccaattgaattattttttcaatattgtatatttttcttttgctagttctagtctagattttgtggccataaaagttgccaacacttaattacttaactagtggccatattacaacacgaaaggataaactatcatgatccatcacaaaatattgcactagtacagaaaccccctataggtgccggttgggaaccggcaataggtgccggtttcctcgccggcaccaattggtcggtaccaataacactaggttattggtgtctgtcatataaccggcacctttgtgctctccccgattaaaaaaaaaaagaggaaacctactcctagccgagccgatgctttaagtctcacagatcacaaatcaaatccatcacagatcatcatcaacaacaataaagctttcacagtctcatatatcacaactcatcatcagcaacagcaataataatccctaatccaatccatcatcaattatagatgaacaacaatccatcaaccaatcacagatgaacagcaatcactgatgaaagaactacacaattaatcaaagatgcacgaaatcactctcgctggttcttggttgtcgttgttgggatacgcgtaggctacgatagcataaatcaaaattttctatcgcgtaaaccaggaaccatgcaagtattagatcatagatcattaccactcgacgcgctgtgcagcggaagaagacgccgagaagtcgaaggaactctcgcgaagtagcgcgcgtcgatgtagaggaagtagtcgatcgcaccggctcgaccttctcctcctcgtgcgttctcctcgccgtactctcacgccgatcagctccgcaaaccagcggcacctctaccggtatccacacgtacagggacggaacgccacgcacagatgtgctagcactcgcgcgcggctagagtttagctcggggagggaagtgacggctagggtttctcacgtggtgcaatacctccgccggtcacacccctcacgaatatataggatccatcactcgggcctccaaggcccgtaggactcctattcggatccttatccgaattaagctcatattggatctctatccaatccccttattccggcccattaagcgtgcgaccctataggttcatatatactcggctgtaacccgaaaactccttttcggtccacgcgtcaacagcggcccctagcagaacgtattgacccaccgggcatacataaagatcatatcggctgaacctctagtgcatatttgtatgaacccctttgcctcacgatatcgattaagctcaaggctagatatgtgtcatcctctaatagctcaatcatttactcgaatctgttgatagattatataacttgtgattgactcctaaatcacctttggcatggccatgcacttccataatctacaacatcgaggggcccagagatatctctccataggaggggtaaatcacatcttgattattcatatcccactacatgtttcatagcatacccgaaaactacttttataattacccaattacggagtagcgtttagtagtccctaagtaagctactacacatgttgagagccatgataatctcaggtctaaggattcaacaccaacactcaatgagatcactgatgacacaacacatatggctcttgcagtgtctcatgttgggtctatccaacaacatgttcaccaacatgtgtccatattattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagctatctatttcaaggaacaatgtcggataaatatgtaaacatagtatgtgatataatcatctctatgattgcctctagagcatatcactaacagtcgtcaatcagccggggtccctctccacgcgaggtcgccgccggccgctaggtctctctccatgtgccgctggtgggaggccaacgaagatgaagaatcgcccgtgggccctccccgcgcgaggtcgctgctggccgctatgtccctctccgcatgccgccggtgccaggctgatggagagggagaatcgctcgtgagccctctcctcgcaaggtcgatgccagccgccgggtccctctccacgcgccacccatggggaggccgccgattgcgcgtggcggaggggaagagggaggggagggtggcggaggaggcaaggggggagggggcggaggggaggcggaggggaggcagagtaggtagaggagggtgcagcagaggagggggcccgaggtgaggcggaggggaggcaaaggggtagaggagggtgcagcgagggggagggcgctgcgacagagtaggagcgagctagggatggcaatttcccccgtggggccggggacccgcaagggatccgcccctacgggggcggggacgggtggaattttcaacccgcgaggagtcggggttggggccccggccataggcggggatgggggcgggggaggacaaccacccacgggtgacccgcggagccccgagggtgtat

SEQ ID NO: 37660 - DNA, 6188 bp, Oryza sativa
gtcggcgtcgacgtcaagggcaagcatgtgcagcggcggcgccggcattcctcatctcgcgaccacctcgtcgccgtctgccatgggtggtgcgggaccccgctcacccgcgggtcccctacgggggcgaggacgggtgatgtttcccacccgaccacctctacgggaccggggccggtgggagaagtcggggagtagggcggggacgttctagcccaacccgcccccaacccgccccgttgccaaccctatggcgagcgctgcgcgtgtaaataagggccaaatgggatcgacgcgagtggataaggttggtggagatcgcgctagtggatctgtggaaataggcggccggctcggccggctcggctcgctcgtgtcggttcagtttggtaggcactggttgtttaaagaaccagcacctgtaatatattaataggtgtaagttcttttaaaaaaccagtacatatagtattggtaccggttttaacaaataaaccggcacctttaattattaattattaaaggtgtcggttctttatattttcatcatgcgaggtgcaaaatgcctataagtgtcggttttaaatgaaccgacacccataagatcgacccctatgagggttttttagtagtgttgatccaaacatgatggatgtcataaaacctgtctggaaatataggatcaataatgtgtcaataatgtaggcattaataaagtgtcaataatgatgtacgttgtaacgggaagaaaaaaacaagaatgtggagagacagacccttattcgaacaaaaaagaagaacgaggatatatacaagagagtggtcatatacggccgagtgagacggcgacagcacgctagatcgatcctagcttagccaaggagagcgagaaggggagagtaatgcgacgaaggaattaaacatgcggaataatagtcctaaattatatcacggttagtcaggaaatgatcatagaggaaacataacattgaatttgtcttgaacttttcattggtcagcaaataatttcaagtcataataaaattttctaactgaacttttcattggtttcatttagtaaaaaataattttaaatctggaagcaacattttatcattttccctgcaattataaatcgtcaggacagatggaagtagctcattctgtaaatagaaaaaacattcaatcagatctacaaaactaatctatctatttatctatctatacctatattaattgaacactttgcagaaatccccacgttagccaaaaatatctagccattgactaataaatgatattatcgtcaccatagattgtaaaatccattcctgttttactttgtgagccacgtgtaaaccaatcttaaaaacaccacgtcacaaaggagctgattttttttttagaactacaaaggatctgatataagagagtgtggatacgcgagacgcaagataaattatttgtattgctgtcgatcattaggaacatgattagatatgtttaattcacaacacaagaagagacgaagaaaatcagcaaagcatgcaacaccttgcagcaagacgattagttcttctggcacgccgttcacgtttatggaaagcacagcgatcgatcagcaatggtgttcagaatgacgttcacgaagcggcatatatacgcccgatgctcacatcaagtcacgctcgacgccgatgtcgccgagtcggctcggtcgtcttccgccgcgctgccatgtccgtgccagcgccgacgtacgccgaccgcacggacatatgtccatgcaggctgccgctgcaggcagatgcatattctttttcatcgtgagtaatttctctgtatcaccgttgaggcagatattattaataatattaatataatcattagttgtaaggttgatgttaattgatattattagactttgatccttgatgtcatttgtcacaaaaagtaataggttaactttgtgccatcatatatcacaaattaatttgtgcatgcttcatcgaaattgagttgaacaacttttttgtttagaaagtacatgattcctctaacaaatataatttagcaatctaatttgaacacttttcttttatcaaagttgatgtttaaacatggcgaaaagttattatttataatccaaaaataatatatgagagtttatgtcaaataaaccatgtcatcgaaaaaaatatcatactaaatttttctaaaatttactaattactaaatacataattaatacaaattgataaaaaaagttatatccaacttggactctccattaagtattttattaattaggaattagtaactttggtgaaaaactagaattagtaattaatccgtaagttattagtcatacaagctcttctttcaatttgagccattgtaattttaatctttgtaatgtatcgataagttgcatgggttgacggccattaaacataattcagcgcacaaactagtgagcggcatatgcatggcccacttaagctcttgggcccattcgagtggcccaggcagatgcccccagctcctgtccttttctgccactacgataaagccattcttatactctccctttaatttcacaaatcgactataagaaaaactatatgtaaaaggttttgggttgttcggtgaagaccaaggatttaaatctctggttaagaaatactacctccatattttaatgtatgacgccgttgacttttcatcacgtttgaccattcgtcttattcaaaaaatttatgtaattatcatttattttaccgtgacttgattcatcatcaaatattctttaagaatgacataaatattttcatattttcacagaaattttaaataaaacgaatggtcaaacgttggtcatacattaaaaatacggagggagtaccacttttgccgctacataatctactacgctaatagctgggcttagctggagattcggccttcagttacaggtagcaaaaacttttgttctgggctgaaattagctacgggccaaggcccatctacttctcctgtaacgcttgttcgccagcgcccacgcttttcccacacgcgtttgagcgcaagccgtccgggtggggcccacctgccagccggagcgagaggccgatgcccgtgctcccaatcgacccgcgccctttgctcgcgcatgcacgcgcacgcgccgtcttgggccgtcgccacttggaccacgcgggcctgccaagccgagccaaccaccatcttgggccacgtgcaaaggctcgattggctcggcctccctgccaaccaatcacagcacacgtgcacccttgggccagctaggcctgccctggcatccctgccagcctagcacgtgccacgcagcacacgtgcacgatggcttacgacagtacacacgactgctgtagcaaccatgcaattcctccaattttcgtcgcgaaatccggcacttgcacatccgaccatgtgaaaccgttgcgaagatctctccagaccgtgtcagtctaccgtgtgccaccctgtatccaatcttgttacttggtttcctttatcgttctggatctcaactacttcccgagtctagtcccgatccgctgttgacctaggttgaccacgaaggatcctgacgttagtcccaccttgtcatatggcttcttgaccgtgccggacctctgctgctccttgagcatggcctcggtcctcgctattgactaaggctgacttcaatcaaactgcatgcatgtaaacaaacaaccaatgtcttggcacagatattgcaacttgacccacaaaaatcagttaatgcacactcctacatttccggcactgcactagccaattttccatcacacgtgaatcaaacccacacatggtttcacagttcgagtatacacaagattgaacttgtgttcatttgtacacgattgaacttgtgttcatttgtatattggatcttttccaaaatctcatagcaccggagcggcagatttatttatgatcaattaggtgttagctaaaaaaacttgaaaaagtgaattaatatgatttctaagcaacattcatatagaaattttgaagaaaagaaacactgcttagctgtttaaaaactatgtgcgtgaaaaaaaaagagaacggaagttaggaaagtgtactaccaaaccctaggtatggtcattagatggtggtccgccatcctgagacttaaaaagaaattctgggtcccactgctatgagattgattccaacgttaggggtgacaaaccctagcttaaaaagtaattgtacaacgatataaacaatgaaatacgcaataactccatgtcatctagaaattggcaacaaaactgaccaattgagacacgattagagagaaaaagagagggagagagatcaggatattattacaagtagttacgaacaatatgagactattttctgccctcgagagcaatacactttatttgttgcctgtgatcaaagtagtctttttttttcctcaaaaaaggaaggtgaaaaatccaggcgctgctatgggaaagtttttttaagttagatttgtagtttcactccatttccatgctttattaaattcacacctatcatcaatttcaaatgtttaaaataattgagaaggtgtggcttcatgggagacaagagacacattgaatcgcatatcaatcatataaatgctaaaatatttttgatgatatagcttcatcagaggaaaacatacaatttgcctcattgatcaatcatcaatagctagaagtaattagtgtgatatggattcataagaatagaaagaaatataattacttagtgggaggcaacttaactatataatgttttgaaataatcagacaatatacatttttctccatatatacctccaaaagttaaaaaaaaagagaatatttgaccatacagtctacataagaactatatgggaatgggattgacaaagagactcctaacaatctcttgtagatgtgtggagaatgtgtatgcatcctttctcttgtcataaaagaacattatggaaatagccatgttcagaactctttgcactaccgggagtagctggtggtgttcatagcgagcgtggttcatggttctccattcatcttctatcagtgaatcgagcttggcaaaggcaacctcacttatgaccttgtgctcattcatgtagcactcaacagtgctcaccatatcgcctttgttcttcccacactatatgaatgtcaaagataaattgcaatatctcatcctccactctagtttagcagttgtacaagatataaagagttgtatcatctctttttgaaggaatcatgtacaattgcgtatagttaaatgttgataacaatgtttttagtgtactagtgtgatttttttatgatttctctatatgatgagttggacaaatattgtgatcacttaggaacaatgtcattgtgggcattgaaaatgttacatttaataagaaaatgattagttaattagattgtaccttaaaagaggcaatgtcattcatgaaacgtaatatctttgcacatgatgtcacggtactactgcttgctgcccactggaatgcttcacttgatattgcgtcaccccggccaaccgtcgtagacacacataacaattgcaccgtcgaagtctttgtagacaaagccacctgctcttcaaagcttggcttgtaattattatgtgaccattcagcttcctggagaaaataatgggacagcttttggaactgcacccaagcaaaaggaaattaattaccacaaaattagcaatacatggcaatattgttgttctgatgggccactcacaaacgcttgcacatctaacacacactcaaagatgctaagaccagcggcaactctctagcctcacaaaatcatattgaaagtgcagtcgattatccataatatttgtgggcataaggacctctagttggtgaagtcatacacacacatcttcaccatcacaccaccaatacatcccacctccattttttgcttgacttcatagaattcgtgatgtcaactaacgttgatcattatttaaaaaagagtaaatttcacagaactacatgttttgtagtccaagttgcagaaaaccacacacactttgacacttggtacttaagtacatatgttttggtagctgtagtttca

SEQ ID NO: 37661 - DNA, 11228 bp, Oryza sativa
ccaattctggtaggatcaatatggccaatacacctttgtcagacatgtatgttcaacacattgtttacatataaattatatgtatagtgtattaagctttaataagattgagatgaatacatactactgcaatacttattttctacttggtgggtatatatcaaagagattccatactcagaaatagctttgagctccttcaagtggaccccttgcaaaatattaaaatccacctttgcaagatccaaaagaaacgaaatatgcccttcctcttgtccatactccgaaagataatgcaatgtttccactcttttgtatgtcctcggtagtggtaagtgaagggcacgcttgacttggtcagctaaagggtgtttgaggttaccacactgcatcattgattttagatggtgcctagaaaaagagatggcctcttcgagttctggttcatcgtgaacgaggaggtaagctgcattatataaacttaataaactgcttggttcatcagctatttaattgatgaacctcccatcatcatccttgaatatgttgaatgtagctgcaagataaaatatgtaatttgagactaattgattcattttagacttgtctgtgcaactaggtgactagccttctcttataacggaccagaaatttcttttgataaccacttatgactctttaatttgttgacaatagaaaatccaaacgtatatagattttccgtgtgtcatcagtaatgtagaataaaaaaaatttaagttgttgctgaagctgtatagaattttcccaacctacaattattaaatccaattcatattttgttaccaaatggctagctagtgatgagtatgcgagttatgtcagtattacttcagtccactctatagaccgatagatacctggagatacccataggccatgctccctgagcaagcgaaatcgaagagcaacctcgtaaaggctagagctagtaaattcacttgcatggatatcacttagtgtggtgcttatctcttcattgaacaggtgaccaactcctagatgttggattgaatccactaacttcatccttgcaacaacgtcacccgaagtccgaaacagtgtgcgaaccttctctctaagattatcagccctctgcctcatccattcctccgatctctgcaggctttcgattgttagcaccaaccaaatgaagcaatattagataataatgataatttgtcaaaacgcaatgcaaagcatatttcgggtggtcctcaatccaaaccaatccattttaaactaaaatctcaactcacacatttggatgggtcaagatttcatccggtttctaaccgatcgacttccttaataataatatatagagcatgcgtaagatgttaagataaattcataaaccagacagtaatagcaatataacaattatgtgtatacatgcctgaagtggttgtggtgtgtaggtgatgaagaaatccccccagactgagggcttatgattagaaacaccagattgagggctcaagcatggtgcaaggctagtggtagatctgctgcccgtgctggaaaacatttgcacgtgtactgtgtacttgggctcgatagaatgtttcaagctcagacctcagatgctagtgagcaccgtacccagccctttatataggagtagtacccccctaccaaatactacttgtcaagtggggattagtcatatttaaattctgatatgaccattagtttgactatgaatttataaatatctaaagaaagtaagcattttttaaaatacttaaatatttaaaagtttttaatgtgaattaagaaagcaggtagaattgaatggtaaaatgttatgatcggttaagaaaataaattaggtagaacaattaaacgggagatggttacgattggttgagataaaaggttagatgaaaaatagctaaattttaatataaatttgaactctacaaatagctatattttaggacagataaagtatattactatatattaaacatgaccgtacaatttctgttcagccaagtaaatacgataagagtaaatttcacaaaactacgggtattttgaccaaattatcacaaaactacagatttaaggagttgtatcataaaactacatatttagcaccaaatttatcacaaaactacagattttagattaagtatcataaaaatgcatatttaatattgaacttatcacaaaactataacttttgaagtttaaatccctagcaccattgttatcgtggagctataaacatcattactttgtgattaaattgattctaaacctatagttttgtgataatttagttagtaaatacgtagttttgtgacacttcatctttaacgtgtagttttgtgataaatttggtgttaaatgtgtagttttgtgatacaccgagttaaatctgtagttttgtgataatttggttatagtatctgtagttttgtgaaatttactcacacgataaataattttaaattattgacgatcaaaattaagttaacactaataaatgatgaccaaaaatactactttattacatttgtttacttttgggtttggacgttatatcttcgtattataaaactatatatacctgcatttgtttatcattggcctgtgtttttacatattacactaaattaaattgatgaatgattaaaagtcaactgtgtcgtacactatctctacatctttagaaatccagtcatcctccttccttccctaccatgcgcagcgcccgtgaaaatcaaaccggcccgcacctcccacaccatatttcttctgatcccgtcgcaaatgcacggtacagtaatataaaaaatggataacagattttttaaaaaaaggagggagtagaaacggaaggagtactaccatatatatctttcaaaaacgctgtatatatatattgcatttggtccaaatccctgaagccaatggtcagtcacgtgcatccagtggggagactatcgccagtgaggcggctgctatgccttcctctgtttcgttccagacatcgacgggaatgacggaaagggtgaaaaagtcatctgcctcggagcggatctcagccgttggatctaaaacggacgcgtccgatttaccgcttgccttttggaatggttccaggaagatggaacagaatctatctcacaccagtaatattaatctgaataagctccaggtcaaacaaataataatctgaataagctcagttgatcaaatcagtacacagaaagtcaaattagttcgatatgcatgcaatgattttttctacgatacttgcagtttaatatctggatagtctggtgaatgcaaaaggtttgggatgatggccgccgtcggtgcaaaagtttgtttcgattttttggaaaaggacgaacgttgaatgagagatataactagcatataattaatcaagtactaattattaaaaacttaaaatatatttatttaatttttaaagcaacttctgtatataaaatttctcgtattaaatgtatcgttcagtttgaaaagcgtactaacgaaaaatgataaagtgggtaaaccaaaacaaagtttagaatagggccttaggtttaaatttgaaattcatgaacgacggtatattttcttgcaacaccatatgtaataggtgtataaatttatgttctatttttttatacaacagacacaagtaaatttcacaaaaaaaaaatcccatacagtgtgccatgtgtgacacaaaatctcgtcttgtgaatttatttattgaactccatattttagggcaaaaagtttcataaaatccaggtcattaactatgccatctattttctttgatatatttgtgcaggatgctatatttcataaatttatatatgttattttaggagcctataaatctctggctcctgccagacaccaacttgtttgatcacctcatgacactaacatatatgggaaaacatgcagtgcataccacatatatgatgaaaacataaaaactaccattggataaaagaaatgaaagtctaatatttgttcacgtcacgtagagaaaaaattttactccaagttcaaccatgggtaacgtagataaatctcaaacgtccatttttaatcaatggtagtgaccaggttttcacaatatacgtggttagtactacatatttccaacgaaaataaacataccattaaaatatactcaacgttagatttaataaaactaatttattattatagatgttactatagtttctatagatttgatcaaatttagaagacttaacacaaaatgacttgtaatataaaatgtacggagagagtacattatatcgttgcaacacatttgggggggtggggtggggggcgcctaattttgctaagttcgtcttagaatgagaaaaaaagagtgtggagagttagaatacttatatatagcgtatcagttggcataactatatgtttaggaaacataaggttctctaaaacgataaataacagaacatatgttttttttccagttacatggaagatgctaatggatgtacacaccactgtacaaacacagcgacgaataaatcccttttaacacgtactgcctccatccaaacataaaaaaacaactgctatagtttgaatttgataagaaaataccttcgtacctacttttcacacacgaatcgagaatatttttatcccttagataccacttaccaactcacccttgcatacaagttttacatcaatgaggatctcgccttgccgccacgctcgcctcctccgccgccgcttgccacccagccgccgctcgcgcccaccccctgcaccaccctgcctcgccgccgttgctgcctcgcctctccgccgccgcgctcgcctcatctcaccactgccctttgccgtcgccatgatggacaagagagagagagtgagagagattgggaaagagagggagagagagaaactgacttgtggggtccaccaacttttttataaaagaattgttgattggactatcatgtagaccaaaaccactgcggattggatcgaggagggtaattcgtccggttttcatagttgggggtaaagaatgtccggttttcgggttcagggggtaattcggtcgaccgcgatagttgggggaggtaattcgtactttttcctttcgatcatttaatatggttaataaatattttccagttcactttataatcaagtaggataatccgtttcgataaaatggtgaataatctgaaaataacaaacaagaaataaagactcgctcgtctgcttacaaacttatgtcagaattttcctaccaaagattaatcatctgctgcctggcctgacaagccctctcatgcagaaaaacaaatgcagtgaggcggtcttaagaagcctgaagtgactgatccatccacatatcggaccacatatatatatatatctatatgaagccaagccttcaacgactcctcgaaggaggatatcagcggtgcaaccgtgcaagacaccgtacccaccgcacgccgccgacccgacctacacaatcaccgtcgataggaccaccccaaagcaccgagaaaagaccccatcagtatggatggtcaatgggccgctcggcacggcctgaaccggacacgactagggcgtggcccaaggcatgtcaggccagcacgcccggcatactcctcgtgtcgtgtcggccaagcacacaggctaaacctgtggcccaagcacggcccattaagatgctgtgccgatccgaaagcatgaccggtctatcgtgatcgttttgaaataagtctatattgcatctctcaactatttgggccgtctttctacatggttgggataagtccattttgtgttcctcattttcttaggtttgtgtcttgtatatggctggagtaaggctccgttcgtatgcgcgagtcctgatcccgggtcatgttccgtgcaccggaagcgtggtcccgcacacagtaccagaacggcggcttgtgaggcggcgttaacggatgtgagatgtggccattgcgcctcagcttttccgtcggagtcaggtgtcacgcccagaaattcactagtaatttctgaactaatttgtgcatgaaatcctcatccaaaaatcagccgaggtacacaaactgacaatttaatatatagattcatcataataataacgtacatacttacaaaagaaaagaaaaacagcagcggaattacggtctagcgaagctccggctccacagctcccacaggcagctcaactatgatataagccaaacgtcttctccttttggatcctttttcttcaactgaggttgattgattattgcaaggtgagcatataacatcctcagcaaggcacacagcaaatatgcaagtgcacaggataccaaaggatggcataatataggctcatttacaaaagcagcatttagcaaacatttgagaattgtaaaacaatagagtaattaatcatcaatattaatcaagggcgggtcagcggctcccggcgcagcggcttctctgtggctccctggcgcagcgggtgcgctgcggcgcctcgacgcagcggctgcccggtggcgcggcagctcgggattttgccctgagctcgggacctccacggcggcgaggagcagcgctggcctccctctcacccctccctctcctctcatctcctatgtgatgtgatttattctgtgatttccacctcttctctcatcttatgtttaatttattttgtgatttgcaatttccaattggattgcttcatgtgttggattattttgggatgattttgtaatgattccaattggattgggatttagtttttgtgatgatttgggattggcgccaagcacttcgcagccgcacgtcaccagcaacccgacgtgcctcctgctgcctttgtaccacggccttggggcagcagtgtcctcggcctgcgatgatttggaaattggtatcgggttgggagggggaatcgggttgggatgctattagttttcttgtggggatcaattttcgtgttgtttttggttgtctggattgattgatttggggatcttgctcagggttttttttttttactcggactcgaacgaaggaaccaaaattttgggagtgacggacgaaaacacaatgacagatacatgtgacgagtagaaaaatccaaatcttttaattagttaagatattatgttaagaaataccgcgtccttaagaaatggttttttgctagtacatagcacaattacgaaattcaatctacatacaatctattattttaaacgaaactacatgaaattgaatccatatgaaattactactgtaatgcaattcccgtttcttctcaatttttgcaaaccggagtgtgctttcttgtgtgcatctaccaattcctcccacgcatttacaccccctgcagcgcatccggcggtaatggcagccatcctcctctcgccgacagaaagtgtcggcgctccaacggcgctctgtggaaatacctaagtcctgtgaaatttcaaactgaaatcatataaaccgtatattttcttgtaacatgtgtaggtgctttggtattaattacacatgttgcaagaaaatataccattcatatgatttcaatatgaaatttagatttctagatttagacataaaattttctagcagatacatcggttcaattcacgggtcgacgatgcatgaacattaaccggtcggcaagtaggggtgggcattcggttagaccgaaaaattcagttcggtttctcggtctttttaaaaattcggtctttagaatctcaagaccgatcggtctccaacaaaactgaagaccaagaaaattggtcttcggttagttcggtttggtctcggtcatagaccgaactaaccgtgacaaaaatttatcagcaaaaaattggtacaagataaatgaattaagcaattaggccatacacaacacactgcaaattgatgtcaccactcaccagcaaatcgagcactacttagacaaaaaaaaaaagaagcaaatcaaacacgatctagaaaggaaatcggcaaatcgaacacaactggcgcacacagccacttcaacttcagcctccgggatgtagccgaccggctagatgtggagggaggaggcggcgcccggcgcggtgcaggaggcggcgccggcgcggtggagccgtgagggcaggaagcggcgctggcgcggtggaggctggaggcgccgaggcggagggtggaggcggcgagctcggtgaagggaggaggcggagggggcgccggcacggtggaggcagcaggcggcgccggcgctcggtggagggaggaggcgagctcggcgccgggcggaggtggcgagctcggtggagggaggaggcggatggggcgctgcgcggtggaggcagcaggtggcgccggcgctcggcgctgggcggaggcggcgagcttggtggagggaggaggcggagggggcgccggcgcggtgaatgtgaggagggagtacgacgcctaagggacagagggagttggggtagggattctagggtttttttactgggcttaattgggcctctaggtctattgggccaattcggtcatcttgggtatttcggttaaccgagcccaataaccgaaatacctgaaataaattcggtcttttgctagctaggactgtatagctacccgaatttttcggtctcggtcccggtcatttcggtttggtctaattctgcccacccctatcggcaagagccgaaatttggatccttgtcccacacttgcacggacaaccgcggtataacaatcttttgcgtcacaatcttgagaaaagtcttttcatatatactccatattcgagtgcataataaatatacataagacacaagttgcctgggttggatattggactataaataaagctggatgacttaattttcatcccctcctacttttcttcgaccggctggtcggccctagctttgccgacgtttccgtcgatgtctcgcaagagacgggaggcagcgacgggttgggatcccctggccaaccagtttagtttagttggattaatatggcaaaaatagcacagccatcgaataattagtttgtacggctgagatggattgcccgaatgcagatgagtattaataattagtttgtcaaactaaactaaatgatccagcagaaacccaaaaggtaaacatagatgctcatgttctttgtcattattgatttttaacttccgatcaaccttttttatgagaaaaatatctttctctcctaatggattcaactacagagtacatgaataatgtccggctgctcatttatttattctctacttgtcttctcaaatcattacaacaattatttgacatctcccatgatagaaatgaaatgtggagcagagtgtgggttgtaaactctgaagttgaaaccagcaatgcaatcagatattactgtcagaaaccaatatatagtgctaattgaaaaggctcagttgttttagatcaaatcatgctgctaaagacccctgcttgattgcggtcatttacttaggaaattctacaatacatacatgttacctcatagcctcgaagtgttgtttgataggttcttgcacatcctagtgtactgctccctttcagacctatcagcaacgatgtcttcagccactacccagtggccagtgatacccattgctccgaccgtaccagcacgggcgccgcgcgtggatgcgccaccactcgtcgctccgcagcttcctctgcccccaccacgccggctctgctcactggtttctggtcgccggcagccggctacccttcgccactgctgccacaggataaagaaatctaaaagaggaagtagctggaagcggtggagtgttaaatgccgattttttttttcggtttgatggaacaggattctctgaatctttctcctggttgtgggctaaggggaaaaaaaaacaagaaaacgctaggattgtgccacgtatacgatcggagcacgtggggagcaggcaagcccgtcgctgcctcccgtctcttgcgagacatcgacggaaacgtgggcaattacgatgagtttgaggaatttggacccaatgcagatgcttttccttttcatgtttttggtcgatctgaagatatttgttcgttcaagcatggtggtagtcgatccggtatataaaggagggtgctggagtataaaaaactaagcctgaaaccgcaattcagccagagccccagtgatatcgatagtacagtactgatcaaagaacagcattatgcaaatagtatcaaatatgggttccgccggcaagtgcgcgccaagccttgcaccaacacatataggacttggcatgatggggaagatcgctgtgagcccatccagcgttaggcctaggcctcgggccatggcttcccacgacgctattgctcctgagaagacgaccaactatgagccctcagtctggggggatttctttatcaactatagaccacaaccgctccaggtatggatgtgtatatataaacatatatatatagttgttatatattagtgcaacagttatacgtatatgctaattatatattgtctatgcatgcatgtacatgcaaatatttttatgcatatgttctgttaattagtactggatcaataggaaacttcattagtcaataccgcagctcatgcatgtctgactcgagattttaattttaataatatcaatatcggcccatatgtggatagcgccatatcgaggccatttagtggagtcctaagtttgccgccattattttatggcaaattttgctacatgacactgctattttgtggttttagcctacactgtccaaactcacttttggggaaaacactccataaacgtggtaatttgccagtggacaccacgtcgattaaaataataatttttggttgaagagaaaagatatcacgtgaaatgtcaaaaatgcccttgggcccacatgccagctcctccatctctattccaccacgagcgccgttgttcgcagagtggagcgccgacagcgctgggagtcgtgcggcaacggcagtggcggagtgtagcactgggagcgctgggagtcgtgcagcaacggctgtcccggttgcggcagcgacgccgacgataaccacgacgacgcgcggcgatggcggctgcggca

SEQ ID NO: 37662 - DNA, 2280 bp, Oryza sativa
gcaaaatttgccttattttatactgcttatgtgcatgcgcactatacttttgctggttttatcaatccaaaccatgaatgctgcagagatcagaggaatggatgaggcagagagccaagaggctcaagatgaatgtccgcacactattctggacttccaatgatgtggttgtaaggatgaacttagtggatgcagtccaacgtctaggaattggtcacctcttcaaagatgagataaggcgcacactaaatgatatacaccaaagtgaatttactagctctagcctccatgaggttgctcttcggtttcgcttgcttagggagcacggcttatgggtatctccaggtatctattgttctatagagtggacttaaactaatgttgatatagcttattactttttatgctcattatccatttggtaatgaaatttgaattgcatttaataattgttggtcggaaaattctatacagctttagagacaaactttattttttaactatacattaatagtgataacacatgtagaatctttaagtttctccacgtttgatttttctattgtcaacgaaaaaatcataataggttaaagctaaggctgtgtttagatccaaagtttggatccaaacttcagtacttttccatcacatcaacctgtcatacacacacaacttttcagtcacatcatctctaatttcaaccaaaatccaaactttgcgctggactaaacacagcctaagaaagaaattttggttcttctctgtacaagagaaggctagtcacagacacatctcaaactaattagttacaaattaaatattttgtcttgcagttacattcaacaaattcaaaggtgacgatgggaggttcatgaatggaatagctgatgaaccaaggggtttattaagtttatacaatgcagcttacctccttgttcatgatgagccagaactcgaagaggcaatctctttttctaggtaccatctaaaatcaatgatgcagggcaataacctcaaacaccctttatctgaccaagtcaagcgtgcccttaacacaccattaccaaggacatccaaaagaacagagacattgcattatctttcggagtatggacaagaggaagggcatatgtcaattcttttggatcttgcaaaggtggaatttaaccttctgcagggggtccacttgaaggagctcaaagctatttctgagtacgtgtgcctctttgatatataccaaactaacaacaaaagtactacaacagtatatattcatatcaatcttaatacagcttcatacactcatacatatatatgtaaatgatgtactaaacaaacatgtctgataaatgtacaatatccggaagagctctttgcaatattaattagtaccagtaataatcttaaatatactatctaagcatgcacctaaaatgcttttattttaggtggtggagagaccttaatgaacatgtggagctaagttatcttagggatcgtgtggtggagagctatacatgttcacacatgttgttctatgaagaaggcttagcattcacacggataacttttaccaagataattgtactaattattatgatggatgatacatatgattcccatgctaccatccaggaatgcaggaagctaaatgaagccatacaaaggttttgtctttgtcttagtgtatgctgacataaactaatttatatatacttgcctgactaattccgatgtaaagttaacaatttgcctgccttgcagatggaatgagagtgccgtctctgtcctaccagagtacctaaaaaatttttaccataaattgttgaataattttaaggagtttgagaatcaagtggtggttagtgagaagtaccgggttgctcatgctaaaaaagaggtacaacagcgatataactatgttgggactgattccttatttgtttatttgattttcagccaacttaggttttcaaatttgactattatgtttcataaatttccatcaatatgtgatgataaaattgtcatgactttcacagcaacaaatatgatggcataattttcatactagacttttttttcagtaatgatcaacattagttgacaacatgaattctatgaagtcaagtaaaaaaatagaggtggaaagcatcagtggtgttgtggtgaagttttggttgcatcattccacccaccagattgatggctcaactcttcataccaatgaatattatgcaaaagcgggtgctcttttcaaaagaattttatgatgctagg

SEQ ID NO: 37663 - DNA, 18183 bp, Oryza sativa
caatgcccagaacaacattgttcctgagtggccacagtatttgttcaagctcatcattatagagaaacggtaaattttcacacaagtaaaagaaaaacatggtgctcaacatatgactatatgctactatccatgattcccttaacaactactctataacaatgtactttataactttttacattgttaaattatgggtggaaggtgagaaattataatttatctttgacattcatacagcgtgggaagaacaaaggggaaattgcgagcaccgttgagtgctacatgaatgagcacaacatcataagtgaggtggcctttgccaaactcgattcactggtagaagatgaatggagaaccatcaaccaagcccgttgtgaacatcatcagctactcccggtagtgcaacgagttgtgaacttggctatttgtataatgttcttttatgacaagagaaaggatgcgtacacattctccacacatctacaagagattgttaggaatcttttcatcaatcccattaccatgtagttccccttttagactgtattgtcaaatattatctatttttttttctttttacttttggagggatagatgaaacaaaatctatattgtatgattttttcaaattaacttgcctcccactaattaattatatttcttccatgccatgtcacccttcttatttgtagcattccgttgattgatcaattacgcaaattgtgtttttttctctcatcttatatcatcccaattattttagcctttatatgattgatatgtgattcattgcctctcactacaagaattttgggcttctgtgacgataacagcatgtttcctgtcactacccgcctgctgtgacgaaatggctgtcatcacagaaggtgggtcactaaccagcttctgtgaccaccagaggacatcgtcattgaaatagtgatgatagttctcctgtcactgatgaatgacgagacaaattcgtcataacaaattgaaccaactaacgccacgtgtatgatgacatgtgatgttgcagatgacaaggcgagtgatgtggtagatgacgtggcaattcacattcggcccatatagcatgggcttttttattttcaattacaattggcccaaatattttttgacctagctacaaatttgcttttacatttttttcattatagtccaaagtacaattcaagcccatattatgggccagcccaattaaaaaagcaatcacagaatataaaccacaaccatttgcataatcatattataatcacattccagccataattaattttccagcccatacaaaagcaagttccagaatacagtttccaacatgttccatacaaaagcacgaaacatgaatacaaaatattccatccaccatccaactacacaagtcccagccgactatgaagttcctacaggtagtgtcaagttcctgcaccaaaaaaattccacctagcagccactactaagttttggcgtgcatcttgccagcagccaggaaaaaaattccaccaagcagccactgcactttcggcctgcatcctaccagcagccaacaactagtgccaaaaaatcctgtgttctagcaaccaacgcaaaaaaaactccagccaccaaaagtgccaacccgcaagcaaccagcagctagcaccaagttctagcagccacatacaccatacaatagcagccacatacaccaccaagttctgaagtaccaaaagcgatcacagcctcgaagttcaactacactaacacgagccatcaaattccaagctcagccacctcattcctgccatcaaaaggtgcatgttttcagttgatggtgaataaaaagtccattttgtttggacttggaggcaaacaaatgaacaaatagtgtttagagtaataatccagcaggtaaattgagtaataacaatatattgatatggctcttttccgtaaagtccaaacaaatggctcttttctagtcacaactaaatccaaacaaatggctcttttgcagctaataatccagaaaaaaatagagtatctagatcgatcaatcaaatggctcttttccagtcacaactaaacaatatctagtttcatagtaacaacaactataaacaatccagcaagtaaattgaaataggcagagtaataggcaattttgatacacaccatgaacaaaaaattcagccaccaatgaaacagtacaataggcttgatatggatgcaaaagcacaagagacaagttaaagctgtgcacctgagcatacaactagcttagggaggactgatcagaccctgtccaaatgctatcatttgtcgaaggaggccctgatgatgaagtgagggtttcccgggcatgcatatcctcctagcaatgaaagcaaggtttcagttttgcattattatataaataaaggttcattgcataaggtacttaataaaagaaggaaagaagatgtaatagttcagtacttactatagctttctttacaggttcactaaaacctttagtttgctgcaatgcaactcattgaagagatcaattacagtgggctcactgtcaattgcagtgcccatgctcttcccccttggctccacttgtctactgccaatgagggtgcctaacataaaacatttacaagtgtcaataaaaagatcctgcacttgatatgaaggcataacacatgtaaggacaaaagaaccaagaatccaagttacttgccttgttcagtagagctcaatcccattggctccagttctgtacttaaagtgaggtcgctcaatcccattgccgccacccaatatggccacccagggcaaaggccccatctgcggcgcaagaaggaagggttgaggatgatggccagctgcggcgcgccctggttagggctccacccgccgatgctcaccagtgccaccggatcttgcagtcccgaggccctcattcctgtagtcacattctgcaagacagatgaagaaaggatcagaagaaaagatcacaacattgcattagagttgcagaagcttctaactagtaactgtttttgctaggcaaatctgtgagttgagtaggattttaaggaacatatactctttgagcaagtttatggccaatttagtaaaaatctcacatcttattaacattcttaaggggatatttttgtgacagacattatattggattatagaaggaatcaaagagatgctagccatgacctttcttctcaggaggtgatgcttcccttttaccagtgacaatttctactttatgaactacaaactgaggtggagatgcagcagtagcttcccttcctacttcaactaccaactgcactaaaggatccaagctagaaaaaatttcttccttggagatatcatgatctatatacttggattgaactgagttcaaatcaatgctaccacacctaacattaacaaaaaagaaggtgtttgtttttcaagaagaatgcatgtggtaagtttggtacagagtagagatcaaaacagtaaacagcagctgtgatcggttgggcaggcataaacatcttcctaattataattagttaaccatacatttttgaaacacggtttctttctagaccaagtcaactctgacccaaactaactctttggattattttagttattaaatgtagaaaagctatattcaataggtagatgcctccctactttcccaatgaacattgttaaacccacaagtcaaacatggatcacccatattttgttaaagaaactatgcaatttaccacgcttgacctaagaagctagaccaatccttgataatactaacatgcctaaccatgctcctaatgcttaccactccaaattcaagtacgaaagctattctgttatgtaacctaaaaataatttcgaacttgagaatcatcgatatcgacactagaatacaagaagagagaagcttataaattttaagtactaattgtatgactgtcaaaaacaatcagaactatgtactgctctaattttcacaaaacaatcagaactaattactgctctaattttcacaaaggaaggatcaataggagaatggaaaaaaaatatttgctaatcactactccatttcaagactgattcacacaaaaaactgtctacgagagaggttgtgacctgcaaaactgaatcctctactcgccgtctttatctcggctacaaatcgctccagcagcagcagcaatcaagcaccaacagaataccccaataaaccaccagatccgcgaaagccagcatctcttctaccgatttcccaactcgacaagggagttgttaccctcatccagatcccgacgcgtcgctggcctgctaccctgcacccctgccccgcgccgcgtgcccccgcggcccgcgccacctgcccgccttgcgattgcaagtcgccagccgccgctggtcattgtcatcgtcgtcgtcgctgcagcactgtagccgtcgttgcagccactgtagccgtcatcgccacagccgccgccgccgtagccgctcgctccctcctacctaagcctgccgccgccgctccgtagggcggaggtgggtggatctgcgtgttgccggcgctcccactcacgccaggccgctcccgaggacggaggccattggattcatgcgccgccgtcgctcccgaggacgggaggcggcgaatccgtgtgccaccgtccttccctggctaggggagcgacgtggggaaaggcgaagatggatggaggaggagagggatgttggcggtgagggaatggatggtggcggcggcggcatatggatttagtttgggctaaggtttgggggagaggttatatgggtaggaagcaatccaacgggagtttaccaaactgtccctggtatgtcaacagtagttatgaaattgtatgaacaaaatggacatttcaccttaaatttatgagaactttaaatttaattttaggctgatttttgtgtttcaaatgcaaaaatcataaacaacaaaattgtaaaactcatcgagatctacaactactgtattggtcctttttacaaataagtttatttgaacaattcaaattttgaattttcaaaatttgataacgtcaaacaaaaattgaggttaataaatgatttaaaatggaaaagtcaccaaaaccaaagttgtagaactcattgagatgcaaaatttttattttggtcatttctccatctgactctaattaaataatttgaaatttgaaattcaaactttgagaacttcaaatagaattttttattagtgaacgacttcaactgaaaaagtcatcaacaacaaagtagtataattcatctagatctacaatttttattttggtcatttgttcatccgataaagtgattttaatattgttcacaaaatttacatatctctcttatagttttataaaccatataagagatatgtaaattttgtgaataatgtttttatcactttgtcggatgaagaaatgaccaaaataaaagttatagatattgattagttatacaactttgttgttgatgactttttcaattgaaatcattcagtatttgaaaatgttgtttgaagttgtcataatttgaaattcaaattcaaattattgaacacaaagtcatatagcaaaatgaccaaagtaaaaattatagatattaataagttatacaactttgttgttgatgactttttcattcgaaatgtcgggtcccaaaactaatgattcggaaaccgacatgtttagactgtatcaagccctggatcagtagattgatacaggttcaacaatctggctcttcattgcatacatttgaacagggctctagaggagttgttattacaaaatatatgggtatttacaaacttgtggctaactaatacagcagaagctatagaatgactcaatcctaatgttttgctatagacttaaaccatctaactaatctagacttgagaactaggttgaaatgaaactaacttatatgattgaactctcggcttcggcaagaactccaaattaattctgaaagaagggggttaaagcaagggtgagtacaacgtactcagcaagttattatattcaagtatgaatgtatgaaataatagtatttgagtagagctagatctaattgcagaaagctgagaaagtagaaggagaaagtctataatgttttgaaatgcaacaatatttaataaaatctggagttatatttctaaccaagatgccatagtgagtcccgatgctcaatatccgtgagcatggctattcgaatagtttcagagatactcatactgtagtagatgtacactttacccgcaatccatgacatgctaatattcatcagcttagtcatggcaaagcttttcagttcctaacattagtggtacctgttccatgaactatagtcctcatacgctctgaacgtaacgttatcagcagcgagaggagttctggcgttcccgaggtttttagagagaactggttgagagacccccgtcatcccaaccaggttttcacaatacacacacagcgcgcaataatcaatatatttacctacgcctcggtaaatattataatcgccctgctcggcgtaaatttgcctcctgcgcgaggacttaaagaagaaccactgtacaggggtaccacctttgctagataacatactttgctaagtctgtccccattctagaagttgcggtcgtactcgctcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatatctggtttgctatgtgttcaagttatgcatttaaaatcatgaatggctaatgcatggaataatagggatatagaatataggataataatgctcaaaggggaggaataataacttgccttgctccaacgcaaacaaatccgagataggcaacctgattatctgatcctcgaaacatcacaggttgccatccaaaagataatagactctactaagaaagacgaagaactaaattcaataaaagccataaaataacaagaaaacgataaatggttaggagggctagggtttggttgtgtgctagtcgatgctagagcataacgactaggtttggtatcttctctagccggtgtcaacaggcagcataacggctagagggataggaggtttgtgtgggtttagtggggcggaagtgttactccgacaaccgtgagtggcggtggagcggctaggatcacacagagcccgagagctaactgtgcggcgtgcaatggaggtcgaggggataatgaagctccgaccgttgtacgcatcaaggcgtggggtgccaggagcagcacttcgaccttgggtttggcctttgccaggctttataaccaacagttcgacgtcggggatagaaaaccacgaacgtccccatggaaggcataaagttccaaccggcggctttttagtggctaaaggggtaatttgggacaaaagaaaatatttgaaaaggcaaatataaattcaaacgatatttgaataaattcaaataaaattataaaatagcaaatttggtgtcaaaagatagggtttaagtttcactggaatttgatctacggtttaggagatatgagcttctaaagattgggttttgaattaaatctagaaaatacgaaaatgtactgttcatggacccagacatgtacctgctcttttccttttctctctctctccttcttctcgtcttcttcttccttcagccgatagaagggagagggagggcggttggggcgacggcgctccggtggctgactggctgcgacgtcggcgtccacgcgtgttcccgagcacgacgcacctggggagggcggtggctggcggagagagtgaaggagttggccggaacggcgacgacaggagctcgaccgtggcaacaaaaggagtggcggtggtggcttgatgtggtggctaaaagagaggggaaaggggaaaaatgggttcacctcgtcgaggcaaacacgatggcgcaagggcttggcttgtggagatgcggaagaggagatcgactgatggtggcagtggccggtcaaggcaggagagagagaagagagcttcaagctctgatgtggggagaagagggcgatctcgccggctatttataggcggcggacgtcggttcacgaaggtcggttcgccggtggtagatgaagaaggcacggcgacggtggcgtgaggaagagggacacggcgccggccctgtacgttgattggttgatgatggcggttcgtctgctgttgacgtcagcgggatgatgtgtagttgacgtcgggcggcggttccttcgcgtcgacggaaagaagacagcggtggcagagagtttgtgggcggtgttgagaggaccgaggacgacggcgcacaaatggcgcacggcggcggcgactgtggcgagggaaaagtcggctctgagagggggaggctgggccgacttgggccggtctgagaaatttggcccaaaagcgaatagaagttatttttcaattttggaagatatttgaagaaggaagtttgaatccaaattaatatttggaaggaaatttaggtggctaacttttgaaatgaatctatttttggagataactttcaaaagagatatttcctaaatatttgagtgcaataatgtggtctaaatattaaagcactcaaatgggagggaattaatataattcctcaaaatatttttgggaatgaggcaggaaaacaaggagggaaataaataggatttttagccccaaaatatatggtatggattttagagaagtatttgaggctaataggaatttggattcgtggaagagaaggataaaatatatttttttagcacaagagcaattattcacaatatctgtaataatattattcttgtgccgaagaggaaatcaagctataggaattaaattggcggctagattaaaaggaagaatttggatacttgagatttcgaaagggaactaaggataggttaacaattaactccaacaaatttggaattgcttcggtttaggttcaaggatagtgttggaggatttcttggaccatgattcataaaagtaaaaagattttcaaactaaatttgaataaaaggaattttttcaaaagaaggtttttaaattaaaacccaaaatcaagaaacaccttaatttaactaaatatatttttaaaggaaaggcacaaaagaaattaaataccagaaagagattttatgcaggttaattttaggaggtctctttaattataatatcctaggtttaggaggttaataaaaacataagaaccggtatgatgcataattagaaaatagctaattttttagtatgttacacgaaatcattagtatttgaaaatactatttgaaattgtcataatttaaaattcaaattcaaattattgaaacaaagtcatattgaaaaatgaccaaaacaaaagttatagatcttaataagttatacaactttgttgttgataattttttcatttgaattcatttactacccgaaaagttatttgatttgagaggagggaagtaaaatggacttattggcgagggaggagcaaaagggcttggccggtggcccaaagagggaggaggagggagagagaggctgtgggctaagggagggagagagtaatacttgggccgaaaaaggcccaaggacagcgagaggaattttaatttgtttttcatttattttaataggttaaataaactttgtggtattaaaattagttattgagctccgaaaattcacggaaaattttaaagaataatttagaccaacttatagccattttagtttgtttttttaagttttttcattcaatcataaaatgaaacaccataattctgtttttttattcataaaatgagactagacatgacttcaatcctaaaatcctaaaatgagagactagaattgatgtagacaagaagagttcacctaggacaaacgatttatggtctagtagcaatgtagtataacaagattttttttgtttttaaaaaatataatagttctatattttatgacgatccattattgtcatcgtgctatcgtcacagagcccatgcagagtatactgtgacgatgattatgacagatacacggtttgatcataaacagctgtcatcctgtgaacagtcgtcataaacagcctctgtttatgacagatatgtgttccgtcatcaggtaatcgtcatagaagcccagatttgttgtagcatgaagccacaccttctcatttatttcacacatctaaatggttgacgatatgtgtgaattgaacaaagcatatggagtgaaactacaaatcttatataccgattgcaaggttaaaaccctagatgttaattgggccacgtgtagggatgaaaacggatcggatacggacggaaactagctctaccatattcattttcatattttttttcggaatcggaatcggaatcggaaaccccggatacgaaaacggaatcgaatattgtcgaatacagatacggagcgaatacgaaacagaacgaatacggtgacgaatattaatcggaacataaaaaccactcaaactaagcatcacaaatcaacaatgaaatataacttgttattttttctaatagaacatatcaacatttccaaattttagtgttaataattttgctatatccaattttgtggttgagggtgacggcgtctgcaaaaatcgacctttattttctcatgcggctccttaagactagtttatcgtactcatatgaactccaaactggatgattctttttcctaaatgtttgtaaaatcatgctctattgtgttattgtgttcttactgctattattttggccatatttttcttgtgactttgttttatcaattaaaattttgaatttcaaaaaaatgacaacttcaaataatattttgaagcggtaaataatttcagctgaaaaagtcatgaacttaaaagttgtagaactcatcaagagctacaacttttattttggtcatttcttcatctaataaagcaatagtaacattgttcacaaaatttacatatctctcttataacttatgaaaccatatgtgagatatgtaaattttgtaaacaatgttactttcgctttgtcggatgaagaaatgaccaaaataaaagttatagatcttgataagttatacaactttgttattgatgactttttcagttgaaatcatttagtatttgaaaatgttgtttgaaggtgtcatattttgaaattcaaattcaaactatttaagcaaagtcacatagaaaaatgacccaaacaaaagttgttgatcttgatgcgttttacaactttgttgttgacagtttttttcatttgaaaacatttactacccaaaaaaatatttcaatttcatatattttaaaattcaaattttatatagttcaataaaactcggatggaaaaattaccaaaataaaaatggtagatgtcaatgagttctacaactttgtttttgataactttttcatatgagttcatttactatatgataaaattcgattcaaagtttttcattggattaaagaaggtgggtcccaactgtaagtgtcctcctcttccttttctttcccttcttctcttcctctttctctctctttcttatctccttctctgctctcttctcccctttcttctcgattctccatgccagaggggaaggggcgggcatggcacacggcggggtggcggcctggcaaggggcgcggcggcagggtggcggcctagcacggcggggtgccggcctggcgcggcgggagtggcacaacgcggcgggcgagacggccggcgccctccccctcccagatccagcggcggcgggctagggaggggccggtcgtggccgggagcggcagcggcggcgggcgggagctgcgcggcgcggcgtgagcggcatggcagcggcgggggatctccggaggctctgacaacaacgatgggaggggcggctctggtggcggcggcggcgagcaatggcgacggcgacaacgaggacaaggacggctgttgaggcttcgagcgacgtcgacagcgacgaggatggcgtcgccggcggtgagctagggtttcggcatttttgagatttttatttttttttcgatttttaatgtggctgatttggatttggctgttgattttgattcggatatccggcaaaaaaagtccggatagtttccaaccgcaaccgaatccgagttctgacggataccatcgctactgtattcgaatccgtttccaagaaaaactatccgaattcgtatccgaatccgaaaatatccgaaaaaaatccgaccgaagcgatccgtatccgaaaacacggtcggaattcggaaattatccgtacatccctagccacgtggcaacaaacgtcgaactcagcccatcttgccgaggaagaggcccaggcacgacccatttgttgggccaagccgacacaggtccaacaacagtcgaggggtgtcatgcggtccaggccaaaaatctctgttctatgggccggaccattgggctacgggtcttttggccaactatacaccacaggcagccgagtacgagcgaaggggagacaaggtcatactgtcgcagcaccatccctctgctgcaacagccatcgcaagtgttccatatcggccatgccagattgtcgccgctcaagtcgtctttgactcctcgtcgacgccccgttagatctacccataggcgccgctctatgtgccgatgctgcatcgtcgtttccatcctgactcggtcgccgtcgttgcaaccgctcctccgaacttctattactagtatgccactccaacggttttcaccacagcccatgggatgccctaccagatccaatgcctgggcgttgccctctacacccttggtagtggcaaaaatgtcatgcgccacaactgcaccagccagcccagctgccgcttgctaacgccaagtctgaccgcatctaccaccactgtcctgagccgtggagatgggattgaggccctctttggatggggtaaaaaatctttttattccatgtcatatgggagtattaaacatagactaattataaaactcatttcataactttggactaattcgcgagacgaatctattgagcctaattaatccatgattagcctatatgatgctacagtaatatttgctaattatggattaattaggcttaaaaaattgtctcgcgaattagcacttatttatgcaattagttttattatcaatttatgtttaatactccaaattagtgtccaaacatccaatgtgacatggactaaattttagtccctggatccaaacaccaccagaaagagcccatcaccaccgtctttgcactcacttggaacttcggcagcggcaaggtcaaggaaggcaggtgtgcgtcgcttcagctagattgagatggtgcgcaccaaaacataacccatacatagggggtgttttagatacagggggtaaagttttggcgtgtcacatcaggtattatgtagggtgtcgtatggagtgttcgggcactaaaaaaataattacagaatccgtcagtaaaccgtgagacaaatttattaagcctaattaatccgtcattagcaaatatttattgtagtactacattgtcaaatcatggagcaattaggcttaaaagattcgtctcgcaaattagtcgcaatctatgtaattagttatttttagcatatatttaatactttatgtaggtattcaaatgttcgatgtgacaggatgtaaagtattgggatgggatctaaacagggtcgtacttgggagttttatgatacactaggaaggtagcccgcgcgatgcacgggcatatgtattagtttgttaaaaaccggtctaacaaattaattttaacttaaaagtaagatgtttttcattcgactttttctttcagtgagccgagtcaaatgatgtggtgtttttttaatttgagttagaatcgcgcgtgctctctctcatgaacagaacatatacgtggagtatgtgtggctgaatcatggctggcatcattaagcaatggtggacggaatcatcttgaagtttttaagtaggttaagattaagattagatctaatgattgaaaatattgaaaaggcagtggttagattttttttaatataatttctgtgaattttacacatgatgataattacacgtgattataattacatgttggtttaggggcattggtatgattgccacgtgatgattttaggggcatttaaaggatctaaatttaatatttgtttaatatggggcttaaaaatttgatcttaaacatttatattagaagtttgagctatgtatatggatctcgaattatgtatttaattataaatgacacaataattcaaaaaaataagaaaaaatgtaacttgatatttatgatcatttagaaatctgattattagtttttgatagattgagtgttaacttaaaaagtagcaattagcttaagaaataggagagaagaggagagttaggagggtggagggagaactcaactacgacgtaggtgcgcacatatggaggtggcggtgaggatgcatgtattagattttctttttagatgaagatctaatggttaagattaataggtccatcaatttttaaaagaataatcgctaaacatttattagaatttttacgatttttttattaatctattagctagaaaattaaaagaaggaaggaaggaaagaaggagggatgtacgtaccgtgggaggagccccgggaggaaggaggcagtggagatgggttttggatttttttaaagatagatctaatggtgtataatattaggtccatcgtattaagtgaaaatcgagggcaagatgttttttttcctcataatttttatgatttctctaatttattaaagcgtcatgtgaccagttaggagtgtttataggaagtttaatgggctttagctaaataataggaaggggaagaggagaggagaaccctgagcttttcggagagggaagggtcgatcgatttaaataaaaccgatgatcatatgcatttttcccctaaaaaataggttttttttaaaaaaaaaattatatgtgaaatgtgaagacatagaggtgttgtaatggacacctcatagatgatgatacgatatatgttgtcaatttttatataacgtttcattgctgcttagttatcacggaaaggatatggattcatgtctaaaaatatatttatcatatatcaagaaaggcctatatggatcaaactaaaaactgaatatatttaaaaatataatcatttagctatctattatttatatataatcatttagactatctgacgattggccaccagctatgcctgtaacaaaggaactcacatcccgtaactatatctcaaacagctttttttttacccattagatatgagataattgcagatgacccatcggatgcctatttctatataaaaacatagtaaatagagtgaatatatgacttagctcattgattaatttaattaaaaaatacaatcattcaagcgtattgtaaaatcaatgtatatattgtccgtaaaaaaatattagtgcttgaacgttgcacagacagctcgatgctccatgcaaggaaagatataaccatttacaataataagttatagtgcatatctcataataactaccttaattagaaaaagaagaaaaaataaagagaaaatgaggggagagggattttattttgatatgatgttttaaattaccggtgactattctaaatgaaaatcaacagtttgattttttttttctcataatttctataacttcttttttttccctttactttatcgcttttatcacataagtctgtgcttatgtttttcttctcgtccgatgaacagtaggtaattaagcttcatcgtttttctttcaaatgtacataacgtactgaatacttttttttttcccttttccggcccacaggaggaaatcattaccttttttaaataatacattcaatctaatggtttaaaatacagggtccaccaatttaagtgaaaatcgatgatgagattaaacagtgcaatgtaaacagtgcaatgtggcgatctagagatgtttgtaggagcgtcacgtgacggcttcagagcgtttgtagggagtttattaaacttttagtatataatagatagatagatatgccgtaaaacctagggttctctaaaatccactcaataagacgtgcattagccaaatgtttgtgtccaaatctcactaagaactgaatacaaaactaccagcgcaagaatagatttcaaatcaaaaaattggattcaaaatttatgcagtaaattaataagcgaacgactagccgattactagtttttactggtttctttatagttgaaagcaccaagctatatatctcaaaggggaatgagtcgcatgatccaaattccaaaatagcaaggatcgttgtatgcaactggttaaaaaaacacaccgctggatactattgaaccaatcaggaggctcacatgatctacgagagaatccatttgaagcaatgaagaggcttaccagaacacccctgttatttttaactctatgtttggttaattaatcaggtgatcaaataaagaataaaaatgaagctttgaccttgaattcatacgaattcttttcctggacgtgcacatacgaacgataagtcctacatatatatttactgcgcattgagattaaaaatatatctatatttacatgtattttctaatgttctcaaattaccctatgtaggataccaagtgtttgaaatttatccaaatattcataaagtactatttgctcccatcaatctcatatgtcactacttccaattacatctcaactccaaccaaccctgactaaacgagtaatataagtctttttcttttctcaaccttaatctttattaacaacttataaaaatccttatatttaaggacgaaatacagttctcacataaaaccggccccaaaattatcaacttcaatcgtccactcgtatacgtagaaccaagtcgctagtctttttctggaaatgtaaaacaatactgttctctcacaaggtccaaccgacctttcttaaatgaagggcccagatttgcgctaattcacagatggctcctctgcagcagcaagaactagagctggggtgtgtttagtccacgctaaaattaaaaatttggttgaaattaaaactatgtgacggaaaagttagaagtttatgtgtgtaggaaagtttttgatgtgatggaaaagttggaattttgaagaaaaattttagaactaaactcggccctaatgcagagtttccgcttctactaccttcaacttcaagtcattaacaaatccacaactgggccacttaagcagtaatttaaatcctcatcccgacatatgattgatttcccaccggccaaaaccactgcacgcgccgatgcaatcagaatcaatttctattaacattgacctctcgcagctcgcgcatgctcatctcgtcaactaatgatgaatgaatcgtgaattctctctctctataaatggctactaattcgatcatcccaaggcaataatccacagacagcaaaggatgatgcaagccaagaagccaagatcaccattgatgatgctcatcgccaagaagccgctgctgctgcttcttcttctgctcgttctcctggtgttggagccaagatcatcagcagaagctaacctcgtcggcgtcaatggcggagagacggatgagaggcggcttgagagcttggtttacgacgagctgcccttctcccagctcggcttgggattccctaccaccgtcgtcgccggtggctccgaggtacgttaattacgtacttaattagcgcaaattcaattgctgtaagaaagaaaaatcactcaaatgagaggttaaatttttttttggggaaaatgagaggttaaattaggttccaattgactgaaaatgcagcaaag

SEQ ID NO: 37664 - DNA, 4673 bp, Oryza sativa
  unsure (1)..(4673): unsure at all n locations
atctagatttttacatggattctgaagattgaaaacctaacattttgagattcttattggatagttattcgataggataatagttgcttcgcagaatctcaagcaatccaaatgggacctatatatacatacatataacggctcaattttccgttatacaaatacgtttgtgattaaaaaaattagtttaaaccaaaatgggctcgcaagttgtcttttgagaaatttcaaaccctgtttgtcgctaccaaactctaagggctctggtgatctgttgcgcgaatatcatcctaaaattttgccgaatatttgacacagaatgatgtggaggaagttgtgcaagcatggtacatggacgacgacgacaacgcggaggaagaccagaggcttcctcatcgccgccagcctgatgatcttcttcctctcgccaaattgcttggtatatatatttatctacatatttatcgagcttttttttaaaaaaggttaattttgtttagcctcgtaagcttgttaattaatttctttccagtggcgccgatatccatgcgatgtttaccactagtgtgtatgtatgtgtgtacacacaaagatgacgagtttttaattagtttttttgcaatttgcagacctcggactcgttgcaatgcgattagatgcagataaccatgagcacgatgagaaccttaagataatgcgtgaacagagaggctacttgcacatggttagtcttcttgctattaggtcaatctttacttttaaaaaaagatgcatatgcatgcttaaattagtttttgtttctgctttcaaaatatacttgctattaggtcaatatttacttaaaaaaagatgcatgcatgactaaattaggttttcttttttgtctgctttcaaaatatactcctcatatagacataaatattagatgtttacgataggaactggtcaaactattgaaactgttcatctattttattttaaataagtttatcaaatctacttctgctccagaatataaaaatttttagagtttgatacggttattaagaaaataggtagaattatatggggagaggttgtgattggttgagaagtggaggtatgtggaaaaaatgaatggtggagggttgtaattggttgggagagaatattgatgaagaaatagttatatcttagattaaattctaaatgctagaaattgttatattttaggacggatggagtaataagtttatggtggtattgtgatagcccttttcaagataaatatatacatgtcattttttttgttactaagtattagagaagttggtggtgtaacttttaaaatttagatcaaatcttgttgtaaatgtcaaatatttatgagagggagtagaagctttgaaatgattaccttgttgttacatatctatactatctatatagttgataccaactaactcctaaaacttaacatctaaatgtgcaacattatcagccactagcaattactccctctattttttaatatataatgccaatgatttttttaaatacgtttgatcatccatcttattcaataattgtatgtaattatgatttattctattgtgacatgatttataaccgaatgttctttaagtatgacttaaaatagttttatatttgtacaaaaattttgaataagatgaatggtaaaacgttgatttttcacatattaaaaaatggagatattattatctagagtattttaaataccatgcaagcatggcatcttatttataattttgttgtatttttagaacttgatatacaagcaatgtcaaatcattattttcatattatttaaatgtatacatctatcatttatataatgtataacatgcattcatctacatatcacatagcaaatcacggggtatcaactagtatatactaataagtaaatccacgtcctatcacttaattttttggcatatccatatgccattcattattatttatatgaaagaaaaataataataatgtggtttacctctttcggaaggcatcatagggggtgtttagatccaagggtgtaaagttttggcgtgtcatatcgggtattatatagggtatcgtatggggtgttcgggcactaataaaaaactaattacataatccatcagtaaaccacgagacaaatttattaagcctaattaatccatcattaacaaatgtttactgtagcaccacattgtcaaatcatggagcaattaggcttaaaagatttgtctcgcaaattagtcgcaatctgtgcaattagttttttagcctatatttaatacttcatgcaggtgtttaaacgtttgatatgacaggtgtaaaattttgggtgggatctaaacacccacatagtttctctttgcagcaaagctgtgattaatttgggccagctctagttagatctcaatggccatggattgtaatcctacttatggctaataatgatcaatcgattatccaatctaaaaaatcgaacttaagtatatgcattttttgcattttcgtaggacatcgttgaattgaccccagagaaaatgccaaattatgaggtgatgatcaagagattcttcgaagaacatctccacacagatgaagaagttcgctattgtcttgatggtagtggtatgtgcgaacaatttactttaccttgattttttgttataacgaaacctttcatctcaaaaaacaaagaaattttttatttcactatattgctgattttgaattttggaattaatgaaggttacttcgatgtgagagatgagaatgacaagtgggtccgggtttcagtgaggaaaggggcactcatcgttgtgccagccggcatctatcaccgcttcacacttgataccaacaactacataaaggtaattaaagggcatagaattttcaattaatggaaccaagaaaatgtaatctgattggtttctggtttatttctacaagattttatcagatttaacttttgaaggtagttgtgctaactgcatcacattagctccgaaaatagccaaagcgatgacaaatatctctactattggattcataaagagcgaatatatagttggtcagcaaattccccttggtccttaacaacaattttatcctaaccatgatcatgacatggtaccctttcaaatatttgtagtcattttcttttgtttctgagtgggtatcaaaagaattccttgcagttcagtaatcctttcgtgattaattaactgacagatggggcctgggggcctcttgtttgggtttttacagaccatgcgtttattttcaggtgggccagattggacggcttacaatcgtcctcatgatcatctgcctgaaaggtactctatttcactatgcagggataaatttcggggttaatctaagctaattaacctgttccctccctctgttttttttttcttcaggaagaagtatctagaagcgctgcataacaggaccccgagatttggacaactgcatcgaattcgctcaaaaatggagtaatttttattttgaaaatagcattaatatatacccatctttcctcatcattaataaattttagattttctgcatccgtcaactgatgttgcgaagtgattaagatggtggtgttagatagggtgcaatgggccaatgtttgatctcttgatcaagcaacgacaagatatatatggatcatgtatgtatttttttttaaaaaaaatgtatcatgtatgtagaacaattgctccaatgcaagtgtttgcactactgtagacctcctcatgtataacatttcaaaacaatctatctataatgggtatgtcaactgatacacattccattgatcaaaggaacccttatctatatatagcggctcagaattacgaacccttagatttcaggatttgtcaattgacgttatacacagatatactcttgttagtaacggctatacaatggcctattcatacctgccgttatagatgagaggtaataggtgacgtcgaaacctcatctataacggctaggtattagcaaccgttacagattattataactgatacccttaaaaaaatacaagtacttgagcatacctgccacgattgtaatggccatcacggcaccatcgcccttgttccactaccacttgtcactagatttgtaccctctaattaagcatagagcggcggattcacatattccctccgtttcacaatgtaagtcattctagcattttccacattcatatatctatctagattcattaacataaatatgaatgtggaaaatgctagaatgaatatatctatcgagatttattaacatcaatataaatgtagaaaatgctagaatgacttacattgtgaaacggaggaagtagttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37665 - DNA, 826 bp, Oryza sativa
aagatggcaacccaaggttagtgtgcagataggcttacagactggatcaagaagaattcacacaaagaccttgtaattgtgtcgtgctctaagctcaaggggtggacgccctaaggctaaccctaggttgtcgttaatcatatttattcagtagccatcattgtttagagtcaggtttttcttagattatttccaacattacaatttcatcgctagttaggtttgtagaacccaacttcgagtgcataatcattcatctgcaactgagttgcaatctctcttagttttgtttgtgttattcggtttacatgtagggattagccttctcaatgaggtaaattggattttagcatgtttgattaccataagagatgtggtgctgcgattgtagagtttggattgtgttgatcagaaaccggatcatgcgcgtcaagttttcgtcaaatagagagttatcagtacctattagaagatcaggacctatttcctcatcagagtcagtctcaaggactacatatgccattaggaatagcaaattatgacaattaattgcaacaactgctgccaactaagctatgattattttgacgaaaggaaaagctatgtcaactttgtgtcgatggttgaaacacttcaagctacagttgatgaaatagttcatcgtaccttgttcgatcaatctggagttttgacggatatattgcaaaattcgatcaaaaggatagttgatgagttaattgtccaaagacgccagctcgggtggcagattgaagaacaacaacaatatcggctcggggggaaaacatatcagtatcagcatgatgag

SEQ ID NO: 37666 - DNA, 10605 bp, Oryza sativa
aaagttagatttttttgattatcctccgactagatcggccttcacatggttttcttctttaccatcaaattctatcaaaggttgggccgatctagaaaagcaatttcatacatacttcttcgctcgcatcgatgagatgaaactttcagatttgatatcagttcagcagcaggaaggagaatcggttatggaatatattcacagatttcgtaatgtccgcaaccgatgttatagtttaagtctaagcgatgagcagctagcagatcttgcgttccaagggctatcaacacctatcagagaaagattcttttgccatgagtttgacagcttagcttatctaatgcagacagtatcggctcatgaaagccgattggaagaagcaaaggaagatcaattttggaggtaccaagatcggacagaagataattttgaagcatgagacctcatactcaaaaattggggggcatgtgttaacgccaaaatttggtaagcccgaagtcaccatcggcctagagtcagtgtcggcttcagagtcctgggatcggccgatgagagttatcaaatcgcccgttgtcggattcttactatattcggttaaggaaattaatctactaaaggaagcttatccagaagtgatcgaattcaaggaggatgcggcatggcgagttatctattaattaggaatagtttgttagtttccttttatccttaggaaagtgtgtttagtgtcctataaggactttatgtttttatttttttaggaaagtttctttcttgtcctacaaggactagtatcttaccatgggtataaatatgtacacccgtagtcattgtacaaatatctctcgatcaatacaactactctcggcccatcgccaccctcttttttgaggttttttcttattcaaccggcggaatttggcacctgacgcggggctatatcggttcagttcgatctccggcgaaggggtaagtcctacgttccgccggccctggcgaatctatcggctgcgttggtgttgttcaaggctgcatcgctttgatctcctggatcgctctggtttggttgatatatttgcctacctgatatctcaattctatctctaattgcattgtgtttagagacgcatcagtttagttgggactgtctcagttaggtccgatcttctgtcttagccgatatatctctacaatcacaatgttgttctaaatagatttgttttatccatcacattagacagatctatcggctcatcgagtattagattatcgtatataatctcgtgctgtatcggttaggttcgacctactatattgttgttgataatataaatcttgttgaactgataggttcatgctttatcggggtgctagccgataagttatctggatgttgcatcggcttataaggattacatataagttgggtttagccaatcgcaacaaatgttacactgtttaatctaatcttgtggattttacgacatcggacctgcagccgatgtatgctttaaccgtcggatcagtgcttattctatcatgtcaatgtcagccgattggtttatactggattaaattgttgctttcttgcattatcatcagccgattgcctttatgtcaatatctacattggacatatagccgattgctcaaaatcctatcgctatcggctggtatcggcatcggttggaattaatacatcggcttgtcagccgatcggcacattgatctgctatttgtatatcttatcagttgtagggtcaaactgactggtatgcccacatctcaccaacatttggtcctgcactggagctatgcagatctccctggccagtgtgtgttttttcgcgtcaacacattttttatcaaatgcttactgctgcaataggtcattggcccccatacagcaagctgaatatgccctcactctaacatcgattgtcacattgctttgattagatatacaaattaaattgtaccaaagtacccctaataacaaaagggttggctaaatcggtcctatattacaccatacattacattagaagagaagatatgaaattacctctccatcatatattataaccatagtcaaatagcaaggagatgggggtcgacaagacagagcagtgggcagctacaaacagcaatgggtggagatctctgcagccagtcggcctccctttgcaccccagctgcgggccgcccttcactagagagccaagtcgcacataggcctccctctgtccaaccccaccccttccttcctctgttcctgcgatcggacgagctccgaatgcgctcacgcccgcaccagccaacttccctctgagctcgtgcgcactgagctccatccatgcccgcaccggctgagctccctccgccctgtgcccacacctggcagagctccgtccgccttcgcgaccgtgcacctagcatagctccatgccggcgaccgcacactgcatcttgctccgcgccgcgacctccctcccggccacacgctgagccaccaacacttcgctcaccttctgctcgcctactgcccaaagcctagcttcgtcaagtctaatatgggatgacggaagcagtggcgaatctatgatgaaaatgtaggtggggttttatttatcatcgtaatataaaataatcatatatctttgatctatatcaacaatatttgaaaatcctacacggatagaaaaaaatacagtggattaaagaatgaagggaactgaagagtgaaaaagattaaaagatatatatagggatgggctacacactgacagctactaaaacacgaaagtaaaagtaatccacatcgtttctttcaccctgaacatctccagccaaatatagtcatcatcggttggctgtttgctgtaattaattttgttggcactatgaactcactagtcactacacatagacatagatatctgggatcaatccctgtcagccagagctggggctggagcctcaaccagccccaacagtggattcgccacaaccagccccaacattggattcgccactggacggaagggggaggaattagaatccacccactcctatgttatttcctaggagcatttcagtctttcatcctgaaaatgacatacacccctaaagcttggtttggaaagggtcagtcggcaggtttggtattttaaaccggggttaaataaccaaagtttaaaagcagggctaaactcatagttaggttttaaaataggtacaatggtgccattgcccctactaattatgaaattaaggattacgtgaccaaggaaatctaaaattaccatgacttaactttgtctttaaataatattgttcatatgtccttaaatgttttccatctatctatctataagtttactaatttgactctgaataagctcctaagttaatcataaatatcttacgatcaattagtttgatcgaatgatcatggccttagatagtcaaattcgtataaaataaaaatatataccttcaaagataacaccaattgaaaacctatgcatacggtttaatttgaattgaaaacctgtccagaccgaaaaatcatgtataactttgtcaaggttggccaaactaggtatacgtagtcataagccaattaattgctatagaactagatctttgtctgaatcaatatcaactatatcaactattcctaattaatcttagtgataggtatgaaagattaatctatctgctttttatttagaatgacttgaccgaattcatttgtgttaactaaatataccactgaaaatttcaaactattcagattttttatatatgccgatacaattaagaaaaacaactaatatttttactaaatggttaaatttttaatatattataacattcacaataatagtccatgtaatacttagtctggctactaatataaataatgtatctatacaaatagcccgtgtaaatacatgggtttctgatgcttctactttggtagtacactcacaatattcttgaatagatgttactctaggatatgtgtaggcagaaattgaaatgtttaataaatattgtacaggaaaatattaaggtttgagacatagatatgtaaaatagatatttatatatttataaatatagctactcacttctagaaatcggcaataagaaaaaggggtggcatacgaaatctaaaagtggataagtaaatggaataatgatttagacatgcttaaaccttgtcgacaagaagtaatactctactcctgattggggattgtatccgtcgagtgtgtattgatttgacaatcgagtacgttgtgaatatgctctttgagggctccctgtccaccttatataggatcgagggcatggttacaaagaggaaagcttagccgaacatgagattggtttccatgccgtgggaaagaagggaacataattctcatgtcttaaagaaattacgtaatacatggatccagctcacctcctatctctctttttagtagtcttttttaatgttgatttgagaaaaaataatgatggaaaagatgcatgtcactactacagaaaatctcataggttgggaatgggctataggtgccagtttcccaaccggcacagattggtcggtacctattctcgaaattattggtgcgggttgtagagccggcacctatgaggcatatggaaaaaaaaaagagaaagaaacgccaccagtctccgccaccctgccgcccgccatgcgtctcgccttccgccaccgccgctgtaggccatgtgtgcggccacttcactaccttctcaaccaccaccatcccatccaatatcacatcatccccatccaaaaatcaacagcaaactactaaacaagatggacatggaggaggagaaagcaatggagaactcaagaagtcaccacctcaccgaacgccacatcgctcgtgccagcctccaccgccgccgttgccaccgccgtcgcgggatccggcggttgccgccggccaccgcctcgctgccttgccacctctccacgcgtgcgccggccgccaccacccgggcctgcctccgcgtcctccgtcggccgccgcaaccacctcgccacgcctgcgccggcctccgcgtcagccgccacccgggcctgctgccgctcctccatcgaccgccaccactcctccgtcagctgccgcgccgttcgataggtaaggggagaggaggggcgaaggaggagaaataagaggcggaagatgtggataagagaaacgataaggtcgttgtggataagaaggagctgcgaggttgcattatatgctccggtttttttaataggtgccggtttttcaacagagccgacacctatgcttatattatatgtgccagttttctttagaaccgacacctataatataagagtaggtgtcggttctattaaaaaaccactacctacagtattggtgctggtttttctctagaatcaacacctatattaattaaaggtgtcggttctatatttttttcatcgtgtggaggtgggaaaaggctcataggtgccggttttaaatgaaccggcacgtataaggccggttcctattagggtttttgtagcagtgtgtattgattagtgcttgtaatacttctactcgatccctctatgacggaaaaagtctagtacagaagatggatgtaagttcagattcatctatggaattgaatactctctccattttaaaacgtttgacaccgttgacttttagtacgtgtttgaccattcgtcttattcaaaaatttaagtaattatttattcttttcatatcatttgattcattgttaaatatacttcatgtacacatatagttttacatatttcacaaatttttttaataagatgaacggtcaaacatgtgctaaaaagtcaacggtgtcaaatattttgaaacggagggagtatttttttacgtagggaagtacatggagtctccttactgaacatatggaactcaattcctgattgaacggtactggcatgaacggtagaacgggacagtagggataaggatcaggaagttcggcagagatgtttccacgagtttagtacggtagtattgttgatccacatcactaggcaccggaatttctgcccggtcattctcctccacacaagagcatacaatttctccggaaaggacccggaccagtagagattgagttggcgtgtagctcttgcctctcaaactctcccaatcgttgtacttagctcaggtacaggcactgtatttgtgtctctcatactctcacaatcatcgtattaattagcacaggtacaggcatactgtacgttcttgttctggaagacacgtgctttaggtttatcatgcacttgccagctggttcggtagagcagtagccaacggcaacttccttcttatcacgagcacgtctcctgtatgtttttcgaaaataacaattatgaagaagttcttttcaaataccaaatgaactattttttaaaaattttactagttaatacttagttagtttgcctcgtttcatatatcaccgacttatcaaatcctactgctctatcgaactaagggcatcagcaatgtatcgtttaccaactaccactactacaaaactgcatacagaggtcggcgctaaagttgctagaagtgttaaaacctgcacttataggtcttctcccactttcgcggccttagaaaacagaaaacaacacctttaaatgattataggtgccggttttgtttaaaaaccgacactatactacatgtgctatgttttattaagaaaaccggcacccccataaaatcgaggcgagccgaactccacacattgcgcgtaccctctcctccttatctccgagccggccttatcctcaacctctctcaccctctctcttcctcctcctcctcctcaacctcgctctctctctccccctcccccctctctctctctgtctcgcgggagaggacacaagagccagtaggcgatggcccagcaatggtggtggccccctcccctccgctagatccggtgagaggggaggcaccggcagcccgacgggaagggaggcgatggttgccaagaagggaggaagagaggcgcattcaccgagcggtctccccgtacgcctccgactcgttctgtcggtgctctgtctccctctctcagctctctctctctctctctctccctctccctctctctctcggtccctttcaactgtctcccgctttcagcctctctccagcagcccggcggtgttgctgtctcttccgctagatccggcgggaggtgaggtggtggcgacggttcggcggtggcctggcattggcgccctcccctcctggcggcggggctctgcgggacaacgtcggcagcatccgcagcgacggagcatcggcggcggggcctcccactgcggatccgacgttatcagtagttaatttaatcatttgtgttcatcttgtgcatggtgtcaatccgtgttcatttgttcatatattaatctgtgttcatttgttcaccttgtccatggtgtcgaagtatcgactcgagccgggttccttttttgtagctcgtggattccactttggtgccggtttttaaatgggattggtgccggtgcactcatcactgccgcctctatggtgccggtcggcacctatgtgggtttaccaaccagcacctttgatgttttgtgttgtagtttactatctcagtttcatattataactcattttgacttttttagtataatttcttttaaacttgataagctttagaaaaatgtaacaatattttaagcacaaaacaaatatattatcaaaatatatttaatatttctttcaattaaactaatttggtattgtagatgttgctaaatttttctataaacttagtccaaattaaaaaaaattaaaaagaagtcaaggcgacttataatatgaaaataaggtgggttctaacaaaaaataggaaattgtttttcaaaatctcacaatgtgtaggggaaaatatggtcacaccgaaaagtgtgttacaatctaacagtgtgtaataacatattaagaaagaatcaacacacatagctaagagaattcattctttgttatttcttgccagtaggttgtagtgctatttcatgatattcgttcataatgtttattatttggtataaaaaatgtatttaacacttattgcaccctcgttataaaagtgtttattttttacatattccacgtactagaacaaaaccaaaaacaaccataatactcttactttttcaaatcccaatgcaattattccttgctaaggaagtaaatgtttttttgttccttgttaggaggttgtagtgctattgcctgataaatgttgcttagtacctccacaatgtttgtcgcttactacaccctcgtctgaatgcaatatactatctcctaaacagtgcttgtcaatggcaaaatttggcaatttccattagtcaaggccaaatcaaaggtagagttctaagctgaggaagtcatgttagaattggactcagttagtttctttttgctacatattagctgattagagtttgagttggagttgtataagtagtttcttgtttaggatagagtgctaagtcgatccgatcttagtataaccagacttagttttgcctatgggtataatatgtacacacatagggtttttgtaagataacaacagttcaaaacatatttttcggtgcatcgccaaccctattattagttttgacgagttcttgtttttaacatggtagagagctcttacataagggacttatttggcgaatagttgatggaaattcagttgatgtaatcaaggataactgggacaagaggaacagccttctcaaaccacttggttttatcaatgctttactattcatcattctatagttaaaattttacagttttctttaaaaaaataaactgcactaaagcttttattgagatggatggtcaactattatttcaaaactcaacaacttttcgcacatggaaggagtactacataattatgttgcaaataaaggggatacacagctacatatgcatagattaatcttaaaaacactcaataaaatcataatatatatatatatatatatatatagactgcgtgtccttgttcaaaacactaaggcctcctttaatggttgagctagtgcactagcaaaaagtctacctttttaatagattgtctcatagcacattgttcaaaatgctttgggttccacaatccctctcacatttttttaggagcttagctcttgaagaagagatagtgcattctctctccttatcttctctctcttccacatcatacaaaaactgatgtggagatttatgagctagctgactcacccttgttggaggaggcctaagtactaccaacctggagggagtaccgtgtttttttttaaaaaaaaactgcactaaaccatttagtaaaacaaatggccaactattattgcaaagctcaacaactttgtacatatggaggagtacataactttcaaaacggagggagtgggtacgcaatttctccctctaggtagataatacttaccattttggataaaactgatatcaaactttaaaatctttaactaagaataatttctaaaatatttcacttataagtattgagaccatatgtatagatttgtcttaaaaagcacttcaataaattcatatattcgttgatattactatatatatcataatataaaatagttgtcatagttattttttgaacatcatgcgtatccttatccaaaaggataagtactccaatctagaaggagtactgtgttctggttcatctatatattagaggcatggtgctatgcattcgcattcataaatatcaagccaatcggcaatcgctgagatttactagtacttactgtacctgcataaatacataaacacataccatattatggcctcgagtgatactcctacccatgaggaggcactcagttttgagccctcgatatggggcgacttctttatcaactacgaaccacaaccattgcaggcatcaccactactcattcctatgtgtacatctgcccttctaattttaattaatgccatgctaactagctaatagctagctaattcgatggatctatgctataatttcatgcagagatcagagaggtggatgcaggagagggctgagaagctgagagggcaaatccagacactatttgggacctgccacgacatgtcggcgaggatgaacttagtggattccgtccaacatctcggaattgatcacctcttccaagaggagatagaagatgctctaacaagcatccatggcagtgaattcagaagctctagtctctatgagattgctcttcggtttcgcttgcttagggaacatgggttttgggtgtctccaggtatccaaatgcatccatccacctaatatatagataaatagtttattattccgagattaggaatttttgtcttcgagatttgctgaagcttacttttgttcgtttgcgacattatagaaattttttagtctaaaaccatacgacacatgcaa

SEQ ID NO: 37667 - DNA, 2193 bp, Oryza sativa
tcacgtaccatttttttataaggactatattaacccaaataattaatttagaggacatgtctggacgatttgaaacctgactaaactgagcctgaagcgaaacttcagtgaccatattagctattcaccctttttaattccaattttctattatttcctaattgtgtttctatatggactctatactctacttctaatattccttatttttaattccgaatttcagttatttcctaattgtatttatatatgtactatgtactctacttctattattccttatttttaattccgaatttaagttatttcctaattgtatttctatatggactctagtctcctcttctaatattccttattttttaattccgaatttcagctatttcctaattgtatttctatatggactctagtcacctcttctaatattccttattttttaattccgaatttcagctatttcctaattgtatttctatatggactctagtctcctcttctaatattccttatttttaattccgaatttcagctatttcctaattatatttctatatggactcttctttttctttttctccgattaatgtgagaattttctaggccatgagagcgaacgtggaggcttctttttctattccaaattttagtttgttttaaattcctatatggactatatactatgcttctaatatttcttattttttaattcggaagttctatttttttcttaattgtatttctatatggactctatactctacttctaatattccttatttttaattccgaatttctattatttcctaattgtattattttatctcatataatagcatatatgttttctcattatattattcaaatatattaaaatgacaacataattctaaattttgcaataactttacaaaaatactaatgtgtaatattcatattgtattttatatacgtgttagttattaattatttttaatatcaaattttagttaattttctgtaaattgtatttctatataaactctatgctcttgtttcaatattatatatttttatttctgaatttttattatttctaattgtatttctatgtggactctaaacttatctttcaatattctttaatttttaaatttgtatttttttattaattgtatttctatatggactctacttctaatattccttatttttaattctgaattttaaatatttctaaattgtatttttatatagagtctagtctcctcttctaatgctccttatattttaattccgaatttcagctatttctaaattgtatttctatatggactctgcttttttttttctctaattaatgtgataatttctagatcatgagagcgaacgtggaggctcctttttattccgaattttagttagttttaaattcctatatggactctacactctacttctaatattccctatttttaattccgaatttctattatttcctaattgtatttctatatggactctatactctatttctaatattccttatttttaatttcgaatttctattatttaaaaataaaaagattagtttaaaaagattattattattattattattatttataataaaaagattagtttaaaaggttgtttataaaattagtttattattaactaattaatagttttctattttatttatttagtttattttgtagtatatttataaaaacaaactagttcacctgaacatcgtttggaaattctgaaaactatttcagtttgacagccgccggctctcgtgagcgtcggacgtggtcacgcatccaaatgttcaatggaacgcgtttcctctcccacttgtgaagatataggttgggcagaaacctactccattcgagtgggtgaccaagtgaccaggtgaaaaggatcggaagcgacagaagagggatcggctgtcgcggtgggcgcaggcaccaggcgcacgatgcgcctccgtccgcggattgccgccagatactacgaacttttacacgcatgaaatgcaactctgcccgaaaggatagtagtactagatgtctagatggcaattagcccatgtgcaccggccagccacatcagtcgaggccgcgtatgcatggccggaccgcaactaaccgtggcggcacccgtggtacgttactcgcgcgtggccggtcggcgccatttttg

SEQ ID NO: 37668 - DNA, 1124 bp, Oryza sativa
ccccccccccccgaaattttttatttttgttttatttgtttgatatttttttcacgcttagggacacacaagaaccaaccatagaaaaattgaactcaaatgaacgtaatatgtgacatgtagaatttttcctctcctctcctctctccgaactagtgcagaggagagagatgtgcaacttttttatttttattttatttttttgatatttttttcacacttaggaactcacaggaaccaaccatgtaaaaaataaactcaaacggacgaaatatgtgacatatggaattttccaaagctccaccgaaaaacttctctcctcgacaacacaatcttgcaagcggaatttggaggttttaatatctccgaacccggcaaagctggggagaatcggatgtaactttttctgtagatgtccgtgcatatattatttgcctgattccgagtccgtatgagaaagttatgcctattttaatagatgatatattttgtccattttggtagagttttggaaaattctacatgtcacatattttatccgtttgagtttattttttatacggttggttcctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaaagagttatggtctaattttagtgaaagtgcaaagtagactaagtggtatgctagatattttcagacttagctaagtggtagttcgagtttaaattttttttttgtggttggttgtatcgtgatcttgagtatgaaaaaacatccgaaaaaataaaataaaaatgacaccgttgcaactccatacagagaaacaggaatggaggcggcggcgccagccatgctggcgccctccttcctggggcggcgccagcatggctggcgccgccgcctccattcctgtttctctgtatggagttgcaacggtgtcatccttattttattttttcggatgttctttcatactcaagatcacgatacagccaaccacaa

SEQ ID NO: 37669 - DNA, 2650 bp, Oryza sativa
  unsure (1)..(2650): unsure at all n locations
cctaaagcagcagctcaatcgatttatgagaaggaggcaatggctattttggaggctcttaagaagtggaggcactatgtgttgggcatcaaacttattatcaaaactgatcaacaaagcttaaaatacatgatgaaacagaggttagtagagggtatacaacacaagttacttctgaaactgatggagtatgattacaagattgaatataaggctgggaaggaaaatgttgtagcagatgcactatcaaggttgccccaaacagaacatgacaatgaggattgtcaggccatcactgtggttattcctgagtggatacaggacatccagaatagttatgaaggagatatacaagcacataagatgctgagtatgattggaactgacagcgaccctgataggagttacagtctagaatctggaatactatgatacaaggggagaatatatgtgggagactctaattccattagaacaattctgctccaggattatcattcttctgcatttggaggacattcaggaataagggcaacctatcagaggataaaaagtttgttttactggcctgggcttaaaaagaaggtggaaaattatatcagagaatgtcctatgtgtcaagtcaccaagtctgaaaacattcacatacctggcttgctaaacccattagaaattccagacatggcatggactcatatatccatggactttattgaggggttaccaaagtcacatggaaaggatgtgatattagtggttgtagacaggcttactaaatatgtacattttgtggcaatgtctcatccttacagtgtggagcaagtagtagaggtattcatgaacaacatacacaagttatatggtatgccgatggctattgtcacagaccgggacaggattttcaccagtcaatttttccaggaagtgttcaaagcaatgaaagttcatctcagatttagcacagcttatcatcctcaaaccgatggtcaaacgaaaagagttaatcagtgccttgagtcatacttgaggaacatgacttttaaggaaccacaacactggtactcctggctcgcgctggcagaatggtggtataatactacttatcacacatcactgcaaatgacaccatttcaggccctgtatggatatccacccccacgaatcaatgaattttcactcccatgcaatgtgtcagctgaagcgagggttaccattgagcagaaagaggaaatcttatagaaacttaagacctgtttggctgaagcccaaagaagaattaagcactatgctgacagaaaccgatctgaaagaactctaactgttggggatatggtgtatgtgaagctacagccttacagacagacggtttttggcattagaggatctcttaagctgagatctaagttttatgggccattcaaggtgatagaaaaggtgggacaagttgcttatcggcttcaattacccaatgatgccactattcatccagtcttccatgttagtcaactaaagaagcatttgggaaagagagcaatacctatgcctaatctgccatcggtaggtcctgagggacagatcaaaacccaacctactgcagttttacagaggagaatgatacccaggaatggagttgcagtaactcaatggttgattttgtgggaaaatttggggccggcagatgctacttgggaagacgctgatgtcatcagaagtatgtttccaaccttcaatccttgaggacaagaattgtcttttggaggggatattgtcaggactctagatcagaaatgggaagtgagaagaaagtctgaagaaaattcagagataagaagattcagagaagttcagtgaaatgggagagagatatatcgagtatgcaaatccgatggtggcggatcagagcaaagcggtatcaacatcatctggccatcatctttgtcgggggccactgttaatgtaatcgttgtcnntttcctgaacttaattacgtaaacatctgtctgaaactgaggccacgatgaatgtggtccttacccttttttaagactatttaagtgttcgctggagaaaggaaaaggatatcaaaaagcatattctttgtcattaggagtagatagatctagaaccctaatttcgtcttgcggcatccactgaaatttgcgattctgatctgaattttttgttgaaatttccatttctattcccagctcttgacagaggggaaggggaagaagcccttgcagacgaagtcagactcagaggaggaaacatcctcagagtcggagacggaggagcagtacatggagacggacgacgacgacaactacgacgacgacgacgagtatggttttgtaaaggggaggttttgcaacggtctaggtgagctctctcagttgacatctccttaatcccattcccacccactctgaccggaaggaaacccctaaccctaaccttgtagttagtgttcgggaattggatcccaggattaggggagtgcttaattgctgcaccgggtgtcaagggtttttgtgattaggctgtgttttgttggcggatctggtgagggctagagagcctttggccagcgttttgatttattttgcttgtaattctgcttgcctgaatttccttgatgaattctatctgt

SEQ ID NO: 37670 - DNA, 7610 bp, Oryza sativa
caccctttgttctctgcatgctctgatcacacacctctctttttagtgggtaatgagaagaggagcaaatctcccatcttcagatttgaatcttactggcttaaagttctaggttttctagaagtggttcaacactcttggcaaaagccgattttgtcgtctaaccgactagccatctttcgcctaaagcttcggcgtttagcccgtgaccttaagagatggagccgctgcaatgtgggagacatcaaattgcaattggctgttgcagctgaagtaattttccagctggagctagctcgagaatccaggtcactatctgatcaagagaacctactcctctccaatctcaaatcaagatttctaggtctctcaacccttaataaaattaaaattaggcagcgctcgaggctcacttggctcaaagagggggaggtcgattcaaaacttttccatatcaaagcaaactctaggagaagaaagaattacatccaatcacttcaaactcccttaggagtggcaatatcggcacaagacaaggaagacgagctgttccgttttttcaaaactagacttggggcaaatgtgcaaagatcgttgggtctcaactgggctgctttagggctcccgtccttggatctttcagaactagaggaggatttctcggaggaggaaataaaagcgacgatcttctctttacctcccaaaaaggctccgggtccggatggttttattggatcctttttcaaagtctcctaggagattatcaaggatgatatcatggcggcaatcaattcgttcatgaaccttaacacatatcaactggaaaaactgaattcggccttcatatgtctcattctaaagaaagatgacgcttctgacgctaaccactatcgacctattagtctgatccatagctttgcaaggataatcactaaaactttagcgaatagattagctccaagacttaatgagttggtttcccagaaccaaagcgcatttctttggaagagagcgttacatgacaattttctttatgttcaaaacacgatacaactgcttcatagatcaaaaaaaagcagagcttattcatcaaggtggatatatcaagagctttcgataccgtttgttggccctacttacttgaagctctacggaatttcggttttgggaacagatggataaactggatcactcatatcctggcaacatcctcttctcaggtcctgctaaatggttcgcctggtcactcgatcaaccatgctagaggactccgccaaggcgaccctttgtctcctatgctcttcattttagccatggaacctttccatcgaattcttaaagcggctgaagatgcttctgttcttcaaccggtaaatggacgcaatgcaagattcagatgttctctttatgcagacgatgtggcaatttttgcaaatccagatagtgccgaactgtcttccctctcacagttcctggatttctttgcaaaaatttctgggctccatccaaacatcaacaaaacagaaatctttcctattagatgtgatgagatagatttgaacaatcttctttcaagtttcccggggatgattaaatccttcccttgccgataccttgtacttcctcttcactatcgaaaactaaggaagattgatttcatcccgctaattgataagattgggtcacgtctaccgggatggaaggggcggttcttcacctctgctggccgtaaaacccagtccattcggttctaagctctataccgattcaccatctaacggccctccgcgctcccaagtggagtgggttttcaaaaggattgaccgttttcgcagatcctttctttggaaaggcgaggaccctgatcatactaatcccggtgatagtttgattaattggcaactagtttgcagaccacaatctctagggggggctggtcttcctgaccttgaaagatttgcaagggccttgcgcctccgctagctgtggttttcttggaaatccgacaacaaaccttgggttggcatgaatattccctgcgatgatttagacaaaaaactgtttcaggcggcaactacaatctcggtggagaacggcgctaaaactagtttttggcatgataattggctgcacaagaggtgcccaaaagagttagcccccctctgtttctctttagcaaaaagaaagaatagaagggttcagttcgagttgatgaacaataactggcttttatcctttagacaaattacttttgtcgaagagttacatgagctggtgcaattgggaggcctgctccaataggttcaactcactcaaaatgtcaatgacatagtctgtaattggactgaatctggaacttatacaaccaagagtgcttacttataccaatttgctggttcatacactacaagcgattttacctcactctggaaagcccccgctgagcctaaaatgaaatttttcgggtggcttgtcctccatcaaagaactttgatggctcaaaacttgctcataagacattggctgtgtaattggatttgctgcttgtgtacctccgccttcgaagacaccaatcatctgttcgcggaacgcccgtttatgagacaagtatggtctatagtacatttgtggcaaaacttgccctcagttttcaattcccttccatcccgcgtctcaacctgctgggatgagcttaaggacgcaggaacagaagatcaaaaattattcgctcgaggtgctatcctgacaacttggtggaacgtttggctagaaagaaatagtagaatctttcaaaatttatctagttcggagttgtcagtagcttatcgggtaaaacaagacttggatttgcgcaaagtggctttcaggccaccctaattctccttttgttgtaacctttcccatgccttcctgggtgaatttttttgactccttttaattaaattccggcaggtcttctgccgtcgttcacctcaaaaaaaaattgaatcatagaaatgcttttggtttggaacaaggggaatattagttatcttagaggactattttccttgaaataactccatagttttgaattcctcccaccttaccctactaaactcctaatacacatttaattggagcattataatattttttactccatcatatctccaaaacaaactaaaatctctcttatatttgagaacgaactagatatctggcactagtacagatccttccatctgtgacggcccataacaagactggaatttgcgggccgtcacaaggaagtaatctcaatcgggccgaagtttcgcccgattgagatatggtcgcacaaccatggtatatcggcataaaactaaagtccgtcacggatgacacttatctgtgacgggctatagttgaggcctgattgagatgagggttccatatctcaatcgggccctaaaagaagcccgtcacagatgagggtcatctgtgacgggctccaactagaggcccgattgagataagtttattgcccgtcatagatgacactcttttttgacggccttttattaagacccgatagagattacttgtatgcccgtcacggttgattgttttagggccgttacagatatttgttgcacaatataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgttttttttgtagcaattgatcgaagttggatgtatgccaaaaatttgaaacgtcattctacggagtaccgaaagggcgtaataaattttatgaacgccgcggaggaggatcggataagaagaaacagtgattacatgtgttgtccatgtgcagattgcaagaacgagaatatgtttgatagcggagaggacgtacacggtcatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacccagtccagaatgagagagatggaatgaaattcagcaggttggtaagtgattccgagacgcctttgtacgctggatgcaaagcaaaacacactaagttgtcagttaccttggacctaatgaagctgaaggcaagcagtggatggacagacaagagtttcacagatgttttaggaattttgaaggctatgcttcctgttgagaacacattgcccgagacgacatacgaagcaaagcaggttatgtgtccactggggttagaggtccgtagaattcacgcttgtcccaatgattgcatattgtaccacaagcaatatgcggacttggatgcttgtcctgtctgcaaggcttacaagcgaaagaaaagtgctgacgaaggaaataagtcaaagaggggtggtccggcaaaggttgtgtggtatctacctatcattgatcgtttcaagagaatcattgccaacccgaacgaagcgaagttagtacgttggcacgccacagaaagaaagaatgatggtatgcttagacatccagcatattcgattgaatggaggaatatagatcgaaaacacaaagactttgctgccgaccctagatacatgaggatatgcctttgtacggatggcatgaatcctttcggtgatataagtagtactcacagcacttggccagttcttattgtgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacatgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctaaagaaatcacgaaagatggtatacatgggtcaccggaggtggctcccgctacgtcacacatttagaagaaagcagaaaatttttaatggtaagagataactttagcctgctcccaaagatttgtccggagatgaggtccacaatatggtcaaggacataagcaatgagtttgggaagaaaagaaaacgtagcaagacaaaggagaagggtatgtggaagaaaaaatccatattttggcggctaccttactggaaagatcttgatgtccgtcattgcattgatcttatgcatgtagaaaagaatgtgtgtgagagtttggttggcctgatgttgaatattcccgggaagacaaaggacgggttgaacgcgcgccttgatctacaggacatgaatattcgcagcgaactccaacccatacgagatgcagagacaggtaaagtgtacctccctccagcctgccacacactgtcgaaggatgagaagatcgcaatgttctcatgcttgaaggatattaaagttctatcgggctattcagcgaggataagtaagtatgttaaattggatgatctaaaacttgttggaatgaagtctcacaattgccacgtgctaatcacacaaatcttgccagttgctatcagaggcattctaccaccgaaagtgcgtcacacgatccaacgtctgtgcgccttcttcaatgcaattggacagaaggttatagatccagaagatctagatgggctgcagaccgatattgtgaataccctctgtcacctggagatgtttttcccactgtctttctttgatataatggttcatctccctgttcatctggtgaagcaaacaaaactatgtggcccggcttttctaagggaaatgtggccgtttgaaaggtacatgggagttctaaagtcgtacgttcgtaacagagctaaacccgaggggagcatcattgaaggttacacgaccgaggaggctattgagttctgtgtcaattacatgtccgatgccgatcctatcggagttccagcgtctcgtcacgagggaaggttgttaggtgttggcacaatcagaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtctacggatgtcccaaatgagacagtacagttgttggggatgggaccgtcttggaccatagacacatggcaaggatacaatataaatggatacacattttacaccgtcaaacaagatgacgaaagcacagtgcaaaacagcggcgtccgtatagatgcattccaggatcaagttgggtcaaacacatactacgaccgcattgaggagatctgggagctaaactacgtcaagttcaaggttcctttgttctgctgctgttgggtgaatctacgcactggtgtcaaagccgacaaggaaggtttcacttcagtagatctatctaaggtgggatacgccgatgaaccatttgtacttgcgaaataggtcgagcagatattctacataaaagacccttcaaacaagaagatgcacatcgtgagggatggaaagcgccgaattgtaggagttgacaacgtcgtcgatgaagaagaatgcaaccataatcttcatgtaagacctcacattgaccttgacgatgatccccaagagcttgtggcatatgctcgttcagatcataccgaaggcataaccttgtgactgatgcatttgtacttatctattgtaatgaatgaagtattttgttttattgcaaagagttgatatgtgtagtcattaatatggctaattttgttttattacaaatgaccaaaataaaagttgtagatcgtgatgagaggatcaactttgttgttgaccatatttcaatttgaaatcatttagtatttacaaatgctgttaattagatttgtcatattgtcgaaatcaatttcaagctgttgggaaaaaaattatatagaataatgaccaaaataaaaatagtagatcatgaaaggctttacaactttgttgttgaccatatttccatttgaaatcttttactatccgaaaatgtattatgactaataaaatgaattattacacagctgctatatattttgcactcacaacaaatgaaagatggaaaatgagtcatcggtgacgggccttagtttacggctgatagagattaatctatctcaatcgagctttgccgtagagcccgtcacagatgactcatc

SEQ ID NO: 37671 - DNA, 18371 bp, Oryza sativa
  unsure (1)..(18371): unsure at all n locations
aattcattttattagtcataacacattttcggatagtcaatgatttcaaatcgaaatatggtcaacaacaaaattgtagaggttatcaagatctacaacttttattttggtcatttgtctatataactttgtttccaacagcttgaaattgattttgacaatatgacaaatgtaaacagcatttgtaaatattacatgactttaaatgggaaagccataaacagctaacttgtacagctaatcaagatctacaacttttattttggtcacttcttcatccgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggacaactttattgttgaccatatttccatttgaaatcatttagtatttacaaatgttgattatatttgtcatattgtcaaaatcaatttcaagctattagaaacaaagttatatagataaatgaccaaaataaaagttgtagatcttgatgagagaatcatttttgttgttgaccatatttcgatttgaaatcatttactatccaaaaatgtgttatgactaataaaatgaattattatacagcagctatatattttgtactcacaaatataaagacttatctgggaaatggaaaaatagtcatcggtgatgggccttagttcaagcccgatagagattaatctatctctatcaggcattatcttagggctcgtcacagatgagtcatccgtgacgggcctgaatgtcatctcaatcgggcattagtatggagcccgtcaccgatgagtcatctgtgacggttctacggcaaagcccgattgagatgactcatcactctaatataactagggtttctcagatcggatcgaaaatttttctaagtcccgctacagtttcccgcctccttagaaccctagcgccgccgtcatcctccctcgccaagcccgccgccgtcgccaccgagcccgccgccgccgcagtcgtcctccctcgccaagcctgccgccgtcaccaccgagcctcctcggccctccattcggacctccgccgccgagcctcctcgccgacgacccccccccccccgagcccgccgccgccgccaccgaggctttacaccgaccggactggtgttggccttcctcgtcgtcgccgcccgcgtcctcaccgacccacgtcgccgacccccaccgagcacgacgccgcccgcccggtgccgacctgcccgatcggcgtctccaccgaccggcgtctccaccgaccggcgctgccctccaccgagcccgggcgccaccgccaccgagccccaccggccatcctcaggtgagtcctccatcgcgccgtcctctgctaactgtgaatgacatgtcattgaaatatggatgtggatgatatgtgattgaactgtgagtgagacatgtcgatgttgggatgaaatatggtgcatttatgaattttatgatagatgattgtagtgattgatgaaatgtggttcatttaactttatttatatgcaatgtggttcatgttgggataaaatgtggtttattcatgttgggatgaaatgtggtttattcatgttgggatgaaatgtggtttattcatgttgggatgaaatgtggtgcattaatgaaattattgtgaaatgtggttaatagattgtaatagattgtagcactcaattgtgtttttttttgtttttttggaagaaagtagacaatgtctcagcaaagcgaaccaatgtcgacgacaactagtgggtcctcaagggcacgtactcctaggacagggaacaaaattcctaaggaacggttccgcataacagcggtggacgccatagggttgccgacatctccaaggaaaatattgagccgatttaggtctatctgcggggtcatagggaggcagaaattcagtattctgcaagacgacttcaagctcgtgccggccgcagagaaggacattgcttggctaacgttcaaggagagctttgattatcctgcggagcatgaggactgtctcaggcgggctgctttcaaggttatgggcactgcttggaagaacttcaagactaagctagtcggcgagttcgtctacaacccggcaaatccagatccaagagagaaatttccttggatcatggaacaggtctaggaggaattccatgcgaagaagtcgacccccgagtccagagctagaagcgaggcatatcgcttgctccagaccaggaaccagcatccgcaccggcttggtaccgccggatatgccggtaaggaagaggaatggcagcgtgaggattaagaagcggaggaatcgtgcacaccgctcgtgtttggcgatatcccacaccctcgggctaggaactgggccagggctaggtaccagaaacatgatgatggcataatcttcatgccaaatgcagaagatcaacgagtatacgaagctatagtaagtgtctagtcaaactagatgttcgcattgtttcccatcgtgcagtttatttgaccccactaaattgtaatgcagaaggagttagttgccgagcaacaagcctcgcaagaggcctgctctcaaagacgcgaggacgacctcctcatgaaagcgttgggcaacaaggaacatcgtggacggacacggggcgttgggtcttctgttccctggaagtatggatttccagactacgcgtggtagtacaagaagcggacttccaacaaggcggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaacgcagcagttgcgcatcaactgagttggcggaaagtccaacatcggtcgacagcgccgtcgaccacataacggtaaccgtgaacttactcaatacatgaaagacgtaacgaatccatatgatatataatattctaaaaaaattgattaatctattgcaggaaccaacgagctgcaccctcacagttagggtgatgccgaccttcactgttccagcagccgagggacttgcgtacaagccgaccccagagacaagagtgcatggagcgcaactcagggccgactgtgcaaaagttcaagtcgactcggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagacccgcctctgctccttcagcccctcctactcaagatcgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccaaagcaaaggggagaggaaggggaggaaaggtgcaagcctcgcttctagctccaagaaagctagatctgggcaagggccaggaagagactaagggcaaagaggtcaagaagaaatacgtcgctccacaggagttccaactaggcatgccattggttggagatgacatgcttgccgcaatgggcaccgcttgcaaggaccttccaactaggcatgccattggttggagatgacatgcttgccgcaatgggcaccgcttgcaaggaccttcacttatactacatggagaaatctaatgccaggaagccaagtaaagctaccgatatccttggacagcacgatggaaagccattccttggtccaacaaattatatcgtggtcgacttcaaggatctttttgacctctacaggctccgagcggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcactggaagttgccttccttgatccacaagtggtcactgtcacaaatctccagaatgaccatcaaggaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaaccccaaaggaatgtttaggcttaaactaaaatgatgaacaatgttgaacttctatgtttaggcaatgatgaacacttattatgcaactgtgatgatgtaactatgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagccaaaaaacaaattttattttttttgtggattatagtcatctgtgacgggccataactaaatgcccgattgagatgaggtcatctgtgacgggctctagcttaggcccgattgaggtcactagtcatctgtgacgggctctagtttaggcccgattgaggtcagcagtcatctgtgacgggctctagtttaggcccgattgagctcatcagtcatctatgacgggctatagtttaggcccgattgagatgagtatcatctgtgataggctctaggttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattaagataactcttcacatcagtgacttctagcctgtgacggacgctgtgcccgattgagatggggcttaccgcccgattgagatgagggtatccgttctagtgtggtggtggtcgtaaagttttcaactgatcgagtgtcttctctgtattaagtggcatcctttttttcatcgtttactgttttagctgtatatataatttgaattgttcagtatcatattgaatagtttagttgattaatatggtcaattaccggctgaacgagcatagttttcgtaaagatgttgccgattcactgatctggctttagtaagaaagccccagaaaacaacaatataagacggtagcatatataaaaagaaaaatgttgtggggatccagaaaacaaaatagctttacaaacctcacaaacttctaaatctagtggaacaaataggcaaacctcgtaaagacgttgaaattttcttatgtttagcctacttgaccctggtttctagcttcttcccgcaccttgttataatcttactcaactttatcaagacctaacaaataggcaacactagcctttttagcatatctaaaagccgaattgtgcaaatcttaaatcagctaatagaaatggtcagttgagatttagtatttggctttagaagctgtgtgcctctccttttttctggatcattgaagcacctatctgtatctcaccttaacaagcatatttttgctgtattttctgctgcatgattgaccacaaccacatcattcagaatcagataacgacctagacagatcaccactaagctatctgaatcttccagtgaccagctgatcatcagtcagtcatgcccctccacaccattagctggtaactaaagccaaaagatcagcagcaccaactgcatttatgtgtatggcacacctgacctgacatgaccataacctcagctgccaatgattagccccatagtgcctcatatcataggtccataaatcatgtagtttagtttaagcttgatgcatgcatgactagctttctgctacctaatgcatatgcttctgaaaactaaacaaacatggcatgcaaaatcttctgcaggattgcatacagcaatggatgctatcctcggaagattctttacaggattacagtcttatttgggccttgtcaatgggggtaacagtgcatgcgtgcatgcttgaagcatgtggtgatgatttggtgttaatttggttttgctttagaagagctttgcatctgtataatgctttggaaatctttatgggaaagcatggccgtatcctaaccaaccataccaaagctaagattataaaaaatgcatgcttgctagttgctactatgatatgatcctcagttcatgtgctcaacaagatctgattacaataacacacttgagcagataagagtagccccttttgtgataaagatgattggcttgcgaagttgcaatgcatctactattgatgtagatgaccattacgacaacagtgcggttgccaattgtaacaaagaagtacacgatttaaccgaataaagatggttcaatccttttcatcccctcttgcttatccacagtttgcagaagttgtgtcttcatactattaccatgcatccctttacatgtgcaacatgcatccaccaaatgttatatactagacaagtcatcaatatccatcctagctttccttgtagtgctactgattcttcctccagcaaatggaaaaaaatgtgcatcatcatcatcatcccaaccgcatgacgctttcgatcacgaatcgcgcatcgtttgtggattggggatgcgcaattgcgcatctctgtcgccaccaccattgttgagagcttcagagaagcatatacggttgcagtattgcagagcttggaccggtggattcaccattcttttaattccatccacagagcagcagggattcccctgcctattacagtcttgctgcacatcagcattgaaaattggtcggggatattgcaagagattcgtgatcagtgagatattcggctcatcaatatgcttttgattatagccacagatgatcattgagccaatggtgatgaggatgtgagcacaagttttttttcctaattttgatttttgatgtatatgcagtttttttatttccaatatgtcaggttttgaaactacaaacaggttgaaccggctgctaagcttagcagtaagcaacacaagtatcctaaggttattacaacaaaaaaaatactctacttatgatggagtaaatctagtaaataaaaacgctaaaaggattatcgtgttatgaatctaatggtgccgagagcatcagattcataacactcagcatgaaacattcagatcatttgacgccttgttagcaagccaatgcagtgatgtgacaaaaattttcttttcagaccagcgtgacctacaaatatttgtcactgaaaagttagttcattgagcaagttacagaacgaacaaacgcttcattattacaaacaatacccagaaaataatcattggcatataaacggttcttttcttattaagatacatattttatcttggttttcgttcacacgtttttcaaagtactaaactgtgtgttccgtgcgaaaactttatatataaaagttgctttaaaatatcaaatttatctactttatgagttcaaaaataattagaacttaattaatcaaacatcaatggatttctcgtttcgtgtgtctatgttggagtgtataaagtgaattgcccacctttccttatcagcttaggcttttaggtgtaattggctggtgcatgcaatttaatatggtatcagagctnnnnnnnnnnnnnnnnnnnnnnnnnnnnnnnnnaataaataaaataattgcagcccactccaatattccacgcttgagatttgagggggtctcgcgtgaggggagtgttggagtgtataaagtgaattgcccgcctttccctaccgaacaggacaaaatgttaaaagtgtgactagaatctagtttatctggataaaatctagtgtagaagaattatcttgggtggagatttgcatttataattgtattagggcatctttcagactatttacatggtcatgataagttttctattttttatatatttctttagatgatatcttcatcttttatcaggagaaaatagtgaatgtgacattaaaaaatactaactctacagaagtatgctttccaaccccacaagaatcattatcatgatagccatttcacaatcacttgaatgctttctaccaaaccgtcaccaacagaaacagaaactggaataacatagattctagtcgcgcttgttaggtcctatacactgaatatcataatttaattttctgtccaaaataacaaaaatgtgtatatcctttgtgttttcttgtgaaatatgtgttctaattttacccttgttaataaacaaaacagaataattccggtgcccttttcttcttgcagtcttctttttctccgatccaaatattatataaaatatttggagctggaggtaaagtttgtgcactttccttaaaaagaaagggtatctggcctttacaatatttatttcctaaaaaaagtgtaaggtaatccaaaatcttaacaaccattcttgcttttggctgttctgctctacatcttttcattcccccacctcttgcctccaaaaaaaaattcctccacctcctctccgtgagaaatactcccatttaaatgaaggattagtgaaggctatttttttaaggattcagttcctttttttataatatagatccatttgatttattggaaatggatgaaaaaattttcagacaattgcatacctatggtctatttcacgggaaggttagacctcttgaaaactttcctttgcttcattttttcatgtggtgtaatcaaaggacatctgttcatgtttcatgtatttctaattcctttacgattaaacaaatatactactttattttctatattttttctgtgttttttatcttgcgtcttaaagaggcccttaaacttaaaagaaagtcagatgataaatatctactcgatcaagccgaatacttcttgattgagagattggattagttgatttctattataaaaaagataattatatagatcaagtgttattatttcattttggcccctttatactcagtgataagtttttttttgaattttttaaattttttattttaaaaacgaaccctttcaaaacatattttcaaaatatgaaccttttagccacgccaacccatctggcgtgacgaaacaacactgacacgccactcacagcgggtgtgaaaaatttgtcataccacatcagagaggatggtgtagccaaataatattgccatgccaactagactagcatgaccaaataacgttgccacgctaatcagaccggtatggtagtatggttttgccgtgtcagtctgttagcgtggttataaggttatatcttgaaaataagttttggaaggtttatttttaaaagtaaagtttaaaaagtttataaaaaaagtgataacatgtttaatttggacaatgtcttgatgtatccttcccagttcccacttatctcccgaccgtgtggccgggttaaaggagatagtgactataccaacttaggctgttgactgcttccaaagtttagtctttggtcatgtcgtgtgttggccatcataaatcaaggtctctgtgtaaaactgaacgatgtaccatatgttatatgtgctttggagagagatgttcctataaatatttttttaaaaaaaatctgagcgtgttggaaattaaacacagaaccttatgattataactacacatcccttgccactaaactattgatagtgcatctcctaaaataagttactaccaacattttctaattctaagaaaaaatttttatcacaaaatctatcgtaaggtggcggggaactcgtcagttgattggttccccttaacgctgattaatttgttgagtgatagatggtaaatacattcgcatgaggttatatcattatcgtgcaatatatggggacagaacgggcgaatgaaaggggaaaaaaaataggaccgagcctcgctctcaccctcgccctcctcatatatatataataaaattgagagatcttcttcaatgcttaaaattaattagaacccttgatcagcaatgatctaatggacagagagaagataactgaaaaaagatattaaaagggtattaaaatggtggaccaggtatggagaggggaagggtaaaatggtaattgattttcattaaattatttttcgataaagaacaaaagcgagagaagctacaaacgtttcagcaggaggaagaaaaaaacgaggaaggataagaacgcatgcgagaggaacctacatgaactacctgctgatcgtcgctacgtaaaagcccgccgctcgccgaggccgcacacgcccgccgctcgccgccgccgtacacgccctccggtcgtagcgtacgaaagcagcagccgtataccgccgccgtcgcacgcgcccgtagcgcccgccggtcgcagctgaggtacgcagcagcaggtcgccgtcaccgccaccgcacgaatccccgggctgctgtctgctctgctagttccttgcccgttctttgtcgtcaggccttcatgcagccagcagttgtattccaggctctgaagatcgattttgccagcaaaaacaaatcaacaatgccctgcgctgcgcatccgatcccctactggtttctatgcctaatttagctatttgatcactatgtacatattctgaagatcgattgaggtgagccactcgacacctgcatgatatcgtggatggccgatttattaggcactcgacggggtggaaattaagcaattactacctccatcccaaaatatttgacgccgttgactttttaaaaaatgtttgaccgttcgtcttattcaaaaaatttaagtaattgttaattctttttatatcatttgatttattgttaaatatacttttatgtatacatatagttttacacatatcacaaaagtttttgaataaaacgaatggtcaaacatatttaaaaaagtcaacggtgtcaaacatttagggaaggagggagtactaagctatccgtgttaataattttttttcctaaattaccttttaaagattaacagtggataacaatttgttaagaggtacatgggtacctttcaagcaccgtaaaagacctaattaaaatcatctgtcacccacaattctaaatagcgtcgttacggtggaaaaacaatcgtggggcagaaaatgtttagctgattaaaaaaaaaaggagataaaggtttagttatccataccatcctggatggtgtgataatacatactaacagccatggcatataaccgcacaaccaaaacattttgtttttgaagttagaaatagctttattctaaattgttcaaagaaaaaaagaagttaatttagctttgtttaagaaaaagatgacaactactgtgcccggttagttgtggacttgtggtgcaagtgctcggtgtactggtacattttgtttatggtttttaaatctaaatcatttgtacaaaagcgaaatgcgtagatgtacgtaagagggaaattaatcctacaaatcttttagtttacgtcactgtcaaattatatatatggatatttttaaaagagaatctacttgtacaagtagtacttcccttttttttaaaaaaaaaagtatttctggctagataggatggaacgggataatatatgccaaatattggaagtttacgagggtaaccaagatttttttttattttttacacctttttatattttaattttattaatagatcattttagaaaggaaaaaatacgaattaccccgaactatcgcggccgtccgaattaccccctaaacccgaaaaccagacgtcattcaccctcaaacttttaataccggacaaattacccccctcgacccaatccagagcggttttgtcctacgtggcgtatgcgtggcagtccagtcagcatgttatttataaaaaaatgtgggactcacatgtcatactcctctctctctcttcctctctcttctctctcactctctctctctctcactcttcctctcactttatcgccggtcggcacagacgggggacgcagcggctgcggcggcgggcgacgaggcggcggtggcggccgcggccacgacgaaccggcacccctcagcgcggggacggatggaggcgggtgcgggtggcggcacgggacgcagagacggaggcggcgaccacaacgagcagccgccccctcggcgcggagacggacagaggcggcggcggcgggggacgcggaagcggctgcgcggcgggcgggacggacgaacggcggcggtggcggcgaaccacgcgagcccgcccctgctggtggcctcctccaagagctcaccgtcacgcgacgcctccacggcgagcaccggcacgaaccccaccatcgccagccgcccgttgatccgctccgttgccggcccgctgaacgccagcacgtcccacagccccgtgctcgccgccggcttcgccttgggcgctgccgccacggggctcggagtcgacgtgatcgtctcctccttcgtcggctccacctccggctgcagatcgatcgaacgacgacaatgaagtcgccccaagttagcacacgaagcaaatcaccagaacaggcacagtgaaaccaatcaagaacgctcagctcacctcggcctgggccctgacgacgagcgtgacagcacgccggcgaggcgggaagccaaccgcggcgcggccggcgccgacgacaccacgccatggcgcaccaacagcggcggcggcggcgaaggaggagctcagcgccatggtagcagccgccattgttgctaattactcaaattacacagcagatgaactcaggcgagctagctggatcactcttttttcttcttcttcttttgctgctgctgctgttgatgatgaggcgggtgacgagatgagtataaacaggcgggggatcaaggaggaggtcacgggggcacgcggcgaggtggggagtggtggtggtggtggcagcggcggtggacacgtcggcgagggagggggaggcggcgacgtggagggcaagggggtccgcgccgagggggcggctgctcgtcgtggccgcggccgccgcctcctcgtcccacgccaccgtcgctgcgtcccccgcctgccgccgactggcgagaaagcgataggaagagtgagagagaagagaggggggagcatgacaggtgggtcccatattttttaataaataaaatgctgactggactgccatgtgtacgctacgtaggacaaaaccgctttggattgggtcgatgggggtaatttgtcatgtattgaaagttgagggtgaatgatgtctgtttttcaggtttagaggggtaattcggacgaccgcgttagttcggatggataatttgtaccttttccttttaaaaaatattttcaaatctgaaccttttgactgcgcgctacgtgataatgctggccttctacaccatcctctcttgccacgccactgtggccggcgtggccaaacaacttgttacgccagccactcggctttttggtggccaaaagtttcggtttatgaaaatattttttgaagtagtctactaaaaaatcaaaacataaaaaggtcttaaaaaataaaaaaattcggtaacaaatgccatagggcttgcgtgacaggatctagtaatgatcatcgaggtcagccgatcccgatgaaattcaaagtcctctatagtaaatactccctccgtactcgtaaatcgtaaagaaagtcgttttaagcagcgacacggtctttaaaacacaactttaacttcttgtttctataaaaatatttattgaaaagtgatatatgtatacttttatgaaagtatttttcaagacaaatctatttatatattttttacattttcaaactcaacaactcgaaagttattcatgatttatattcccaaggtttgacttaaatattgtcctaaacaacttcatttaccagtagggagggagtccctccatctattttgatagtcatatttcatctcgatagtcctctatagtaaatactccctccatccataagtatttattttgatacttatcatcaatttaaacatactactagttatttctactaaacaagcgatttattaatatttacatttctcgatgtccatgtagccaatcttgtgtggaagaatggagagtcacgtattaaatccgagaaagtcattaagagaataggtggttggaatgaaatatgcctatcaaaatagatggagagagtaatagtattttttattcaaggttcaccgtatcaagtcatgtaatggagttgacgccaatgatattatcggctagtcagctggcttcaccctggcctgttgcgcaatgcaaatcaatgaaacctcatagaaatgcgagaaaggggccatcgcaaagaaaaaaacgagaaaaaaaaagatgagttatactccctccatattacttttgacaccaagaccaaggagaaattaaatcaccttggatgttacaaaatcaaagagtgaatgcaagcatacaaccaatgagtatttagatgactctttgggttctaataaaacatttaatttatctcttcatttaagtcttgaatgcataaagactacaaatagaaacaacttatttgaaaaaactcaaatctgaaatagaatcaccttagatgttacaaaatcaaggagtaaatgcaagcatacaaccaatgagtatttagatgactctttgggttataataaaacatttaatttatctcttcatttaagtcttgaatgcataaatactacaaatagaaacaacttatttgaaaaaactcaaatctgaaatagatgtaacttttgtggatagaggaagtatcaaatgtcatgttgtgtcctttatacatatgtatgttctcttggattctaacaattctcttaactcttgtgagaacaaattatatttgaaatcagatcactctttgagttgtgtttggttaatgtacatggtagccattaattgtacatgagataaagtccacggttgcttctgaggagaattttgaactcatgtataacggcagtacagttgtttcagaggaacatcatttaattttactcgatcgtgtataatccgctaaaatgaacaattgcttctgaggatatcttttcccgagatatgccagtagagtggtttcagaggaacaccatttcttttattcaagatctctctgtgtcatttgcattaacaacaacatcatcaatctcaaaacaaacagtgagaagcatcaaacctcaaaaccaaaaaaaaaaacattaagcatattgaaatgccctcagtatcaacaaacatttccatatatttttatggtaacctcaaacacccacataacttaactactccctgcaggttgataatacttatcgttttcgacaagagcacgagtgcacgaccattatttttcattataatatgtataaaagtgttaacaaacatatgatttattaaagtaccttttacgactaatctatacatgtaataatcaccatatttgaaagataaatattttaaaaatgattcataatcaaagattgtaaagtttgacttcacatttatctaaaacgataagtattatcagcccgaagagagtatgtgccacagtacttcatgcacttaattcacctgggtcaagcttaattatctcatcagatgacaaacatattcatattgtgctagtagaaccgtgcatgcatatcaaaatgtacaaaatctctcgatctccgaaaccaaatcaaagcaaaagcgataatataatccatgcagccctagagagagaccaaatgcatataggggctgtttggtcgttacctgagaggaaaatacctgacctgaagctagcctggtcttgtttggttggtgccctcagatcccaaacccttcgcctggcctgcagcccttcccgtcattagcctgagccaggcgaccgaaatcgatcgcctgagctccaggcagcaacagcgatacatacttaccatcttaatcctaatctttctcggaggcggccacgcgacgtagattccaggagcgaagctgcgctgcttccgccggtgtgcgaagccgccgccgcccgccgtctttcgtaatccctgcgaagccgtgctgctctcgccggcgtgcgaagccgccaccgtcttgccggatccctgcaaagctgtgttgctgctcccgccggcgtgtgaagtcgtcgccatcttgccggatcccagcatagcagcatcgcccatgctagatgctgcccaggctgcctttcgtgcgaagcagatcgatttgcaggttgccagatgcatttgcacatctggacagaatcatctgaaggttgcgctcctgatgcacggatttgggatctatttgactcttcgattgcgttctcctctctctttttccctgcttttttttcctagatttttatcctcgttatgtatgcaagatttgtgcttgtacatgggaagttgggtcataaatggatcttggtaggaggttcagatgcaatttgtggcaagatttgtaacggcccattaatacttgatttagctgtgtaatgattaaaggcgtaattgcatatttgtttctcaggcagcaacaaccaaccaaacaagcatatactcaagctgcctgaccaggttagatgcattggtcttctcacatgccactcaggcgcacagaaatttcaggcatgttatgttactcagggcagcaaccaaccaaacagccccatactccttgatcatcaccacctaggtttagccttgcacacgagaggcttctccatctccagcgacatgttcaggcgctccaacaagtggacgccgccgccgaccggtgcccactcgaagcggtgcagcagctgcgcgagccagaggtggacggtggcgagcgcgagcgtcttgcccgggcaggcgcgccgccccgcgccgaacggcgcgaggcggaggtcgccgccgagcacgctgacgtcctcctccgcgaaccgctccggccggaactcgtcgggctccggccagagctccgggtcgtgcgcgatggcccacatgttgaccatggccgtggtgcccgcggggaccacgtggccgccgacgtgcgcgtcgcgcacggcgaggcgcgcccacgacaggagcgggcccggcgggtgcacgcggagcgcctccttcacgacgcactggaggtagcgcaggccggcgacgtcgccgtccgacacggcgcgcccgcggccgacgacggcgtcgagctccgcctgcgccttcgcctggatgtccgggtgcagcaccatcctcgccatgatccattccagcagaatcgccaccgtgtccgtcccccgaaagatcatctcctgcacgcgcgcaagatcaaatatatccatgaatccgttgatcgcaatgcacaagatcgatcgaatagatgcatgc

SEQ ID NO: 37672 - DNA, 2997 bp, Oryza sativa
cggtggaagagcaaaccccgcgccgcgtccttcacggggcggtcggcgaacgcggcgctggacaggagctcccgcgccgtgtcggggcggctggccacgacgaaacgcgtgaggccgacggagaagaacgccagggcggcgccgccaggcacggacctcgacatgtccgcgagcgcacggtgcgcggcggggccggcgagcgcggcgagcgcgcccggcgcgccgggcgggggccggcggcagcgggagagcgcccacgcggggccgcccgggacgagccagagcagcgaggtgacggcgaggagggcagcgaggagcggggagaagaaggtggtggagttggccgggaggaggaggaggtagccatgggtagtggaggcgccgagagtggcatccatggcgtgtgagaatgttggggggaggcaggagggtgcgggcgtgggaaggggagattggagggtttaaatagcgagagggttgtgcttgtgcactgtctcgagtaacaaagggcctgttcactttgatgaaaaaaaaaaattggtagccactatgctaaactaaatgtagccactttttttgtaattttactaaaatttggtaaggttggtagatatagacttttctcttgcatactctctttgtttaaaaaaatcaaatccagataggagtgtaagcgggtttgtccgtgaacctgcttataggtaaaattagtgggtaatatattaatttaatctataaataagtttatggatccacacttgcatctctgaatatggcaagccggaccacgacgtgaaaattcataagttattatctatttgatctataagtgaacttgcaggtcggcccgcttcaatccctgaatctagacaacaaaacaaaactgtattcaaatttactgctaatagtagtatctattttggacggtggatgtacagatttatcattgaagaaaaaaggttttaaattttcattttttaaaaaatggctttgaagaggcaaaaaagaaaaaaaggtctcggatagtagcaatttgccatgaaatttactaaattagtttgtctgtgaaaaataaacgtgttgttcactttgttttatgggatagagtacggctctttgtttggcagcaagagttctttccttgggataaagtattaaacggtgttcatttttaaaaaaatccatacaaaaatttcttttaaaaaatcatattaatctattttttttaaaagctaatatttaattaattatgtgctaatgaatcaatttgttttacatgtgtaagaattagttctcaatttcaacatcaaaacacaacgtaaaagtgttatttgcccttctcttttcgaaaaaacaacatctcctctacacgaaaaacggagcggttcattaacacgtgattaattaagtattaataaaaaaatttcaaaaatagattaatttaatttttttaagcaactttcgtatagaaactttttgtaaaaaaaatacaccgtttattagtttaaaaagcttgcgcatggaaaacgaccgagatgggtcgtaaactggaaggtccgaacacagccaagatccatacccaagtcttgaaaggatgagctggtgatttgtggtgtcttttcatttacacctaccttcttttttcaattataaatagttttgatacaaatcgtttatattttgattataaattatttattttttcttagtcaaaattatatatgtttgactaaatttatagataaaattagcaatacctgtggcaccaaactagtcttattaaatttaacattgaatagtatttgatacaaagtttatcttgtattggaaaatgttactaaaattttgttacaaatttggttaaacattaagaagttttttttgcgaggaaaactttaagaagtttgattaagagtaaagacaatcgacttataatataaaacggagggagtagcattgtgctttattcaaagaattttcttgtatataattttgcattgtatgcacactgacatctagtgatagattttaatataaatttgttggaatttagcaggtaaaaacacaagcattccgctagtgtagaagagaaattggcggttttattttaacgcgcacatataaatacttatattgtccatttgaaaaaaacgtttctattgtcttaaaaaaaattgatgcatgcctcttcctctaccacttgatcattatgtaaccgtccattgaaatcattactcctgctcaaatgacgatcgaaactaaatgcaggcgtaatcactgccgttacgtacgttgcagcaatagcaatcgccaaattgatgatctttcaaaaaatcttctgcctaaccgtccgatgagttgccgttcagtttttcaggtaacgagactgcatggagcccagctataggtctagacgtctcctccctcccgaaataaacatagttataagtttacgtgtccaaatttaatcctttgtcttatttactctcttcatcctaaaatataaggcataaccacttttctctcatgtctcatactccatataagacgtgtatgcatgcatacattaattagcacctcatggtccaataaaattgatttgttttaaatcctataccattaaatctccctatcacattgcttggatgagtcaaggtgatctaaccaagaaggtgattaaatattttcttggtctttgtgttatgagtggttgagaattatattttggaatggagggagtaaattttttttatgattagtatttttattgttatttgattataaaatatgaatattattttgtgcgtgacttatttttttaatatttttttaaaactaaataaataagacaggcggttaaagtttaacacggaaactcatgtttttgtttattttaggacagaggtactactccctacgtaaaagaaagttcctagcgtagcatccaaaataataagtacagtagtgagacaaagagacgaaaataactcattaaaa

SEQ ID NO: 37673 - DNA, 4594 bp, Oryza sativa
ataataaatttatcccaaaactacatgtttaaggccaagtatcacaacactacgaatttaataataaaattatcacaaaattatggattttgggtttaaatccttagctctaatattatgtttgagttataaatgtccaaattttgtgattatattgatgtaaaacctataattttgtgataactttattactaaatgtgtagttttgtaatattccatcttaaatttgtagttctataatatatttttttgttaaatctataattttataatacatcatattgaatatgtagtattgtgataatttacctaaaatatatgtagttacgtgaaattcactcattttttattttagaacgtagagggtgcagttgatcctgtttgaaggtaggtgggccccacgggcacacaatcagctgtcagcatcgcagagcgaggcggcggcgcaggccggagctggccgatgtgtcgagcggcgttgagccgctgactcttgctgtcttgcatgaaggaaatgtacattgtcgctacttctacagttctagtacttgttttctaggtccacgtcgcagaggatgtaattctgctgctgctacatgtctactcgcttcgtttggttgggctttaaattccaaatcctaactctaaactcttatgtgggagaccaactaaaaagtgtttgcctagtattcggaaaaaaaaatggaaaaaaaacaatccataatacctcgtgaagccctaggttgctgtcccgtgtgcgtcgccagcggcaggccacgcgctgtcctcacctaccccgcgtcggccatacgccgtccccgcacgcgccatcagccacgcactgcctgcccgccagtcgcgcgcgagagagaggggtaaggagttgtcttgggatggttaagtggcatttttatgtaaatatgttaaaaaaattcagtttcacctttgtattttttttaaaggaatagctctgctaactccactcccaaaaacagaggatcagcttcagataagttggagatgagagctagagtttaccaaacgaggctgactcgtttcattaaaattaaatctaaatataatgtgatatattatagtattataaatctagataacttctagtcagacttagtagaaaatgtcacatcatatcaagattattttttatgaaataaaatgattattttttatgaaataaaaggagtaccatgactagcctgcactcacttctgagccccaagtgttttttttttaaaaaaacaccacttactctctctatctcaatataaatataaatgattttaactgatttctatcccaaaatataaataattttgattggataaaacacatcttaatattattaatctgaatcttcctgtcttatttataatattattatttataatattaagatatgtcatattcaattaaaattatttatattttgagacgaagaaagtatgtccaggtaacacccatttccttcttcaaacgactactacaataagaattcgcactcaccgttttcttctaaggccagctctcctatcatatcattgtcatacagccggcaatctgtgctgtttactggtaggccttcaaaaaagaatgtcacagggaggtgcagatgattgtgcgcacatccagataacgattactaccatacatataatcctgagcaaaaacatagacatgaacgtgactgaaaccaaggcacaggcacacgataattttggaagattcaggcatacgatttgcctcgaaatttaagcgacaggatcatgatcccaggcagggtgtttgccacggagtcataggtacgggacatgcatagagaatgataaaacaatgggggttcccagttctgataaacaaggatagcggtagacttccttcttcatccggtgctacagtgcaccaggatcactccttcagtttccaccaaagaggtagcccagggaagatccaccaccaggggcagcatggaccttggtcgaagggcgatcctgcgaaatgacaatgaaattgccagagagaactataagtaagccccatgaatcagaaattattcaatctcatactgcaaatagtggataagtaactatgtttctatctcagtgtagactgatcctttcttaccagacaccaaccaagcattcacaatttaccagcagacatacgtaacatatgcccaaaaggaagagagatggtttacaaggacaatcaagtgtccaaatcatacctcatgcataacttcgatttgcagcataaagatcagcatgtgaaattagcaatattcaggactaaaggctaaaatgatcaagaattactcaattgtccattctggatgtggaaactagccaattcattcaatagtattataaaaaagatgcccagcaattaaagaactgagcttactgaaagtatatattgataataacaaaaccaatttgaaagttgatgtataatatttttttcaaatatattgccaacaagaagttacttccagaaaaatatctaatggtaccacatttgtgacactaaacttgcatattgtttgactaactgttggccagaacttacaagttctgaatcctgaaatgccttgacccattacaaataaactgtaattctgatgtggataaaaggaaagaaccgtaccgtaagaaagtttccagtgttctggccatcagctctatggtagttgttattgctccggctgccctgaatcccagctggaatctgcttggggcatcagcctttgcaggtgatggtttctcagcaggagcagccacagccgcagctggtgctggtgctggcgctggtgcaggtgcagctgcaggtgctggtttagcagctggcttaggggcctcattgcctccaaaaaggtaacccagagaactttggccaccaccggcactcccaccacgactcatcttgattgttgatgaagtgaagctgagcagaaatttaaggcaaaaatattaaaactcaaattttcagtactgcaaggaaagacaaaacaaagttgacctgagttcaacttatgaaacatgataatgatcataaagtttttgatactttgatgaacttatgcttctgaagaaataaaaagtttttcagccaaactaggatgtactggttctatatcaaacggtagtttcgttttcaagctgcacccgatggctattagtattttgatgatgtggcacattctccatccaagaaagataaattctttcactactttacatttttattggactgaaacaagaggatggtaaccagagtacaagactaattcctgttgctttccattctaactcttgttctaatgttcaaccattttctgcccagcaacatatagtagcatgtgctcaaatcattgggagctccagtgtgcagtgagatttctaatcatgcaagatagcatagagcagaactctaacaaaaacaacagtacgattgaccaaattattagaataaaccaataaaaaaatcaccaagctattttccttggttaagtttgaatttacctagtgagaaaattaaaaaaaaaacagctataaagatgatgaatacttaattcatagcagaaattatcaacacaaaaaggacaatgcttcaagcacgcaagtgtatatgcttcttaacttgttaaaaatgttctgtgaatctgtatatgttccgtagcaagctataaagagattagttcttactaatagaacacagcaagcatgcagcagctaaacttaccttgtgtactaactttctattgttaagagaaataacttttctcgtgttaagagaaaatgttgtatgaaccatcaatttccaacttacacgtcaagcataaaaggtggctataagcacctagatggtagtttgctattcatgaagtataaacaacacaagaacctttacgctctggtgcgtttactgctcaacattgtgaagtattacatttgaaagcaactttctattgtctataagtacacagacagcaacatcactaccaagtaatttgtgcaaaacaacaagataaccaataaagaaagatcttccgtctccactaggcgtctatgccgctagaaaacagtaggtgacgctcatgtgacgtttattaagacgttcatgtcacgcttactagatattcaaatctaactgcaagatcaggctcatctgaacgaccacaccgttgcaaatactgacgtacatcactatgtttcatcaaagggatgagatcagcacagaatgattcaggaaatccagtccaatcggaccgaaaaactaaacaaaacagatcgtggcatcctcttccaaaggcctaaaacaaaatccacaattctacacatcacacagccacagaccatacaaggacccatcagaaatcgtcccacaaagttagcttccgcagccgaatctcgaacatacattccactcctcgctaatgctctccacgcaattcctacctaccaggaacgcacagacgcagcacaaacaaccgcccaaaagcacggtgggcggaaacgaccctacagacgaacggatcacgccgtgcgctacctacggcgagcgaaatccgccaccg

SEQ ID NO: 37674 - DNA, 6110 bp, Oryza sativa
  unsure (1)..(6110): unsure at all n locations
ggtgggacgtcttgtataggcgacgcggggcggggttgcgggacgggtggccgtccgatcgccgcgatggacggtccagatgtgcaggcgccgacagttgaggcaccctctctgggccagcctgtggctgtgctggtgcgccgacgggacggggacgcgtgatgctcacactgtgctgatgaaaggaattgcataccgtaaccactcacgctcgctataaataataaagattcgcccctatttagctgcgtgtttgatgtgtaatgaagagcatctttgatcaccatgtacatgatttttaggtaatatggtggtgtttgaatctcctgaagatgagataaagattaagtgtttcacaccaacgaggtggtaataacgtgtgattaattgagttttaattattacaaacttgaaaaatggattaatctgatattttagagcaactttcatataaaaagctttcacacggaacacatcgtttagcagtttgaaaagcgtgccacgagtatctaaactttaatcatatgcttgcagaagaaacgaacaggatctatattgtgctcggccatatgttctcaacccaaacatttccaccgtggaagactactatggttgatggatggggaaagtaattacgtgctcctgttttggtgaggtctatatgatgattctgttttcgtattacttaatttatcattcgcccctttaaaatattccgtacaactagcaccgaatataaaaaaaacttgcctttttctttttagttaaaatcatagatattacaataattggattgtccgttctcctcattctctctacttctctttttctctcctattccaacagggaccaatagtggtgatcaggctacaataagcgtggttagtagctagcgagtacaagcaatgacaatgctttttgaattgccccattatcctcatagtatggtcgtcattgtgggctataagcctacaactagtgtcttgatcctcgtgccaaagtgattgtagtatcttctatggacaacgtagttgcctaatctatttcatgcgacctcttcatcaatgtccccgtaatcggttcttatgtcatgtagacctcgataaagtggcaataaacatagaagtatgatataatgaacctctagagactaatggtgggaacatatgatggtctggtatgatcaagatgatagaaaagaagggaggggaaagagttaaaaattttttaccagtaaaacaacaggagaggctcctactgtgatatattaaaaaaatatatagagaatatttacaagagagatttacagggggagcatcaattacagttgatcaatctatgactgccaaatggagatatcttgtctttttactctatgcaaaagtagagtaaagtcctctttgaataaacagtctcgtttgttttgtgaaaaataaaaagacatgaatacttaataatcaattaaggtatatgatatttgtgttcaaaaatataaggaataacataccctcaattttaaggaatgaatgaacaaattgtatatactcaatgaatatagggacaaataagaaatactaggaaaaatagaaggaaatacttaattccccttgaattttatgcatatggtaactctgttccctgacctatttcatattctcctctgttgggttggctttgggtttgacaattgatatgagcagaaatatgcaattattaacttagcctagaaattacaaggcttgatagctatgttcttagctaggttatttaattattcaaataaatggctggactgtgaaaccgctgacactggacaaccaaccaaagctgaactttgtgtcgaactagtaaccgtgcacgtgtaatgcacgtttatatcaaaattatcacttcaattccatttattgttataagcaataaacttatttcaaaccattgatgtttacatgaaacataattgacaaatgaaagtgacaaataagcaaaagctctcgttggtccttttgtttcactaccatttaaaaaaactaagtttcactactcacttcatttgaacaaaattttgcatgtggctccacaagtttagtttttgcaacggattccctctaaaataagcaactgtagaaccatcctctcgccgtaacaatctacaaccaacagataaaaacaataatccgatttaagctaatcaacatatatgactgttagtttatctgccagctctgtccaaggatgaatacctcaatagtacacaattattctcattgtgcatttggtttatggataggcaaaacactacttctgaagtacatgtgtaaataccttgaaaaatggacacgcatagcacaatcatttcactgcccatattatagcttacaagtccacaaaattatataccagagcacagcagaaatgcacataaactatatagtttatgatcaaatatggtgaaaaaaaaaacatactcttccagtcaacccaacttgaagaggaatagtataatatatgcatacattccatcggtgtccaaactgaggtcgaatcacccatcaaatacggctagaattgattaattgaaacattcaatttgaaccatgaaagatatccatattcttgtgggtcaatagttgttaacgtccattattcaaagcttaattccaagatggttagcttcccctgtaagcaacaaaataattcctttataaccatttcttcaaatattgcgggagaacttcggaaccatacatacttttgttagcataaattggtttgaactctaaaacatcaagtaagggtctgtttagttcgcgaaaagaaaatttttgggtgtcatatcggatgtttgaccggatgtcggaagaggttttcggacacgaatgaaaaaactaatttcataactcgcctggaaaccacgagacgaatcttttgagcctaattaatccgtcattagcacatgtgggttactgtaacacttatggctaatcatggactaattagcctcaaaagattcgtctcgcgatttcccccctaattctgcaattagtttttctttaatctatatttaatgctccatgcatgtgtccaaagattcgatgtgatgtttttgggaaaaaaatttgggaactaaaccaggcctaacagagacacatagatttttgttttcaaattgtctagatatcagtgaagcaattgtaaagacacttcttaaatttgttacaagcagtagaattcgtactaagagaataataatttccactatgtttaattgatctaaaatgctgaacactttatatcaattaagcattgtttactctatctatctgctttcctatttggcaaaccaaaactctgaatttgatcatgaacagtcattaagataggtctatatatttttcttgtttcgaactgactacagttttagaggtgaaagcttatttgaagagaagtaaaaaaatttgcagcaaatcaacaaagaaattaaggcatgaattaacagagaatgcaagaaaaagaaagcatgtgcgattcagattgacgatttggttgactaagtgatacgacccaagtaggggtgatgtcccgatctttacggcgtaggatcaagaaccgataactagcctcaaagagaccaagataacttagctgcaaacagccaagataacagtgcaacctgacgatcgtactcgaagccaaccaccgtctctattacggcaacctgaattgagggttcgcccaaccacactctaagttaccaaccaacacaacctggaatcaatcaaggaaaaacctcgaagggaccaggagcaccaattaggggggcgtcgaatgtcgtttctgtaatctcacaaggaaataacaggagcaaaggatctctctgtgaatttgttagcacacaagtgaactctcatttgtcaaaagtcttccaaatgataaaacatataggatatttatactaagaacaaccctcctagttgggaatgaaatgtcttgggaatttactagacataagctaggtcaaaagtcaccataagtgaattcccaagaggactcgcacgtctgtttgtcttatgagcggtcttcaatgatttgtccattactctttattggaaagtccatttcattggttcgtttttcactgggctggtccgttttgcactgaactgctccgtttttgctggtgcgttttgtaatgcactgatctgatcttgctgctccgtttcatcctccttggtgaacctgagtaacagtaaagtgcatgacttaggcaatatataattctcattaatattaaaatatgtttcagctaggagcgagtttacctctgcacggctacatgttatcgatccttgaaatgatggcactagtccaattgatggtttatgttcatatgatagcaagggtagtgcacgattacgttgccttggtgtagttgtggcaatccgagtcaagtctctatctttaagcacagcgatatgctttaacccacaatcaaacaagccaagtagcagcctttcttgatgaaaacaataaggtttgtagttaagcatagcgttaaccttgcattgatgcgcaacaatcacattatgtgtgaatggccttgaccggggtgtatcacgaaatctgtgatgttgccctccatggtaatctgttatgctaatcagtcgaaattaatccataaattgactggttagcacaacaattacggtacgggtacacaattttgtgtaaggcacagatccatgccaggacaacctctcgatgtcctgttccaacgtcaactggtcctggctcagcgcaacatgaattggatttttcattttggggaccctttttcaatacatgttaatgatatagaagtccatttagactccccctcctcatcaatatagaacacctggtttgcaggaaatgtcataatgtaaggagctacctaattcatagaaacatagtcccaactttaagttgatctatgggcatgcgaaaaaaactgaagagaagtgtattattctacataggaaacataatatgcggcagaataaaataaaaggaaatagtgataaaatagacagtgcagcataattgaagaaaattgctcaaagataatgtgcggcagaataaaataaaaagaaaatagtgataaaacagactatgcagcataattgaagaaaaatactggattaaaattataagcaggttttacctatgtccacgaacttgtaaagcgtatatcaaggttcctaaacttggtttattgtgtcatcccggtccaaaacctcgtttgaccgtggtcttgcccacgtggcatgacacgtcgaagatgacatggcacatttttatttttccttttttttcccttcttcctctttcatttctctttctcctttggcctcttcctcctctctcaccttccagccaccgcttgctcccactttgacgctgtcgcctctgcctcctctcccttgccgccacaaccgctgccagcagctgctgctgcttctcggccgccaccactgtctctctcgttgccgcctgtttcttctttgggaaagtcaaggaagaggtcctccgcagccactggcgcctgcctcctccgtcctccgtggccgagtagaggggggtgaataggcggttttaaaacttttggctaaaaccgagttttgtatatggaaacgtaaatcaatacggttttgcacaattcaaaacctcaatcaattagtctcaactatgtgcacaaagtagctatcctatgttgtgatttgcaagccttgggtgataatagcaaaaataaactctagtatgtaaatttgcacaaaataaaggagacaagtgacaaaggatttttccacccgatgttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37675 - DNA, 13109 bp, Oryza sativa
ctaagggacattggttgcgtatagcatactcctgatccatgaaggtactagtgctcccactatcaaccagcccaacagctcttttcccattgatgaggattatcactgaaaatgtatcacgtctggtagtcccctacatggcattttgtgagacatatattagctcctcagtctccaaatcctctggagttttctctgggatttcttcctctccctttcctcagttatgtcttctttctattctccctccttctctccagattcttcttcttcttccagcaacagagcatgtaaagccttctttaccttgcattgatgcccagagaaccaagcttctttacaaaaccaacacttcttctccccatttcctctaggtggtgctttggtcatattagctctgctttgatttcccccagtatggatcagaggtttgtttttgttccaattcagagcaaccttcctagcattagcagccttttcatagtttttagcataccaataagattctagcagcccctggggtttgtaaccacacacatcatgttttatatccccccttaattctcctatgaaacagctgttcaggtatagttcttgcaaacaaggatgatcccttctcactaggtccacatattcttcaaacttgtcaatgtactgctcaaccgattggttatattgtttcacattctggaagagctctactgcctcatgtacatcagcagctgaaaacctggtgcaccatagcgcaccattggggccaagaaatcatctgccagggaattcctatacccctgtacaacttaagagctctcccctgcaagtgtgccaatgctaaattcacccattgatccatcggggttccagttatctcataaaacttttcacactgtttgagccaatcaataggatcttctcctccaaacaatggaatttctagccttggtcccttaatcacagcctctgcataatgattaccttcagcccccattctaccatatatactcccctgtcgatcaataaaatgcacccctggacgtccttgaaatcccccttgagttccaaccccatgctggttagcaactgttggaccacttcccccaaagttcatattctgcctttggtgaattccatgaggtggctgctgcgtatgaagtccaccctgtccatgacccatggtatttcccccagaagtagcccatagattaaccagttcattattgggtgcattagtgttagtttccaaagcaaaacgtacctcaggagctgatggctcccctgtgggaggattacttggtctagcaccacgagttgcttgaccagttgcattctgaattggcagcgtagcagctgcttcctcagttcctccttcaccttcttcaacattcttctgcttgcacaactccctcagcaatcctttgatctccctcatttcagtcttgagcgtctttaaatcagctacatccctcttcaaactcgctacatccaccctgaattcattcatctcctccatatctaccatagactcgttggatcgagtctccgtaaccatccagaaatctgtaaggtcggctcggaataaatttttcctccccttttgcctcacagaacggtctaccgccgctaggaacaaagtcaagctacggagattttacaggagcacacctatacaggatggctcgccaacccttgctcaaaccctgctcctactctcgccgccggattggatcaaactagcttaaggaattttacggtgaatctcgccgccgccttccaccaaccctcaccagatcgatccaagagccaagaaatcgactaagctctggtacctttgtcaagagctgggagtagaaatggaaatttcagcgaaaaattcagatcagaatcgcaaatttcagtggatgccgcaagacgaaattagggttctagatctatctactcctaatgacaaagaatatgctttttgatatccttttcctttctccagcgaacacttaaatagtcttacaaaagggtaaggaccacattcatcgtggcctcagtttcagacagatgtttacgtaactaagttcaggaaaacgacaacgattacattaacagtggcccccgacaaagatggacggccagatgatgttgataccgctttgctctgatccgccaccatcggatttgcatactcgatatatctctctcctgtttcactgaacttctctgaatcttcttatctctgaattttcttcagactttcttctcacttcccatttctgatctagagtcctgaaaccctcggagaccaaggaggccatctccaaccctccgcggtcgcctccagaattcgaaaggagagagatttgcggcggcgttttgtcagtcgggattctcaacatttggagaaggtggtcaaggagttttttacctagggatatgggtgacaatctagttttagaattggtggtccttaaaactctgtgcttttgaaggagatggccaaggagttgttcatgagtggcaatttagtcgttagattgatggttctcaatactccatgtcatttttttttcctttcgagtgtggttttgtttgttcggctgtgtgcatcttagttatgcaaaggccggaagtgttatcaggataattgtatcaccttgatgtaattggctgagttcaataaaagcttccattatctaaaaaaatcactcgtgtgatttgttttttaggtttgcactcgaattactgcccattcgatcatgctaggattcgtgctgtcttttgttatcgagcctgtggccggagcatactcggacccattttctgtgcggcccgaggccgagtcgtcgaggcagctacgccggcttctgcggctatcggcgagacggctacatcgttggagcatcgacggcggctcctgcggccgctacgtggtgaggggtatgttatatcactaattcactatatcctgcggctgttcgatctcgggaagcagccgatcgatgtatcgaccacggtgattcatatggtgacacactatttcactgtagttttatatatgtccctgttatgtgtttgattttactgatttatgtagaccgggaggattttgacttttttttccacatctggatttgttgtaggggaatggagcatgtagcatttgaagctggatagaaccaatttttattgtactgaaattggacttacaagttctgttttcttccaaggtgagttcttgtcactgaacataccctcttatataagccaaacgcatgatctgttttgtcttctactaataaatagtaagttttgtaagcaaatttctgtaagtaggccgggttttgtcatctactaacaaaaaatacttagttttctcagcctctacaattacttacaattaattgtaaatatttgtacaatataaactaattgagttttgtcatatttcaaatgcatagtctgttaacaaatttcagaggaaactagtagtctatgaatacatagtactagttttgtacgttttgttagtacctaacaaatttcaggcaatacagatgagtaattttttagttttgtttgaaaaattcctacattatttttagttttattagtacctagtataaaacttcagtcaatagagattagtaatttttttttagttttgttagtacctagtataaaacttcaatcaatagagattagtaattttttttagttttgtttgtaaaactcctactttttttttagttttgttagtacctactccctccgtcccataatataagggattttgagtttttgcttgtaacgtttgaccacttgtcttattcaaaattttttgaaattattatttattttatttgtgacttactttattatctacaatactttaagcacaacttttcgttttttatatttgcaaaaaaaaaaattaaataagacgagtggttaaacgttacaatcaaaaactcaaaatcctttatattgtgggacggagggagtagcaaatttcagtcaatggagattagttatgttagctaatagtgcttacttcagagctaccacctataactagttttgttagttttgtaagcaaaggggtcggccgatggtcgatggagtagcgaaggggccgccggcagcaacggcaccgggaggggacttcttcttctcatcgagatcacgaggaccttgatggacatggggatggaggggacggaagccggcggtagcagtggatgggcaaggagatcgattggcgtgggaggccccctcccgatccagtggcacgacgacgagcaggccgccgcttgctgctgcaatcccctcgcccgcctgccaccgtcgttgctccagtgcccgccgccaccactccactgtcgccacggctaaaggggaagagatagagagaggggttaaagagggatgctgacatgtgggtcccactattttttgtaaatgataaataggtcccacgtattttttttaattctaatgccacctaagtgccacgtaggatgaaaaccaagttaacaccgctatgtaggcgccacatcagcaaaactgcgctccaaaaccaccgaggaagtcaaattacaccggttttgataattgagggatcgagatatccggtattgtggtttagggatacgaatcagattcggacactagttaagggagtcaaagtgaacttattgccctgcaaatctaggtccagtttgttcctgcaaagtggacaaatgcaatctgggctcagaaaaacagacctgcaaatgctatgggcttaacaaaacgggcctgtggatagatccgacccaagaaggataagttacagacttacagttccgcacgcactgtggatagatctgacccaataaggagggtctcgttcgggagagggagatcgttccacgtttctctatcgcacggcaagaaatttgagtgcaactaaaaaaaatcaccctattgatacctaaacagacccttaaagtattatacaaccctcctactacacgaagtagtccaaaagggtcacataattctataaaaagtggagacacaaagtttagggggaggctctcttttctaatcaatcctccaatcaactgtactaatgaatacccctctctctctctctttatacagtgcattccaatatatggaaggttcggtgatgggtccgataagagtatttgggccaggcctttatgggccaagcccaaagtttcttaacactcccccttgggcactcaccgcgtgatgtccatgcctctttaaaactccataaaaaccagtaagaaaaattaaagaaagagtacatagcatatgcacgtatgtcgtatagattgcctcattaaaaagagggctgctagcccacgggatactgttgcaatgggatattttaagtgactctccatttttctttcctctgcccacgtgtgctcccctagtacctggtaccttaggtaccggttggtacctggtacctgatacctttagtacccaaggtatcaatatctgatgcccggtacccaaggtaccggatggtacctaggtatcagaccttggtaccaaggtatcaagcctgatacttatggggtatcagagggtcctatcaaaaagaggagacgtgggggagagagcgccgcaacggcggaggatggtgtcaaggaggcacggcaaggtgagggacgtgtgctcccctagtacctggtaccttaggtaccggttggtacctggtacctggtacctttggtaccgactagatatcgaccgatacctgatgcccagtacctaaggtaccgggtgatacctaggtatcaaaccttggtgccaaggtatcaagcctgatacttgtggggtatcagagggtactgtcaaaaaagagcaggagatgtgggggagggagggccgcaacggcggacgatggcgtcgaggaggcacggcgagatgagggacgaggcccgagccaaagagtgcgagaagtctcgaggaggaggttgacagccatacctgttgcaggtcgacgcgggctgccggtgtccatcccggaggcgcaaaagtggcaagccgcagcggggacgacggtgacgcagaggccgagggcgaggacgaggggagctcccgcttctgccctccccggggcgacgactccccggcgcacacccgaccgacgagggcggcgagccagagtggcgcagcaaggggaggcgagctcgagggcgaccccgccgagggttggccgacctcgccgacgtagtgccatcgtcgtcctcctcggccgccggaaacgacgacgacgaccccttcctcccggccggcttcgtctctgctcggccttcttcagagagagagagaggagagggagagggagggctgcagtgccgtgtgatttgggggaggagagtgaggcaggaggagaggattcggatgattttggggagaggagtgaggtaggaggaggggatcccgtctccacgggatgccgtggtgtaggttttctgcattaaaaaccttgataagaaactgcaggaaaacttatccaaggaaaaaagagtacaatctacccaaattcttgtatcgattttcttaatcggttttgggtacttgatttttcagttcaagcttttgttaatagactggcagaattctccccctgaattttgcatctcttttaagtgtgaaccatcaaaaatcgttgctcatatcttttcaaaagatagttcgagtgatgcttcaatggtcaaatcttgcatgatttttccataacttatagagttcgtatagtctattagtgctagtgcgacgcacatatcattatcttcttgataatgattttggggtttggacaaagctcgaaccaggttacttgctagaaatggtgaactatatccaaggaacctatgtattttcacattctgatatactatggttcacttcttcatgtgttgtaggtttacgggcctaagcaacataggtttctatctattttatctcaaactcgttcggaaagagtgagctttatttctttatgcgatgatattcggatcatcaacttggtttgggacttttaatgcttgtatgtgagtgcccaatccaaaatttctttagccattcattgtcaactataggtcagctttgtgggttgatcttttagttgattttcaactccgggttgactgccaatgatttgttgtatgaagagaatattgcccatagcaggtctcattaccaattcctattggttgtatgtgccacttatgtgagtatccatggatatatggggatatgcaattttcttatgcttctattctttgatatgggcatgactctttcattttatcggcattggtgtgcactccaactgctggttttcttccttgataggaagatgtggtatgcttgttctgaggttccataccatttgccagctctgaactggctccccttcaaataccggggttacttttagtgactatgagcttgagagttcctttttgcactactacaaaaaccttcatagggaccggctcataggtgctggttcatttaaaaccgacaccaatagagcttttcccacctcctagcggtggaaaaatacagaaccgacacctttaaacatgctagaaccggcacctataatatattataggtgccggttcatgaaagaaccgagacctatagtatattataggaaccggttgtttttaaaaaccggcacgtatagctttgagtcgagccgacgagccgagcccatccacgcaccacacccaccatgtccttatttactcgtatccttctcgatctctcgtgttatctctccctcccctttctctttcgcgtctctctccctcccccccccctctttctcgcggcggctgcccggcggaggaggcgggctcccgcggtcggcgcggctgcctggcggaggcggcgagctcccctccgccagatctagcgtgaggagagccagtgggggatgtagtgggtggcagcggctcctctcctcctccgatctccccctcagctcctcctccgccgccctcccctccagccccctcctccttcactccttccacctccgcgacaggcggcgtccccctccccctccgcacccccctcgacaagcggcgtccccacgggcggcgtgtggagaggcggcggatccgctcggatctggcctcccatggccggcgcggcccgtgcccggcggcggcgcgcggagaggcacccggtggcgcgcggtgagggactacagccaggaattggtgagagtgagttcatgcatttcatctgtgattgtgatatggatttgatttgtgatatgcattgttgttcatctgtgatatgtatttgtgagatggattgttgttcatctgtgagatttgattttggcttggcttggagccggcttcctttttttttaatcggggagagcacaaaggtgccggttctatgaccgacaccaatgacctagtgtcattggtgccgaccaattggtgccggctgggaaaccggtacctattgacggttcccaaccggcacctatagcgttttgtgtactagtgttgtctcgttttcaccagacgtctccagttactttagggatttaaggagccggagttcttgtcccattatttttctcgaggcctctagacaatatgaggtatacctttgcattcttcggtatttcaccctcctccggtgcattatattcgggtaatgcaacttagtcatgctctccaaaatcacaaaagtgataggcagttatccaattacaaagtgtgcttttcatactttgcatttgctagtgcttgattaaatgtgcatccatcctttctttgataggcagttatccaattacaaagtgtgcttttcatactttgcatttgctaatgcttgattaaatgtgcatccatcctttctttgaccatttttcctgacatttatcatttaagggttatttctctccccctaaatgactggaaataatccttcttattgtcaaggaatttaggctatgttcatacttctattaaaaatttccaattttttcggagggagcccttatggttgtgggatatgcacatgtgtcgagtcaatactagtattcttttaagtggacaacacatttcaaatagtccgaatattgataattcgctgcctttggaactacaagtccattcaagtggcgggattttcaataatggtgcaggggacatttttagtcctattcttgtggacgtccggtacttagtgcttttcttaacgcgctgacgccaacgtgcatgatcttgcaggatcgatttggcaagggcgtagtgtcaattagacacaattgcagctttttcataagcacagtatgtatcagatgatccattaaagggttaaatatgtatgcgaattcatgcggtatgcgcgaatttgttccggtataccttaaggtacgtcggaattcatgtggtggtcggcgtttgacacgcatctgatgttcaacggcatgcgcgaccagagtgaccatggggtatgcagccggtgcaactatggcgcatggtaggagttgcatggcgtgtgctaatgcttcatgattcgtccagtccccagtacagcggggttgctagttggtgcatagtacggcatttagaggagttgcatggcgtgtgctaatgcttcgtgattcgtccagtccccagtatagcgggattgctagttggtgcatagtacggcatttagagcacggcgctagtagcggccttagtgcgtgtcatgatgctatatgatgcgcaagcctggcgcgaggcgctcaagcagtgcgcgcaacaaatatctcatcgttgcgatacgacagatgacgtgggcttgtttgttgatcaatccggcctaggtggggttggccgaggcccaataacttaaggttgcccggaccccaacagttctttggcacacccactcggagaaaggcccaatctccctaaaagactagtccaataggggaagggtggtttcctcctcccaagctaagcaaggtgggattattcaaaggctcatacggtcgccacccgacttttgcgtctttgccagcgggtaatagtggaggatgtcctcatcgttcccacccccttaacaagggcccaactctgataccaaatgattaatccggcccaggtggggttggccgaggcccaataacttaaggttgcccggaccccaacagttctttggcacacccactcggggaaaggcccaatctccctaaaagactagtccaatagaggaagggtggctcttccttttaaggtggcttcctcctcccaagctaagcaaggtgggattattcagaggctcacacggtcgccacctgacttttgcgtctttgccagcgggtaatagtggaggatgtcctcatcatttgtgctatgttcatttgcaagattctaaattctaagaaaaactgactatgaaatagtctactttagcctacatttcttagtgaggacattgttctcgcatgcttaggtgatgagtatgcttctctaatcttctagttcctataagggaacttttgtatgagagtttgcgattctcaagagaattgaggtgtaatcgcttttctacgggaaaaacgatatccttcacaatcattgcgtgcggttgtgaaggtagttcacgtctttccatagactgaacttgtctcatgtctctcaagattacattttgtggtgcttttgttccacaatgttcctttcaccttaggctatgcatattgtctatgtggataaagtaaaacattactatatcaagacagggagtaaactttaccgtagagcgaaatgcaacaaaatattggaaataaagtctagccatgcaaggcaaatcacaaaataaatgttatgctctcatagagcttacaaaaccattattcaaattgttcataatgtaacttagcttacgaaataaagtaggggcatcaaatactcaaatggaatcaaccagagtattgagctctacaaagatctgctcctgtgtgacggcctcttcatttgttgtacttgctgcagctgcaagggcgtcaagtggagtagtggtggagggagtagccgtactgtgagcctcaaccatgtgtgcctctgcggacgccttggcattcctgctggcctagtatgcgtcgacgacgtgctaaggctcctcgcaaatatagctccagtggcccccaaatcccacacttgtagcatgtctggtcctgctggccatatggcttgtcattgcgagctggcttggcttccttcttgcccttgcctccctgtgctccctgggcagctggagctttttcctttgacttctcggctgccttcttcccatcacgcttgcccctcctcctctaggtgggcttgcggaccttgcaacttctagcattgacttcaagaccaacactcttgccaggtggctggaagacaaaattcttatggagaacctcatcatgagacccagacacctgcatgatgtcgatcatctcatcatactccttgtatgacgcttgcctgtagttacgagcgctctacacggcgctagggtggaaggtggagagcgtattctcaatcttttccacatccatgacaaccttgccacagagggagaggctaatacagatccgtgcagtgtggagttgtactcggagacgctcttgaagtcggcgaaccttaggcgagcccagtcctactctgcttggggcaggatggtgtacttcaatttctcgaaccgcttctttagtgcagtccaaagagtgagtgggctccgcaatcccatatactcattcttgagcgtggcgcagaggtggtgtcgcaggaagtgcagcgccttatcattctcataaggtgtaggcgcacggtcctgcggggtgcccatcccgatcgtctggcggagcttcttggctccaaggacgatctggacaaaatattcataagttactactagtaacatgattgcaaatatgaatgcaaatatttcatgattttccaatatttatattcttagggaatgcaacttgttcaataggaaatgcgaattattcaatagggaatgaaaattatacgtaggagatgcaagtttttcaataaagaaatactagcgttcatataaattcatacaaatattcatataaagaggacaaaaggatgcatatattcatataagtactcaaaaatgaaatttcaaactatcaaataacagtaaataatgcctcatgaaaatcaaattcaaaaattcatgagacataaaaagaaaatgcttaaatatgaaatataggtgaaatatgcaagtacaggggccctttactaagtttccatgtggtggagggataaaaatggaaatttctgaaattctagggtctaggcgcaaggaatctccatgctgagagatatgcgaacagttttaagaaaatccgggggcctttttgcaaaatcaccaattactttcttttttcttttttttttctttccttcttttcttcttcctctttccttattttcccgttgaatccggcgtggttgctggcggtggcgcgtggcagcgccatgcgaggcgcggccggcggcggctcgcggcagcgcttggcgttgctgccggagcgtggccggcgcgatgagggagcggcggccgtgcggtcggcgcggcgacggtgcggcggctgtgttggcggcgtgacgagggtgcggcgttggcgtggcggagcgcggcactgctggggccgtgcggcgccgtggtcaaagccgtgcgtccggcggcggctcgcggtgagcactgcggcgggcggcggcaccgtgcgaggcgcagccggcggcggtgcgcggcagcacacgaggcggtcgcggttctcggcggtgccgtgcagcggcgtggccggcgaccgtggttcgatgccgtgcagtggcgtgggcggcggcgtgacgccgtgcctcaggtccgtctccgatccatgcttgtattagcaagttcgtctctgccatgatggaggatgccgagaaaactccagtcggctagatgccggcgactccaagtcggcgatggcggttttcgtcgggagttaaaaaacggaacgtggaagacaggggtggaggcaggcctat

SEQ ID NO: 37676 - DNA, 4901 bp, Oryza sativa
agagcttcatgcctgataacgtattacgcaaccttcctgctacacgaagtagtccaagaggatcccgtaattccacagaaagtggagacacaaactttaaggtgagactctcttttctattcaatcctccaatcaactatactaatgagtagccccccctcctctgtttatatagtgcattccaatatatggaaggttcggtgatgagcccaataagtgtatttgggccaggcccaatgcaagtccctgcatgcaagaacaagtgaaatatatggccattagtcaattatttgatagcaaggaaatgaggggagtacaatgcgtttatggagtacagagaaaggactagggattatagcatgtgctcaccttgctttgtcgtcgtcagagcttacggggggaggaggccgaagccatgtcggcagaggaatctgtggcggcagatggcatgctgactagcgacgggccgcgcaacgacgggcggaggaggcgggcggcccgacaacggtcaaaggcgccgtgcgagtgttgacggctaggggcgggaccgcgctcacgcgaggagaggcagcggcgctgtgcgtaggtggagattggagtctaaaaaaatttggagatggggagggttgactggttgactaggattagaaaatacgtggtcattgggcttcatttgggccaaaacgactataaagtctagaattggtccctagctgcactgcatgcatgccaccgcagggacggggatggggagtggtgcatcatctccgcccctaccatccctaatggtgatgagttttggaccattagatttcccatggatggtagatatcaaccatcctcatcccctaatatgtgaattcaccgcggggaattggtgatcgggtccccattgccatctctaattaggaaggactaacaatgtttattgagaatatgtatagtgttttagtctttcaaatggcatgaaaagaattgttttggtgattcaattcaattggaatgaaatgtacggcaaaagtgttttcgaaggtaatcctttttcattttttatccacagcaaaagccatactataaagagatatgccgctttgaaatctatggttgaaaaactgaaatctattcgcaaagtgtttcatttggaaaaactttcaagttgctggaattttcaatggatcggaatttcttatatggctttggaagaggggttgttcagattgatgccatttttaactatatcattttttggcaaagttgccaaaaaagtatctacatttagtttattgccaaactttggtacatacataaggaatcctgccaaattttggtaatattgccaacttgccaaaattttggcatcgctagaatttggtaaggttaattttggttacaatctgaataggccatctaatatggcgcaaaatgcttatgtatggagaaatataggaagggccagtttggattgctaccctaccaaaattttggtagacctctattaaaacactacttatgccactaatttagctctgcccatgaacttgtctcttattggcatattttggcttcaatccaaatgaacattttcaactctaccctaccaaaattttggtagtgccaaaatttgtccaagatttggcactactaaaattttggtagggcatcaatccaaacatgcccgaagttccgatatgcttattggaatatgcgatgtgttggtttttggctaggttggaggatgtaattcaaactggttggaatttctcatgatcgcatcggaatatccaatatgaataatctttgcctctaacggtagatttaggagtgggctataaatacccccctcctcttcttgagattcactttgagccttactttccaaaccttatcctctctcattctacacaatttgattttgtgcgaatgagttggttttggaagatcttgtacttggtgagttcttgattggtcttttgagcactagcttttcaacttcaaggagttattgttacatctattactattggagattgagaactcctagatgtttaggtgtcaccattgagccaccgatccgagtgtggtaggttgagagaagtttgtgaaagccaagatcttagcttgcttggcttagcttgctgccttgtgcagattataatttttgattttcatatcaaaatttctagttgtattagaatatctaacacttcggaatatccgacttttccttttagcttccgcttcgtactaagttttatattgcatattcaccctccctctacgcctaaagatgtccttctagttaacaaaatacttttggcatttcaagaaggagagatgtttatatatatatatatatatatatatatatatatatatatatatatatatatagagcggatttaaggggggtgggacatagagaatttacaagagaaaaaaaaagaagagaggagcagctaattgagggagctaatccatgattgccagagggggatatcaacaacttttgctctatgcatatgtagaacaaactctcctttgaagccacttttccaaggtagagaaggagatatgcatatgtagaaccagtggcagagccagaaattttcttgagcctaggcaagtctaacaagagataaaaactatatataaaaaattggaccgcttatcatagacaaaagtaaagttgattgttgccaagttacaatttatggttgtttattgttaatgagttagagtacggggctactatacatcaggaaagcaagattagcgatatgatgattttgcccttgctttgcttgtttgttggctagtcatctaactaaccttcattggaaccaggaagcaacataattatgtaaacaattaatgagtaaatgttgtttatgctgtggagcaatgtgtgtaagtgtgttgcgatggcatggagcccgggcagctgcccatgctagccgggccctgcctgagccactgtgtagaacaaactctcctttgaagccacttttccaaggtagagaaggagacagggatgttgttaaagatgaagtcattcctccttgtccaaatattccaacaggcaattccaataacttcaacaaagaaggggtgcacaaagtttcttcgagctgtgattatcatgtgtaagaattccatattaaggttctattaaattcccaagagatgccaacattgctgagaaaaatggcatgtaaagaatagatgcgaggcatcttcaaccattgcatgagtgcacatgacacagtttggcccactttagagatttacttgttttctttggagcatttctcgggtgtttagcctgttcatcggaaggagccagagaaaaactttaattttcattgtacacttactcttccagatcatgacgatggcaggagagggttgatactgtgagaaaaagaaagggtgcaatttcttggattgataaacttaggagttccagatataatgagaaggagagaagttaaaagaaaaacacatctcgctaagcaaaacgaacaacttgatgttaaaaaaaggttttgaattgtctatttcatatcgcaaaagcaataatgcttatcatccctccttttagcaaggttattctttattagaactacttttctatgcagcaaccatataaaaactttgattttagtgtcacttatgactccttttcattctcttcgaaatgctcgtactggagtccattataatcgtgtacataaaatataccaaaaaagtacatttctatgtaatggcccacaaagtaattttttaaaaaacttaaaagagttacctggatcaaccggtggattaaatcatttcactcaatcaaattgagaacaataattgctcgccttacttattacttctaccaacgaggcaacggcgtattaatgactactccatcggttcctaaatatggattatataagcatttttagttttgtttagcaaatattaagaatatggggaacattccttttcagtcatcttacttgtaatattttgaattgtttgaatttttcctcctaagcacctggttgggtagagaaatgcttagatttctttgaatttgaatcatgtactagaaatatttatattgcgtaaaatttcggatattagagacggtttgttaccggcaacagtaatcttcaaaacagaaaaagaaaaaagaaaaaaagagaacactcgagaacattcgaagcatcgacaatcaaaggaagaaaggagagagagagagaggaggggactcatcatcactcatgagagcgaggggtcggtagatcgtgataaggatcagctgcgcacccgcacgtacgtcctgcgctgcatttcactgcagctggacccgcccgaattcacccaattctttaatccctcccacccagcggacgcgagacgcctctgctctgctctcttgcttggagtttggagagatcgagagaaaggagaaggatacagcttttggaggaaaaacaacggatcgaaatccctcccattaggggctttgggattaaaatagcggtaacacacacacaaaaggttcgttaattcgtttccctgtcgataagtttatcttcttcttctctcatcgtcatcctgtgcacatatacctgccccgtgcgtgcgtattttatctacagctttcttgattcgcttggcttcttttattattattattattattattattattattattattattattattattattattattattattattattattctctagctttgttggcttgtggcgagtcttcgagaaggggcaaatgctaaccgcaggtgggttcttcagttcttgtgagttggggcttgggtttgttcttggttggattgttggtcactcggtcagtccggtgctgctgctgcaagag

SEQ ID NO: 37677 - DNA, 7795 bp, Oryza sativa
cctgtctcaactctcaagattggtggtcgaatgagtgtctctttacttgattagatgctgatttgcccaacaagtttggatttttttttttcttttctcactgttttgtcagctcgattcgtgcaggtagctaagcttttctcgtttcttgagcaatggctgttggaagcagttcagtactagtttcctatggttgatttgtactgttattttccccccttctgaatttgatctgggtaaagtagtagtaaagtgagtagaatagttcctttctctctctctctctagttaccagttgcttcccttttggatgcttttttatgtgattctgaaaacaaaaaagcttggaatctttgatgtgctctcaagctctttgcccaaatgatggctgctagagcttgcagtggcaacatagcttttgctttgtttgcttcccctcacttcccgttacagttcttgtcagctttttccccttccttgagagttgaacatttaagcaaattattcttcctttctcatgctagtataatttgctggtcaaaacattgttggttctttgataatgtttttcagatgaacacctcttaatggtttttaaaaaatatttcttatttacacctttttttcttggggtttttttaaatgttcatgtctaaccattaagcagcacaatatttgagttacgcagtggcttcgtcttaacctgctatacttcttgattatcatttctgccgggctgtaatggaatagatgcttgttctgttgacagtgtattgggacttcagattttgagtgacatgagtgtatttacggttttctatctggctatagtttgctaaattattttcacaaaacaaaaaagaggtgtgttcgcaaggttagcatactatactatatctctgtcacatcataatcttgaataaatccaattgtcttctagtggcatgttccaatcgtcatagttatttagcgatcttatgctgctcaatttcttctattaaaatttctagtcttttgtttgtgaatgcatatatagtcgattagagacaacacttttttccatttagcaagcttattatctttataaaaaaaaaccatgcatattgaagcacctctctgttgctggacaaatgttttaagctcttttactacaactagtgcagatatcttttattaaaaaaaaatgccaacaagatattgaacattgtgtttccagactcaagaggtacactgtttttctaagcagagagaagcaccttgctgtgtagcgttttacttatttagtctatgtttcatcttgttgaaaattttcaggtttaacattttgttagatagcaataagctgttgtctttatcaacatatagcggtgtacacaagttattacatgttagggctaatatagatcagttgagattgaccgtatacatcatgcttaggtttcaaatatctgttctgatgaagaaaactctgacaaatgattctgaaggataaatgatggaggatatttggtagtcaaagtattcaatgcagatgtttttttttctttgccataagcccataacaagaaaatacactaaatatatgaccttccttcttacttgtaaagaattagaagctgaatcatgtttgtttattgatgtttccgaatcaattggacattgccttctggggtgccaagttgaaagttcatctcttcacgtacttcttacatagggatgctcagttggaataatagctggcattcaagttcaacagaaaatagaacaatggagagggaaattgtggcctcatatgaacccaagaagaataacgaaatcaggatgtttgagagttcagacgagatggcaacagatctggctgagtatatttcacaagtttcagaaatttctattaaggaaagaggttactttgctattgccctgtctggagggcctcttatcagttttatgcggtaacactgcttccattagcttcactaactaatatttcagttcgcgttttccagtatgtgtgccttcaagattctgtacctaaattgctttttttttccttcaaacaggaaactttgtgaagcaccatacaacaaaaccctggattggtctaaatggtacatcttctgggctgatgaacgtgcggtggctaagaaccatgtggatagctactataaatcaacaaaagaagattttctctccaaggtatatcagcttaagaagtactccatatgctaaagtaatctagggtgcttgtatagtccatccttttgtttatcggtttctttgtttcaccaatctgagttaattattgtgcgtgtgtactgatacacatgccactataacaagaaaaacaaaggatttttagatgagaatctgtggaagtttatatctgttaatctgaactatgcttgtcccctggttcaaaactctgtgcagttgaggccggagatgtaatccatttccattatctaaaaaaattgcagttgcatcaaatacattttgataagcaataatgaaaccaatacatgtgctctgatctggtaatctggtactgcaatctgatcggaaaacatagatgcaatattatttaatccaaaagtaaatgctttgtttacacaatggtttccgagcaatattttttgtttgacttgggatgtggtctggtctgtgcagatcatgcaaaatccttttctcaataattaacccgcattaaggctacattcggcctaccaacagttgtagttcttccaactactctgggggtgccagctgcatgcctaccacatatttgcttatcttctcattactatatccagcagatgttatccgattgaagagcttatccaaatgagtgtgcattattggtacaggaaaatatcttgtcagttgaaccacactggtatataccagttatatggttcttggtttggaaatcttacactcatagtgaagtttaaagagcttacaacacagttttagatttcatatctatactgtatctgcttgccatcctgtcatattgttaaaagtttatctacctgaacttttaacaaaggatcatttgctcaattgcacatcaaagccttagataagttggcgcatttgttggttttgtcataattaatgtaaaaaagaaggatgttgcaaggtctctctatgttttggttctacaaatcactggtggcattaacattaggttttatgttaagtattttacttcacaaacttacagctttgttggaagtacgatgtagctgtgacttgttaattaatataaggcactccaaggtttcttttgagtgaaccatgaatttgttacatctgaattgggttttgtaggtgcctattcttaatggtcacgtctactccatcaatgacaatgtgacggtggaggatgcagcgacggactacgaattcgtcatccgtcagctggtcaagattcgcacagtcggagtttcagagagcaacgactgccccaagtttgatctgatcctccttagcatcggctctgatggtcatgtagcctcattgttccccaaccatcctgcacttgagctcaaggacgactgggtcacctacatcaccgactctccggtgccgccaccggagaggatcaccttcacccttcccgtgataaactcggcatcgaacatcgccgtagtggccaccggagaagacaaggcaaaggctgtgtattttgccatctctgacggtacagagggtcctgatgctccatcaattcctgcaagaatggttcagccaacggacggtaagttggtttggtttttggacaaggcgagtgcctcgtttcttgaggccaagaccaagaacgatgggtatgagcatccaaagtattagcgacttggcattccctttttgctgcctatgaagagttgagttgatcatgtagtagttgatggtttttgatggaagatgctttcctccattaccttggtagtaagcagttcaggtgctcgttttgaaggtacttggatctgagaatatgaaaatatccgtgtctttttggagttgaccatggcgcatgggtaatagagatgtaatctgtactttattttgagaactcacagaagttactgagagtagctaagttcaaatattggccgaatatgttagcgatgcttggtgtgcactctattatatgtgagtttaagttgcattcttttgctctgattgttcttttgcatggcagaactagcaatgttcatcagagcatatttggattggctgaactctggcgataactcagattaagctgctcgttgtctctatgtttcctcaatgaggaaaaggaaattaagtgtatttaaaaaaaacagtgtacgttgtagtatcttttaggaaatagcacaatacatacttttttgcttaactaaaaaccggtggtggaaagaaaagttaaggcctgtacttgaatgctgtttgctgtattacactgatgttacagtaagaaattaaaatgtgtcgggcacctctagatttaaggctgggtttatgaggtgggacctccccgcacggaaaatggtgttacttattaatatgtgattaattaagtgttagtttagaaaaacttgataaatgaattaatataatttttaaagcgacttttctataaaaaaaatctaaaaaaatacaccataatagtttaaaaagtgtgcgtgtagaaaaagaaaaggaaaaagtgcaccaaaggtctctcaacttgtcatcggaataaaaaacgttctcaaaccacaaaaccagatacgcggggtcccttaactatacaaaaccggtcacccgaggtccttcggtggttttgaccccggttttggtctacgtggcggctgagtgagcgtgggaccctgcataggacccatgtgtcggcgtgccacgtcatctctgtctttccctttcttttttctcaactttttttacttctctttgcgagcgcgcggcggccggcgggcatggtggtcgtcggcgtcctcctcggctcctcctcctccacggccggatccagccgcggcgcggtgtccggcgtcctcctcctcctccgccgccggatcgacggtgtgccccgcttctccctgcctcgccatccgccgggacgacgccacgacgggatgacccgcaacctccacggccacctcttgcgcggccgcgacctccgtgtcggcctcgccgaccaccccagcaacaggcccctggaggacggggtggcggaaggggcggcgctggaggaggagccggagccgatggagacgacgaggaggtcgtcgacgccggcggcgagggggaactcctacttgttgtggaggacttgggtgatggcggcggcggtggggttgcccatggccgccaccccggccgacgccgcggcgatggccgtgcgcccgtcgacggagcggacggctgtggcggtggccccgccggcgcacgtcgcggcgcagacgtcgcggaggcggaaggcgaagcagcggcgcgacggtgtcacgcagcgtggcgtcgccgaacacccgctgcagcgacgacctctccaccgacccacgccggaacagcgccgccacccacctcccccctccaccgccgcgccaccctcccttcccgaggctcgccgccacgaacgccagtgcgactgccgccgtgtacctcggctgcccattgcccccttcaagtccgggttgcctctgctctgcgccatctcggccatgtcgccgccagtccccacgccaccgtgccctatgtcggccccgatccgccgcctcttgtagggatcggacccaatgttgccggccgcggccagctcctccttcttggcgagcatggcgcgcagcacgacgcccgggttggcgaggttggcggcgacggcgacggcgacggcggagccactggaggatccgccggggacactgccgggggcgcatgggttggtcggcgtgccgtcgcgcgcgttctccccatagatgctgcgttgttgcggccaagaaatagtggtgccgaggctgtggggccggcggcgagcgcagcgaggacgacgggggaagtggcggcggcgggcgcgtgggtcctcgcccagtccgggttgccgaacccggtgacgcggccggcgatgtcgaagctgcgaaacaaaaccaaatcaaagagtcagtcgtcgtcttcactgccgtgtgcttcattttgggggcagcgagagcgagcaagcatgagtaacatgtccttgatggcgaaggtgaggccgtgcagggggagttgctgcgacgacggcgattgcggcggcggcggcggcggcggcggcagcagcacgaacctctcactcggcggctaccgcttcgatcaccgctcgccgccgcccgtttcttgctactcccatgccgcaaagagaagtaaaaaaagaagagaaaaacgaaaggggaaagagagggatgacgtggcatgctgacatgtggggcccacgtgctttccacgctgactcagctgccacgtagtctaaaatcgaggtcaaaaccaccgaaggacctcgggtgaccggttttgtatagttaagagaccccgcgtatctggttttacggttcgaggacgttttttatcccgatgacaagttaagggaccttcggtgcactttttccagaaaaaaatggaagtgagttgggaaagaaggggaaagaacacaacgggcttgtttggtttggaaccaatttttgccctactaaaatcttagtagtgccaaaaccttggcaagttttggcactaccaaattgggtagtattgaatttaaactattgcgggcaaaatttggtagcaaaccaaacattcacttgctactattgaagttaccaaaattttagtaaggtaataagttggtatcaaaccaaacaagcccaacatcaaagcctgccaacggtttgaagtccagcccattcccagcccaaaccgcattagctatgtataataccacaaggcccaaatcatcccaatccattgagccggtgcctaacccagttttcaccactgtagatgcaaaataatttcacctcaactctaatatctgtctaaaccccaataaatagttatatttacagacaaagagagtactaactactctatttgtatttactgctgttgcattgcttggtatgatatttcccaatatgatcgggaatggcaaaggcaatatttcccaatcggatcgggaatggcaaagttttcactgtatattcactgtattattagcttctcttgtcagatcgggaatggtaaaggcaatttttgcatggtggtaaaatctcaaataatccatctttggagcttgttccccatggggaatggagggcgaggccttgacgataattttgccttttcaatacacccaagtcccgactatccatcctgaacatgcctatttccggcacaaatgacaaatgatgatctacattattaaactagtcaaataacttgcttatgtaatcacctcatctttccatttttccttctttttattgaagaaagtaaagaggaaagagaaaactgcattgtaagcctataaaatgatgaaatgaaatgaaaatcagtgtgccctttttacctggatttttcacattttggtccttttaaaaaacttatttcgcaaatagacccctgaaaaaacttatcccagaaatggtcctttttggggcgccagagtggctggcgccgtcatccaatgtctggcgccgtcctcctgccaccgtggcgcacgtgaaccgacgtggcaggaggagggcgccagactttggattgacggcgccagccactctggcgcccc

SEQ ID NO: 37678 - DNA, 4059 bp, Oryza sativa
ccgtcctgttgaacaacggcgccagccactctggcgccccaaaaaggaccatttttgggataagtttttctaggggtctacttgcgaaataagttttttaaaaggaccaaaatgtgaaaaatccagccctttttaatgtactgttgtctctcggagcctatattcactgtagctttttataaaattttaaaagataagcattattggctccctctaataataaataaaatttattgattccgcctccgctagtatccttaaacacccaaaccgcatatattgatttccaggcttccagcatgacataattgctactccctctaggttataagatgttttcacttaggtcaaagtcatataaggtggacacgaagctctccaaagatataagcactatcagatcatcatatcaatatacatccggtggatacaatccttaaacatgagtatggtattacctctcattgagaggacctcaacctgtctaaatccttgttttcgcatccatccaattttacatcttgtgtgctacccttttttattattgtcgatttccagaatcaataatatgcttcagtggggaggcagcccatgcatattttcactaactagccaccaatctgtgttgagttgcctcgacacagttagcgaaccaaatttggatatgcatgtatagatggccaaatagaccgcttggctcggcacaacccaagtacgaccgggcccgggtctaggtcagtcgggctagcaaggccccacctacacgacgggccaggaagtgcctaccactggctgcaccaatgacccaggcacggctcaataagacttgggacgtgctgggccggcccgaaggcacaatagcccgttgtgcttctctgtataataattttatttttccttcctcatatctttgggttgtgtctaacatagcaagaataagtctattttgcatccttgtctttgggacatgcctcatatgcctaaattaagtatattttggatccctcaattatttttctttgaccgtgtcgtgccaggccagtccactctgccaaggcatcggcccagtgtcacgcccagaaatttagtcctaaatttccagactattttgtgtattaaatccctgtccaggactagccagggtacacaaaacgacaagtaataaacagatccaaacgtaaataaagcgtaaaatactcacagaagaggcacttagtcctcacatcgaaagagaacgacagcagcggaaaaagacgatcctagcgaggcttcagctccactccacaggcaaaactcaactggggtatgagccttggtcctctaacttcgtcttcagctcagaagcactacacttctgaaaagggggaataatagcaaggctgagtacaaccaccatactcagcaagccacaccaatgatgcagacgtgcaaggggaacacaaggacagtttgtggctatttgcataaaggtggttgtaaaacattttattaagcaaaacagtaaaacagttgagtgattaaagtaacattaaatctccactgatcaacgctacactacgttgaacatgcccaaccaacccacctgaactacagtgcattgagtcgatttattaagggtgagactaatcacggtgaatctggtcgatcgcccataaccgcggacacggctattcgaatagttttactttggccagaggtgcacaactgtacccacaagacataatccaccggcatgtcaccgcgtcatcatgcgcccatgatgaacacatcaccatgtcgagtgattttgacaagacccttcatataaccctcccctaactatccacaccacgctaaggtttcaccctcactcctcgcaaggcagcgggcagtcccctcgtgcgccgcggtgaatccggcagctggacaaccggacaccccggccgacccaactccatcacacccaccctcgccaccggtgcctaggaaagggtcgagctatactttagatcaagcagttacccactcccgcttgtggcaagcgctgtatgttttccagggtttcccatgaaccggtccttaattgccatgggtgtaaccagcaaaaccatacacccacagcccaccattcagtcacattttagttggataattacgcccaatgaaacatagtcgggtgtctcgagcacacagctcgttctgatactaaaaaggtctaatactgcaattatcccatcaactgagctagtggtaattaagcatggctaagcatatagttctagctaggtcacataagtaacacaagctagtcgatttgttacccaaggttgacaaaagacatatatcaagtaaacatggcacaagagagcagatcggtaaaccctgatcccatgtaattagcaaaacatgcatatttatttacaaacggtaaaacatttataaattgggatcaacatgctcaaggggaatgtgtgacttgccttgcttcttcacttggatcttctgaactcttttcctcgtgaccgcagacttccgaaacggcggaaactacacgctggcacgcaaaacgaggaaaacactaataaaaccaaggaaacagtacataacaaacatgtagatcttaaatttagatgaattttgcaagttgaatggcccaattcagagttcgaatgaattagataggaattttagaaattttgagccatttatatgaatttctagaattattactgatttatcgtgcaattattaattattttcttgaaggaaaagattaagcgctgacgtcatcaaagaggccggcgccgacaggcgggccccacacgtcagcgagacaaggaggtggtccaccgtggaccgggaccacaaggacggtccaccgccggtccacgggttggacggcctagatcggccaagccgatcgggtggctaagagggaggcagccggctggcacatgaccaccggctggcagcagccggcgacggcgcggggagcagcggcgcacgcgggcggtggcggcgcacgtgagggaacggcggcgcggcgcggcaaggggaggcggcagccggctgcctggcacagccggcagcggcacgggcgcggagcacggcagtggcgactcggcagcgacggcgcgtcgcgaggcggccagcgaaggagagatagagggagagggagggatgctcaccgagctcatgcaacggcgagaaggtgacgggaaggcggccgacggcgaggaacagcgacagcaggctccttgggagggcggcgcggtggagcttcggcaaccaccggcgaacgtggaggggtggccgggcttgctcgagacctgctgaaagtggaggagggggagatatggcctgaggcggcgggaatcaccggccggagaaggtagagatggagaagctcaccggtgctctggattccgacggcgaggagtggcggccgagggtctcctcatccttgcgaagtcgagggaggcgacggcacagtgcggggtcggccagagaggcggtgcggtgtggctgtagttggcgacgagggcggagagagatggtgaacgtggcggcggcgtttcggcaatagattggggaagaggagcgatagacggggtgcggtgaggcgtggcggcgctgtgggtggcggcggcatggccgggcaaagcgacgctcgccggcgggaggcagctggaggcggcagtggctcgggtcggcggtggaagcggcgctacggcgaggcttcggggaggacgaatggatgccagggtgcagtgcggcgtgacgaagctagtggtggcagcggagcagtgcggcgacagcgggaacggcgggaagcggtggctagaggcacggcggcgagcggcggagcgcaggcttgagcggggagcacgggagagggtgcgaggagctcggggaggagggggaaacggaagacgagagcacgagggtgctttatatagggctcggggatggagatcgtggctgggagagacgggatcggccggcgacgtgaggaggcgaagtggagctcgtggggaggtcaaaccggcgccgtttcttgcggagtgagtgggggaaata

SEQ ID NO: 37679 - DNA, 37181 bp, Oryza sativa
  unsure (1)..(37181): unsure at all n locations
tgattgagaggcgcgggtggggtggtggtggattcggcggcggagtggggtggcaatggcagcagttgccggcctggctagaggtcggggatgacaggtggggtccaccggtcccacctgtcggcctgagagaggaggaaacgggctagggacgtattgtagacttgagggagagtgagagccaagcgggctgagggagggaaggccgccctatgaaggaggaggggagggatttgggccgagcccgaaagggaggaagggaaagattattttcctttctttttatttaattgattaaatgaactttgtgactttaaaattatttattgagctccgaaaattcgcgggaaatttcagagaatattttagggcacaaagaatattacaaaatattctcggccaatgatttttaaaggacattttaattccctcaataattcacttgattaaattaatttaacttttatttaatttctagaaaatgcattattaaatgatttttaatcccgaacgaaaatcggggcgttacaaatctaccccccttacaggaatctcgtcccgagattctgggatggctagaaagaaagctggtgtatgcggtctgactgatctaactgaccaacctgcacgactgaactggttggattcgacctttctgtttctttgttttgccaaaactggaccgactggttctacatgaactaacccagaccaggactgtggatgttcatggaacttatgtatcttggactgaactgtttgatgtgctcgagggtgtcccgatctttcgatgagagggataagtcgattggatggagtgacattggcgatctgactacaactatccagggatgttgcgccttagcaatcgttacaccaactccagaggcggtcgtgaatctcgacggatgcacgatcagcccaaccacgagggtatttgttcctgcaagcaatcgagaaccagcaagaacaagatgaacaagcaactaaatttgcaaatcaaagatgatggattgaatcagcagaagtaacaagtggggttcagtaacaagcaatccggcgatctaatcgatcacgggatcaactcggcaaagtagcgacgctatactttgatctaaacaaaacccgattattcttggcggtgaagaaagctataagaagaggaagaggacaaccacaggggtgctggggtcgttctctcaccctaggacgcgtccctaatggacccaacttgatacacggcccattgggcccaaagaggtgacgcagcaccgtggatagaaaaggacttggtaataaaatgaagattgcggccgctccagaactgatatggatatgaggctagatccatttaaaagtagacttgacaagctttccatgaagtacttgcacgcccaaatcggagttcgcatgaagtcgtgacggctgtcagaagttggtgttgtgctgcagtccgaatccatcccgcgcgaatcctctccccgtttgatcctctccattgttactgagtaaaacaagagtgcacgtgtctccggggtataaataagaatcatatgaatttaagaatgaacgcacctgatagttgagttgacgtgcacgagcacgggcaataggaccatgaagttgtacttgtggaggcgtagatgtatcgttggtgttgatgtcctcatcactcttaatgctggcaattttggtaacccgacaattcaccatgctggctagaagaggatgaagttgttctgaaacttgcatgtgacacttgtaaatcattgaccctacgtccgcttgagctggtcctaactcgaatgacaagtaattccagaaaacctagaaacctgcttgacctgtctttcgtctgaactgcaaccgtccctgatgttgcttctctaagctgaactattgacctggccccacgagtgtaccttagaattgaacctatcaacttgagattggggcaactctgcctatggcttgcaactgactcctttaattactaaccaaattgttgcactgggttgaaccttcaagtgaaatgccgacgaggcaaaccaaaactcatctctgagacctaccccccttacagagagtagtcatactttcgtctgactgggaacctttgaactgttgtccttgaaaaatcaccaacacttctcgaatttacggagccctgactttgaaaattgaaaacttgaccagtcaatcaaaatgacttaacccttagctgacgataggaaattccacacaaaagtgactctcatctagctcatgaacatactgactcttgactcactttcccatcagttctaactgctggcatgattgtcctgcttctggcctgacttcggtgtcgagttgcatagttgatttctgaaaactaacctgaccgactctgcattggaactgatgcaatttgaggagctggggtgctgcaaataaagttgtcgacctgatgacgctgacgccttgccgatgaataaccttctgagaagtgacttgtcgtacatcttccatgaatggttggacactttgcaaaaactgcccttaaaaaccataaccactataggtagcacttgttgcttcagggatcgatggcggcttagctgtgctggtctgctgagggcttggtggtgtactgttcgaggttgcgggtgcttgctcttggaaaacaaactggctttggctctgatcctgattccggcttgcatctgggcttgtacctgttgttggagacacaattgttgcatctgctgcatcggactctgcgattgctgcatcaacataggacacatccatcatctgaccttgactaaccagaatctgaccagagcgtggtgctcggactcagctggtagcttgttgtctcggactgatcaaaagctctgacctcaacacactactgctggagttgcttccgctacattcgaccttgcatcgagctttgcatctcctgcatcaatacgcccatcatctgatcttggacaccaaatgttgatcacgagcaagggttcttctggcattggggtactttgttgctttcaactgaaccgttgatctgtgactttaacacaccatcgttgttgttgctcttctctctgacactgaccatctgctgccaggatggaagatagatggaaaagaggggttgctaaaggtaagaccttaaaccacttgactactgatctgttgtgagtagacttttattgttcaagttgcttaaggaaacaacctagtatggtcgcatccccaccaatgatgcaaaccatacccctacacacaagcaaacaacacatgatctagcagctaacgaaactactcttccggggaggattgggattaggaaaactctgggaaaacttcacttgaccttcgtggaacgacgaccctgaactaatcttctcgctctttgcacgaagcttgaggcttgacttggcttgacttccgaacagacatgaagctggcggtttatcctccagggtttaacaactataagaattggagggacagggagaagaattttgaaaaaccgttttgcaaagaaatgccgaaggttttgaaaaaccgtttcgcaaagaaatgcccgagaattttgaaaaaccgtttcgcaaagaattttgagagccttatggcaatttaggaccggtttacgggaaaccctggaagacatacagtgcttgccacaagcgggagtgggtaactgcttgatctaaagtatagctcgaccctttcctaggcaccggtggcgagggtgggcgtgatggagttgggtcggccggtgtgtccggttgtccagctgccggattcaccgcggcgaacgaggggactgcccgctgccttgcgaggagtgggggtgaatccttagcgtggtatggatggttagggagggttatatgaagggtcttgtcacaatcactcgacatggtgacgtgttcatcatgggcgcatgatgacgcggtgacatgccggtggattgtgccttgtgggtacagttgtgcacctctggccagagtaaaattattcgaatagccgtgccggcggttatgggcgatcgaccagattcaccgtgattagtttcacccttaataaatcgactcaatgcacagtagttcaggtgggttggttgggcctgttcaacgtggtgtagcgttgatcagtggagatttaatgttactttaatcactcaactgttttactgttttgcttaataaaatgttttacatccgcctttatgcaaatagccacaaaccgtccttgtgttccccttgcacgtctgcatcattggtgtggcttgctgagtacggtggttgtactcagccttgctattgttccactgctgagctgaagacggagttagaggaccaaggctcagaccccagttgagttttgcctgtggagtggagctgaagccccgctaggatcgcctttttccactgctactgctttcgtttcggtgtgaggactaagagccacttctgtaagtatttacgctttatttacgtttaggacagtatattacttgtcgttttatgtatcctggctggtactggacagggatttaatacacaaaatagtctggaaatttgggctaaatttctaggcgtgacacctaggcacggcccaactgtcgagccggccagcacgagctcgacaccaatcttgccatgttgtgcttgggctgggccgtcgggcctcggcccttatggccatctatacatgcatgatgcatggtcatgtaagctatacattcatatgtggtgtgtttgggacatatagtcacattgttgagtggaccatatttgtggttcaagttagaaatttttgtttgtgtgtgtatacacacacacacaccactggaagaacataaacactattttttgttttttgcagcggcgaagccacctcttagataagtcagacgaccaccaatgctccgtcgatgtcatctcctctatcgatagccgtgaacacttataaaaattagtcgatcactgaaaaacattattagtcattcgggcttgacgacatcgctagctccaccatgttttatcactacatgttcaattgacttggcatgttttggactttttacacttgacccttttgttgaaaacttattttacaaagactcttataataaaaacgtattgtgagaatgaaacttttttctcaatgccaaggtcattagcgtcgggattcatgtctctgtaccaatgatactggccccgaaacccttgcatctccagtagttaagtcggtgatgtgaaggggttggcgccaagaagaccaatacaaggacctacatgtaaaaaaaatgaatgagttaaaaaatgtaaatatttttcttacaaacagatcctagttaactagggctgaaaacggtaatggaaattcccggccaaccgatgttcgtttccgactttctaccagccaagccatatggaaatggtaatcgatcgaatcgaaaatagaaatggaaacggaaatggttttgctattataccgatcatttccttatttaccgtatttttgtggaaattaccctttcttataatatactccctccgttttaggttataagacggggtnactttcnccaanntncgtctgctttggntttgaccgnccttgtgggaaaaaaagtattgatattttcaacccaaaactaatttattaggaaaatatattcaattattgatttgacaaaattaatttagtattataaatattactatatttgtctataaacttagtcaaacttaaaactatttgacttggacctaagtcaaaacgtcttataacctgaaacggagggagtagtaattattgtgtttctaaatatgttgatatttaatttaagggtatgtctctaattgacccaccgtttagaaattgattgactcttcaatcaaatccctaacttgagtgcatggttaaaatggagttaatttataatttatatagtataacatgaatttatttatacgtgtagcatacttaggtaaagctaagagaaaatttcttaaatgtcacttaaagttcacgagttttcttatatgccatcgaaaagttgttattcctttatatgccgctgattgaacttattcttcccccatatgccatctatgtcatcatcttatgtaataagaatgtaaaagtacaataatacccttttagtataggtgtccactcgtttctttgcatgtcatccaaataattacaaaaatatatttttttaataacatagaaataatatgtgatatatcactacacaaatatgcaagtttaaatttcacttttacaaaaaatttaaaaaaaaatcaaatttggttatgagcacacctatactagtttcaattaaatttgttgttttcgttacaacttgcgaagatcaaatttgaaattgatttttttgactgatatatcaaatattaatgagtgaatttcagaaaacccatgttttgaggccaatgtaacacataaccacaggttttatttattttctcaagtaaccccgtgcattcaatccaattaacataataccacaggtttaagtgagggaaagtgtcacaaaggcaagtgacatggcaaacctgctccacatcagcagctagccccacctgccaggtcaatgcgtggcctattagggtaggatcacgcgggagaacagaagcgcacattccctgttcccacacacgcgacgcggcaccttccgtctttctcgcgcacgcgggcggcggcggcgttccccaaccatctctcgcatgatggcctccaacgatgatcgtgctgttaacctaggtggaggaagattggaggaagagaacttgttgggtactaagaccagggagatggataaaatcaatattcctagcaggtaactttcatcccttttcttgagatgatcatctgaatagactccaaagcatgctggttggtgatttgcaaggacactctgattcatggttctttgacgaggaattaaatccagccttttgatcatgtttgtcttgtcaagaaattagggctaataaaatataattaggggattattattagggcattacaactatgcaatcgttcttgtgtttgtcattacaaatttgctttctcatcatcggaccgtaattttttaataaaaaaaaatgtagattgaacagtattagaactattgtattgcactcagatacaagactaaacacaattgatatttaatggcctgcaacatttttttctgcttcacaaaagagcatacatgccttcctctttttttttctcggcaaatatgttgtggttttctctgcttcacgatgtatatatttttttctccttgaatttattgtttgctttttaggacggaaggtgatgaatggacaattttaataactgtaataacgaaggaacatccctataactagcaaaaaaaaaagacagatcaactgtaaggtgaaaccattatgctcaagtgtgtatgttgataatggccgagtaaaagcaataacacacgaggatagttttgtcagtttgttgaaaaactgacaaggtcaaagtagtttgacctggcaataaaggacaaaaaatttcgttggatggtatataaggaaataataactttccaatggcatgtaaggaaattcataaactttggaatatgtgtttttatagtttaatgttaccgtatttgttaacggtttctaatctataccgacatatttccatccgtattgttccgtttttggtttttgatatttccgatatcgttttcatttccgactttaccattttccatttcgtttttaagaaaaatatggtcatgaaattggtttgtttctaaccattttcatccctatcgataacaaagcgttgaggatctattttgagaaaaaaatatttatgttttgactctaggtaaatagtatattataggggtgggcataaaaagaccaaatagaaaagatcgagcctgagaaattcggtcctagacagcgaaagaccaaattttgttcgatcagtctcagtctcctcggttaaccgaatagagcgaacttaaaaaatgtccaatgcaacctacaatccactcagttccatagaagtaaactctatttttcacattactactccttctagacatgtaacccaataagagtctttactcagatgtgcttgtgattttttttgactttggtgttgaaaatttctatgatttctttgcatatatgaaactgctgctaaatttcggtcaggattgagaccgagaccaaatttaccggtactgatattttgttattgaaattcggtcttcactattatcgaactgaccgaaagagcgaagaccgagaccgaaatttttggtctgaccgaatacccacccctagtgtattctaccggaatccatgaattgaagcttctaacgaacatactaaataatcaaccttgtactaacttgcatttccctaacaaaattcaacgtacatacaacacacaaatcgatcttttttctaaaaactcccataatcgagatagtaatttttacgaaaatcgtacaaacaatataaaaacaataacgcttttccccgaaaaaaaaacaataacgctttgaccaattaccttttgctgacagttctaacaagcagaagtcaaaccttgtaacttacatttccctatcaaaaacctaacgttcgttcaaatacccaaaacatgttcctcgaaagaaagacccttcccagaatcgagatctcgcagcatcgccttttcagagagaaaaaaacggaggcccgatgtgttccagcgcgctttcccgctggccggccgcgccggcgcgcgcgggaccgccgccgccccaccgcctgctgcaaaaccgcacggcgcgcggcggggccacctgcggttgcgggcggcgtgcgcggtgaggcgccgtgaagatattaattaatgaaggaacacgaggaaacaaataccctgtactactacatgtctcgccttcatcacctctaccgctgccattcgacggtccatattcatttttaccatcaatccgacggcgcaataacagtcggcctccgctactactagtaaaaaaccccatgttactccacttgttaccactattagtaatagcagaaaccatcattagttactaaagtttatagtttcatcgaagattaggaaatcaactcccaagcagtatcaaccgcacgtgcttgtcgcatgccccctggcacactttacgttaatgttccttttcttgtcatagcatttgccctaatcctttaagcctaaccactagcagcactggtagtacaggagtaataatctactggtactaggctaatctgcatgttgtttcgccatcatccaacagctagcgacagaatctagaacggatttccagccatccagtccgataaaaaagggtcaaattggatcctttgtgagagtcattctggcccccacatttcatacctcgcgatgagctagttattacagacaaattaggcatgtttagttccccgtaaaaacttttatcatatcaaattgaatgtttagacatatgtatagaatattaaatatagataaaaaactaattactccgtacacagattgcgtgtaaattgcgagacgaatcttttaagcctaattgcgccatgatttgacaatatggtgctatagtaaatatttgctaatgacagattaattaggcttaataaatttatctcgtagtttacaggcggaatctgtaatttattttgttattagactacgtttaatacttcaaacgtgtgtccgtatacccaatgtgacaagccaaaacttttcacccctgcatctgaacacaaccttagtttttcttgtcataaattatgaattaatccctccgtcagccatggtttttcgcgtccaactttgaccactcatcttatttgaaaaaattttgaaaaaaaataaaaacataagtcacgagtaaagtagtattcatgttttatcatcttataacaacaaaattgctaattataaaaaaatttcaaataagacggacgatcttgggcgctgaaactcatgactgcacttattttaggacggaggtagtattagtactaccggcgatgagccaaaacgtcaatttttcaattgaaaagatattagcctctatcttcagttaaaatagaattagagggagtactccctcggtcccatttcaagtacggccgttaacttctatttaatgtttgatcatctgtcttacttaaaaaatttataaaaaataaaaattaaatcacgtataaagtactattaatattttatcatctaataataaaaaaatattaataaaaaatattaataaaaaatttaaataaaatgaatagttaaacgttagacacagaaaattcacgagggagtatttggatcaggaggacgcgagagtctcaggcctaactttttcttcaaacttctaatttttttatcacattaaaactttcctacccatataaacttctaatttttttttcaaactttaaattttaatcaaacttctaattttagcttggaacacacgctgatgatgagtgagctgaggtctgtcctcttttgagttttgagtcttgactttgacaagtgttgtagtcagtggtactgtagaccacttccatgtgggtggggcccacacgaggccacgtaggaaccgatatggcgacggccggatcgggcgcgcaactgttcgtgcccaaccccggagcccgggccccactaccggatggagtacgtgtactatactcgtagttttagggggtctttgggcaaatacataagtagggtagggacttatattttatatttttatgagagggactaaagtttagtccctagttcccaaacaccctcttagagcatccacaatggtaatctataggctctctataagagatccatgtcagcatatttttctacctgaaagagattaaatgaagagagagaacaaatctatctactaaactggagatagtctataaaaaaaccgaggcaatgtattatagcgctatagatacccatgtagacatactattgaggtgatttactattaatctaatctattgctgagatatacatatagatagtaccttatttttttcattgcgggtgctcaaagttttctcataccaaaaatgccaaaccatttaaatgctcctattaaagtctcccaacccagtgatctttctctggattccttctctctttcccgccataaacggagtggtagtagtactactcaataagtttcccgcgaaattatatattttctttttaaaaaacctagtacgatatactagtagtacgtactcctatacatagactgtgttcggtgatacaagaaagaaataagaaacggatttgctacaaacctatcgccattcgccatattttctgacaaagaaaatatcagatgagtcatgagtgtgaagattcgtactcggcatggagagaaaaaattggcagcacaaacatgtggcgataattgacctaggatccttgtggataaaaaccaatgatgctagccaaactagtcagctttgttttcttgtttattttatgacaagttacatatagttaaatttcagttacaatgtactaattacactagaggtatactatagttatatttaaaagtttttgagtcaaaaaaaaattgtcgatagttttatagatagtcttataagcctgacagtttactgagccgttaattttttgtcaaaaatattatatagctaagttatttaaaaaactatattcatatatttttaaaatttaaaataattaatcatggttcacctactaggttagcttttttttattttggagggaggatgtctaggatactcctcctagggtgtgtttagttcttgaaaaaagttgaaagtttaaaaaaaaatttgaaagtttatgtgtatagaaaagtttttgatgtgatataatatgatagaaagttgagaatacgggaaactaaagacaggtctactgtatatagacgtgatttactaggcagagtatagagaaaaaaatgaagaatgcatcagcgcgcgtgaaggagtcggaggaaaagaagggcatatggcatgggactatgggaggacatgctcccggcctagtgcactgcaacacggccatccttgaatacaaagacccaagaaacacgaaaaactcgaaagctcccagctgcatgcttgcccctgctgcacagagaccaatggccaatgcccctcctcctcctcctcttttctctctcttcgcccacctccgtctctctctctcctcacggagtctgactgacagaggtaaagcagcagtagtcgcagtcgcagtagcagcaacagcagctcgcaccgttgcagcctttgctctctctctcttctctctcctctctcgctcgctcgctgtgtggctggctgcagcgtctgacgcgctctcctaggcaggcctcactcctctctctctctctctctctctctctctctctcttttctttctttctttctcgcacagatacaaaggtgcacccggccccgcccctcccgcgagagcacttcggttttaatcgccgggagaaaaaaaataaatgggaggggcggtttggggaagaagaagttgaagaaggagaggaggacgctgaaaagaccaagcaacaagaagggagtccctctttctctttgggagtggagagagagagagagagagaggcatcggccatggcgaggtttctcctgggtgcggccgccattgcgctgctcgccggcgtgtcgtctctgctgctgatggtgccatttgcaggtcagtgctactgcttcgctttactactcctacctgtctaacggatcggttttttgttacaggagtttagagaataaatatgccatattttctcctttttttttattcttctcggagggtaaaaaaactctgatatttctgggcttgggaggcttggaccttggagtcacctgcttgcttaatgcgtgttgttttgcagtcaaaggttgatgcttctttttgggaaaaaaaattatagcgtttttgtgaatgttttcagtccaagattccttcgaaatggcgccattttgttttgagctcacacatttcacccttcctcaagttggccttgctgcgatgctcgcatggtttctcctctcgaaagacaaaaaaaaaattaaaaggaaaaaaattgctgtcttgattcataagaaggaatgtttcctgaatcttgagtcaggaataagaatcctagtaatagataattatatctgcggttggaatcacgtgaaatcgtggctgcggtgtactactcaagttttatttcgtggacacgggtggtggaacacacaaaagggctgcggtttataccgttccattgtgactagtagtacacctctcgttttaaagaatctagttagaacattagccttttttgggcatgtggccatgcaggtattgtgtttgtttgttaactgtccaaacaatgttgtcctaccatggcctttgtgctctgattctgggctctgttactctgtgtcaactctgtttcatagagttccatattattagtccaagtccaggagttggtacttcgtggcaagaaaaaatcagagcaaatgttgctatagcagtttaccaatttcgtatttattgatctgtttatgtaattattatgttgtatgaagttagaactctgctccccacaaatgtagcatttttcctattcagtccaggaaacaaaggtagaactttcatgagtgctggaagtagttaggcaaaagaacaattatgatggctgtggaacatgtgaattgggcagttccagagttcttccccgtggtttcgtattatgtatgtagagttgaatgcatgcttttggtctagcatcatgtaagcgccgaattcgacccaatcgcggtagtttgtcaatccagttatgtaaactgttattcgaagtagcacttcaggtttgcaaattgcagggtagccacatttatttgcttttactttgtgatatattatacatttttttttgttgtgaaatttgcctgtctctctgcagaagcatatgatcctctcgatccaaatgggaatatcacaatcaagtgggacatcacacagtggaccccagatggctatgttgtaagttcactagattgtcagctttcaacataagctggggctctttgagcctttcatctaaaaaaagttcacgagattatgtgtctgaaactaccatttaccaatagtgttaagtcatgcatggtaatttactataaaaccctgatgtgatctcaattgctctagacatctctctgaaattcactttacagcaaggaacctttattttgtgtttttctcttgtttatagttctactttgcatcctatagaaccccaaataaacaaatgcaagttattcttctagttacattttgatagtgggcaagacagatttgtgcatcatttagctataactctctgttttttttttgtttcatggacacctctttcttaaatgattggtaacttaacagcttctaagagatgtttacttgttcttgatgtcttgtataatgtacttcccgtaggctgttgttaccatatacaacttccagaagtaccgtcatatccaagcgcctggttggagtcttgggtgggcttgggcaaagaaagagatcatttggtccatggctggtgggcaggccacagaacaaggtgattgctcggcattcaaagcaaatataccgcactgctgcaagagggatccgagagttgtcgacttagttcctggggcgccttacaacatgcagtttggaaattgttgcaaaggaggagtgcttacctcatgggtgcaggacccactaaacgcagtagcatcatttcagatcactgttggacattctgggactagcaataagacagtaaaagcgccgaagaacttcactctaaaggccccaggtccaggatatagttgcggattagcgcaagaagtgaaacctcctactaggttcatttcactggatggcagaagaacaactcaagctcatggtaagtcatttcagtgttttttgtctttctggcgtcacaattatgacaccctttcttcctttttttgcagtgacttggaatgtgacatgcacatattcgcagtttgttgctcaaagagctccaacttgttgtgtttcactttcatcgttttacaatgagacaatagttaactgcccgaaatgtgcgtgtggctgccagaataagaagccaggaagctgtgtggagtaagcactgttgctttaggaagtctatggattaacaaactaatttcccacttctgatttcttctatgtattttcgttggtaggggtaattcgccttatttggcgtctgtggtgaatggacctggcaagggcagcttgactcctctagttcaatgcacaccacacatgtgcccaataagagtgcattggcatgttaagctcaattacagggactattggagggttaaggtcacaatcacaaattggaattaccggatgaactactcgcagtggaacttagtagttcaacacccaaattttgaaaacgtctctactgttttcagcttcaactacaaatctttgaacccctatggagtaataagtgagtatttgcttcaacttctgagtaagtttgacaattttaatgtgaaatattttggctaacgattaatcttttgcttcagatgacactgcaatgatgtggggtgtcaagtactacaacgacctgcttatggtggctgggccagatggaaatgtccaatccgagcttctattccggaaggaccggtcaaccttcacctttgacaagggttgggcttttccaaggcgcatatacttcaatggcgaaagttgtgtcatgccttcaccagatctgtacccatggttacccccctcttctactcctagatttaggactgtattccttctcatgtcattcctggtttgtggaacattagcattcttgcacaaccacctagttttagacaaaaactgtggaaagtgctgaccacattgggcattggctgttgacatactgagtcttttggaagtttagggtgtgctcttgcatgaaaagctaattcgcgtttgatttaggttgtaagtttaggttcctcgaaatcattaaagtttgggttgtacattctgatggtgtgtattcttggtctgaagtgtgaagactaattgagaaccccaagtcccaacattaattgtctagagaaatgtttgccatctcatctgattgcaagaaattgcattttgtagttggtcagtaaatgtggaaattgtttcttttttcctctcaattcaaggtcaatacctgcatacatatttgtagtcacaacagaatttgcagaaaagtttgtggtgtgatttctcagggctggcctaactggggactgaccaaaactcttccagcctgattgtgttgtacattatggagatctatcaggcaatttcaaagttaacacaatatcacagatttcctctttgactgaatatccagtatgaatagaccaaaatgcccctacctacactgctctccaaacatgtgggaattatcaagaagacaaagcaaaaggggacatttttctgatcatgccaccaggaggagcaccaccaagatcgccgaggcggcggcggccacggaacgcggcggcccgatcggagcggagttgggtaggtaggggtaggagtccggcggcggcatcttgcactcgtcgccgttgaagtagatcttgcgcgggaacgcccagccctggctgaaggtgaaggtgttgtagtcctttcgcatcagcacctccgactgcacgttgccgaacggccctgcctccatgagcaggtcgttgtagaacttgagcccgtagaacatgccggtgtcgtctgcaatataccatggccgtggtgtcgtccaattagtacaggtatagatatgaaagcgagaacgatgtcggagaggaggaataagaggttgtggtagagagcttactgatgttgccgtaggggaggaggggcttgtactggaagctgaagacctcggtgacgttgttgaggttggggtgctgggcgacgagcgtccactgggtgtagttcatgcggtagttgaagtttgtgatggcgatcttggcgcgccagtagtccttgtagttgagcttgacgtgccagtgcacgcggatcgggcacatgtgcgacgtgcactgcagcagcggcgccccgtccttgcgcggcgtgttcacccccgccgacagcgcccgcttcgagtcgcccatgatgcactcggtgccgccgctgtgccctccgccgccgccgctgttgcgtctgctgcgtccgtcgccggcgcgggcgttcttcccgccgccgccgttgccgcggtagccgtcgtggccgcacccgcaggcgcacctggcgcacggcacgatggtgctgttgtagaaggaggagaaggagacgcagcaggtcgggtagcgcgacgccagctgctgggagtaggtgcaggtgacggtccacgtcatgagcgcctgggtgcggcggcgccggtccggggtgaggtagacggtggaagggacgatggtggccgggccacacgtgtacccgggtcccgggccggcgagggtgaagttggtgggtagcttgacggtcttgttggtggtgccggcgaggccgacggagacctggaaggcggagacggatccggcggggtcctggccgtaggcggagacgacgccggccttgcagcagttggcgatctgctggttgtaggggacgccggggaggaggtcgacgatggccggggtgcgcttgcagctgtgggggatgccgcccttgaacttggagcagtcgccctgctcggtggcctgggcccccacgatggaccagatgacctccttcttggcccacgaccaccccactgtccacccgggcgccaggatctgccggtacatctggtagttgctcatcgtcaccatcgccacgtacccgtcgggcgtccacgatatcacgtcccactttatcgtgatgttccccttcgggtccagcggatcatacgccactgcaagcacacacacatgcatgattgattaatcaacagcaaaagtataatttaattaggaataatgggcaagaagatcgaagaagtaattaacctgcaaccgagcatgtcacggcgaggagcagagcgaggagagagcatctgtgcagctccatcgtcgacctcaccggccggcgagcaagctagcacagcagcagcagctactcgatcgaggtgagcagggaattgaatgagaaggcgtgcactggctggccaggaagagggaggagaaggtagaagaagaagaagccaccgagcggcgagatggcgcgtcacacctcgatggattgatcgtcggttgggtttcttgaggaggactcattgcatgacggaaggggtgatggctcagcgccacctctccgacatggttaacatgccgtgaatcttgggttcgtcccgtgcatatgcgggcatggcgctcgctctgcacactcgtctggctggtctgtgaagctgatgatttggacggcctgcggctgcggcatcgcggctgggcgaagcaaccgtggttgatggtgacggagggaaagggacgccggagatctcgcgcgctcacctcatcgatcgaaccaggagagaagagggtgtgtttgcgatagcgacggcggaacattttgccaatttttcgttcgtgtaaggtgcgcggcatctgttccgccagttgcaacgtttgatcgatcaccgcctctgcagccaccgacgacatgtatatatgactatcaaatttgttttcttcatcaatcactttatattagtactgaagatttaaaataataaaacaatcaaattggtgatcattggatgtcaaaataccatagattacggtcaggccaggccaacgcgagatcgatggatcgtgtcatggatactcgatctgctaccgctcgctctatacctgacgtgattataattgatgtcattagattctgttacttgcttttccatcatacttctgtttggcggtacgactatccctggcttacaaagtggacaaggattttgatattcctcaaccaaccagttggcacgttttttcaacacgaacgccaacctcatcgatcgcatatgcatccttctccatctgccgtacgtacgtacgtacatattcctgtgtaagtacgtactttacttacttgcgtgcgtgatgcacttatacacaatacgagttcagtagaagtagaaagcacggaaccattcattcctctccgatgatccagccaagcagtaagatgaagcatcacacctgacagcaacccctcttatttttcgtaaaattatgcaaccactcttaattttgatgagaaattttcatttacctttatactagtatatactgtagtaacatacaaaaacaagaactcccttaatttttaaaagagtgttgttaccatcctgcgttttgtaccgtgaggtacaggtaccgcgcagtaccaaaactaatccagccgttgattaagcgggggtaggatcggaatagagaaggaacagacaaacccgatgtggcggcgcggcagagaggtgaacaaggcgaagcggcagagcatgattcggcggcatggtggagcccgacgcggcgacgcggctgagcatgaagcagcggcgtgcatgggccacctggtctccatgatcgagttcggcaaggtgttcgccgcccgcggcctcgccgtcaccgtcgtcgtcgtcgacccaccatacagcaacaccggtgcaacgggggctttcctcaccggcgtcaccgcggccaacccggccatgacgttccaccgtctgccgaaggtggaggtgccgccagtggcgtccaagcaccatgagttgcttaccttcgaggtcacccgcctctccaaccccagcctccgcgacttcctcgccggcgccttaagtcaaattccgcggctgagcacgacgcggcggcgcggcggagcccgacggtggcgcggcggcgcggcagagagctgaacgcggcggcgcagagggcattttgcgatgcggtgcagatcgtgctaatgttcaaagactaaactacccttccacctctactgccaaagcggtactgcgccaaggagaaaaatggtaccgcgaggtaccatgcaatcctagccgttagatcaattcgaacgaacggtccagatttcgtacctcggtggtacctcgggggggggggggtgctggacgattaaaaaaactatttttaaaaaccatcctacaactaccaaactaccacatgggttgttatatatgcacgtggcaccatcttgccagctccgtgtgcaccggccgccgggggcctgtctaggcctccgcctccacgcaccttgtcgcgtggccaggcctctccaccgcccgtgcttcgggaaacagattcacagagagatggggaggaagatgagtggaaatagaagagggtgaaggaagaggagaaggggtaatttagtaaaaaaaaatgtagaaaataggtttaaagggttagtagtgacatatgttaaagaaaaaagtctgacttactcccctgaactattgggtgagtatgaattaccctgataaaccctaagactagacatctttcatcctcaactattaataccgtatccacccagcagttttgcaggcgattttggtcctacatggcaccaacatggcaatccaattaggcaaaaaatataaaaaaatgggccccacttatcatatactacaactctatcttttctctctctgtcggcaattgcgctgggggcagggggtgaggcgggcggcattgagcacgacgacgcccgggagggcgcatcgccaacagggcactatggcgggaggcaccgggagaaaagctgggcggcggacgcgagaacgatgccagtcgaccgcatctcccatggaggcagcgttacacagcagcggggtaagggtggcaagcggcggaggcggctgagggcggcgagtagcggaggcgtctctcgtcgtcgatctggtgggccgcaccatcaactgctctagatccactgtcgcccaggaccccacgccattcctcgtcgccctccatctccggctcgctgcttgcggagcctagtccacctctgcttcgctagttgttgcttcctccgactcattgcttgccgagcctggccgctgcttcgtcgactaggagggtggaggcagggggaggtggacttcatcagctgccggagacggctgcaaagagagattgaggaatagatagaaaggtgagaggggaaaaagatggagaacgggagagtatggcatgtagggtcccattaatatttttttttaaaaaaacaaattgctgtctggactgccacgtaggactaaaaccactttggattaagttaagttgtttttcatgcggtattaagatttgagagtgatagatgtctgattttaaggtttaggggagcaattcgtactcacccaatagtttagggggtagtttggactttttcctatgtcaaataacaataaagttatacttcaaattcgtaaaaattgtaaagattgtagtggcatgtatccaactaacctttgaaagaaaggccttactactagaaaaatgacactactacattataaaaagatatttaacacttttccaactcgagtgcgtatatgcgcatctattacatgtctgtgaaatgaatgatcataaaaaatattctacctagttcatatgcgatttcaacaaaattagtactattgacatagatcgtagccaataaatcaatcaaccaatatatcgttgttactaagtgtattattgcaaaatttacagggaaaattgtacaacacacagtatttcttttacaaatgttgacgaaaatccttcgtctcggacgaccagccagggggggagcaaaatcgggcgctctcccctgacgcgcacgtgtcctcatggccccaccatatgtcctgcccctacctgacatgtgtctcaaaaaaatgtttcacctagtgtactcacaattttttattatgtatagatctaatattgcagtaaattaaaatattcttttgcaacaaatcatccacatatttttggaaaccctctattaagggaattcgttttattttttgttccacaaaaaatgtttcacctattgtactcagaatgtttcactatgtatagatctaatgttgcagttaacaaaacattcttttacaacaaatcacatgcatattttggaaaacctctattaagggaattcgtttcattttttgttccacgaaaaatatttcacctagtgtacttataatgtttcactatgtatggatcaaatgttgcaatgaactgaaacattctctcgctatttgctgaaacattgtttttatataaggtgaaacaatgtccgatttaaacgtttgaaacattttgaatctacttagtaaaacaattccaatatacctagtggaacatcgtacaacatttaaaaataattcaataataagctaaaatgttttttcgttggaatatatccatgtgtggtcttgttttgaagatttcattgcaacgaatttaatggtgcaatcagatcatgatttggataaataatttaagagaaaaaatagtttaaagtgcttttgcacgcatgcgtggcgttgacgtcagtatgatgtcagcgcctgattttacccccctccccatcgggcacccgatcaaggcgtgcaaaaatcgggcgttgacgtcatgcacgcatgcgtgcaaaaccactttaaactgtttttttctcttagggcttattcggaacacaggataggaaaaatgcaggaataggaaaaacacaggaatagcataggatttcatatggaaaacggaggattgaaaaactaaggaatttgatgatagaaagcattcggaatacaggaatatatataccacataggaattttactgtcaagagtaattaaccatgtagattataatctaattaagcaacagaatactattttctatctagtcactattctcgagtactctctagacaggaaagccttatcctcttcaccgcatcatccttttccccaatctttcagaggcatggggagcagcaaacaaacaaaatcaacagggatggcgggctcgatggttggcagagcaagctcgcgcgcgcagctgagctacgtaccggggggagcaagcgagacggcggttggccgacgagctcgcacggccgcgcagcaggagcgagctgccgccatggccatcacaagctcgagcagctggcaacctcgagttgcttcttccccttgttttttttttctaattggattgcttcttattcctatccttcagagttcttgctcagttgctttgctcgtattcgtaaaagttcttgtttactgcttgattacctcggtcttacgcgaaggaaaacaaaaatgaggtcggagtggatgttatttttccaatgtttttcctttgtaatcagcagcaaaggaatctttccttagcttttcccatgacctgtttgtgccttccaaatgataggaaaggaaaaaatccatgtcaacattattccttcaaaaatcctttgaaaatactgtaatccgaagatgcccttaaattatttatccaaatcatgatccaattgcaccattaaatttgttgcaattaaatctttaaaacaagaccacacatgaatatattccgacgaaaaacattttagcttattattgaattatttttaaatgttgcacgatgttccaccaagtatatcggaattatttcactaagtagatcaaaaatgtttcagtcctttaaatcgggtgtttttcaccttatataaaaacaatatttcagcaaatagcgaagaatgtttcagttcactgcaacatttgatccatacataatgaaacattatgagtacactaggtgaaacatttttttgtggaacaaaaaattaaacgaattctctaaatagagggtttccaaaatatgtgggtgatttgttgcaaaagaatattttaattcactgcaactttagatctatatatagtgaaacattgtgagtacactaggtgaaatatttttttaagacacatggtggggccaagggaatgtgcgcacgtaggggagggggtggagcacccgttcctgctccactcccgtcggtcacccggggctgagcattttcgaagtttttctccctccgtttttgttcagatagaccaggtactcacgcgtactagcatggcggaggagggtaggggccctcgcggatccatccgcatgagaaggcggcatgggtggctggactagggataaatgggaagaaaatgcttaaattatttttctaatttacaactatatagtgttttttgaaaaaaaagaatcaaaaggtaaaacacaaatgaatattaatacattggaaaacaatcgggaatgaaatgaacagccaatatgattgaatcttgtataacttccaactaattaaattattagacgagtgagctttattagtaacattctttttctaagtatgtatatataattatatatagcactaacaaatttaaccccgaaaccggaggaggctacctctagaggcagcaataaatgggtcaggcaccgggaaatggtcaatcgccggcgttatccgcaggatgacgtcatcctccttggtcttcgccggcaaaggccgctggtttctacggggcttgtcatcgtcgtgctcttccacgctatccctgatcatgagctccacggcggccaacgtggcggcgccgacgagcgcggcgcggcccacggcgagcgggccgtggcgcaagcgggcgacggcccccgtggcggcgccggcggcgacggagacgagcgggtcgtcgtgcctgtcggtcgccgacgacagggcgtggcaggcggcgctgtagacggcgaggcgggcggcccagcgggtggcgaggcagggggcgccgtcgcggacggcctgggcggcgccggcgaggtggcggccgcaggggaagtcgcggaggcccgtgaacaggtgggcgagcgtgccggcggcggcgccgcccacgaagccagcgccggcgttgtccaagacacagtccgggtagggcaccccccactcctcctccatggatcgatcgatctcgacgacgaccttgcactagtgcagggaagaagaacggatcgaatcacgatgcagatttcaagctgggagtgggttgtgataattaagggagacgcgcgcgcgtgcgcctcaacagtgaacacgactcgaatacttggatgaacaccactggtacggatcggattcgtttccaattcccggctcggtttgatatgtttcggccttgttcggttggtccgggaatgactggggttgggctgcaatcccgtggatcagcccaacgcggattcaatgccggcccacaagaaaatacgtgttcggttaaacccaatcagtgtgctacctcaccccaacccgggaaaaaaatcagcttctcctgaggtgtggaaaaaaaaaaatcctcacaacgggagccgggaggcgacgcgcaagcgcaacacgctgcggcggcgccacaactactgaaaggcgatgacgcgactaggaggcgacggcgatgcggtgcctcccctccggcggttgtccccttcagtggctaacttctcaccggtaaacttccttcttccttcccctcttctctctggtgtcctagggtttcctgggtgtctcttcgctcgcggcaacagcagtggtggcatctatcttgatccttttttaatatatagagtgtatctttatagatatgtctaagaataaattaattacctcagtagataattatatgttgaatctttcaatttttgtccagatcaaaaattgataattatcctggtagtatgttggattgattttaggttcaatttcagacatgaagagatcctaccatttcttaaagaaaagaaatcatgcatcactaagcatgtttccgtagtaatatattgaatgcaactcaaattctttgtttgataaagatattagattttacttattaactattgcttatccttttcactcaggcttctgttggttatttgtttctctttatatgaaaggcatataatgacattcttgagagcaagcatgtgtggctttctggtttgtacatgcaggaagaacacttcttttctttgtttttttagcacttctgttcagggtgaagacatcctttggagcaagcattggtgttggatcttatatgattgaatttttgactgatacttctaccttttaactgagacatgtctactcattttactgcttatgtgattaaatcattagacgtgcatggatagttcttgtcagatctgtcaatcttgtgaactaattatgttcagatgggcaagcgattaattatgtgtctgtgtgctgatgagtatgattaattgtgtgtatatgtgctgatgagtatgattaattcgtgtatatcagtatatgtgatgttgagtagatgcatatggccatatgggataacttgtggtgatgctttcccggtcctaaaccatatagaggttttaggagagggattaggagaagcaaggggattcatcccccacagggtttgagtgagacgggagggattccctttggggtaaaacccaataaactgaacaaggccttcctgtgatacagcttgaaccacaataccttgggttttgtgtaatttactcttgagcaaatatcatataaccctaggttttggaaaactagtttcacagaaccacgtgttttgaagttttttttccacgaaacatgcgacttggagctcccgacttactcctactctctccgtcccaaaaaaagacaaactctggttttcgtgcccaacgtttgaccgtccgtcttatttgaaaaatttatgaaaaaaattaaaaagacaaatcacgcataaaatattaatcatgttttatcatctaataataatgaaaatacgaattataaaaaaatttcatataagacggacagtcaaagttggacacggaaacccagggttaacggtagagtaacagtggtgggttaagcggggaacataacatatgcacacaaacttcctgtggacactccatccacaccaactagctaatatcatagaaagttctaggaaaaattggacacatacttccaatagtattacacctatgtgtgaaatcttatcttcaaattcattatattttagctgtaacaaaaaagacaaaattctgacatatttttaccctttaaactgtcagatttttcaccttttcgctacggctaaaatataataaattagaatatgagacttttcagatatgtgtagcacaattaggagtaaatgtccatttttttctagaagttttcgtgacatttgctagttggtgtgcatggagtgtgcgcgggatgtttgtgtgcatagaatattttctatgtcagcgttacggataaggtataccctctacctctggatatatgccgtatactgatacggtatacctgcgcgtatacggatgtttcctgtacacgttaaggaaattcatcacgtaatagaaacggagtctacggatggaaggagtcctactcggactgaactgggtcgtcactgtatcgtgtggggtctgatatctccgagttctacttggagatcaactgacccgcagtataaaagggacccccgggaggacctaaggcattgaatctcactgccaacacaaccaccacagcctacgaagtcgaagcccacaggagccaagtcgccgggtgatctagtcggaccaactcgactacggtctcgtcggtatcatcgagttttgttattccctttataatctatggtttccaccatataattccatatcaactgaattagggctattacctatcaaggggcctgaactagtataatccttgtttcttgtttgcttgatgtcgtattacgtagatcctcgtaccagcgtaccctaataccctttatatccggtctacgggtatcccccgtcgacagaatatgttcccggttaagtgatacatacaagtagcctcaattgtgtgttatgtaaaaaagaaaaatctcaaaacctgttattacgtgaaagtagtcccaaaacatagggatctcgtaatatttactcataactagcacgcgatcgaacggacgatagcggcgggaaccggtgcacaattaacacaaagtgtgggggcctttttgcaaaaataaccgatgatgtggcacacctaattctccaacgatctcacgacatttagagaagttaattatacaagatgcacggcccagtggcggatctaggaagagatagcagggggtctgaataaactagataaagctacatcccctttccatttgcatatagcaaaaaattttagtgggggttttgtgggggctcccatagtactcgtgccagtaatgagggctcaagactccgccgtccccatgctagatccgcccatggcacgaccttttgtttagtagaacttgactatatcattttcatatcaaaagaccttacgacattcttaatagtacaaaattaacttatgttaaataaaatagcctgtatgcgagtttaaaaagctttaattttgagaagcagctgattagttgctagatgataaaaatatgaaaaagctaagttttctagctactaacttctaattgattttatggactatgtagctatagattcttataatctagatagaaactaatttaaataggtgcctaacttaacatataaaacactctctctatcccaatttaatcaacacctgagaaaaaaaatgcagagacccaaaatgctatgtcgcttttttatcccgtggattgtatcatgatttaaatttaatcttatttggttacatgcaacacattcaatgatatttatttactctttaatttttacacaaataaagcccgtggattgcatcatgttttaaatattgtatagaagtgtattaataaagtcaatcttatttggttacattgagcatattcaatgatatttatttactctttacacaaataaacgaagagacttgtttggggtattcatccggcaggcacctcctccaccacgacgggcttcggcggcacccccaggaacccaatcggcggctcgtcgtcgggtttggggtcgctgccgccgccgccatcgatgtcctcctcggggacaagccgcctgtggtagtggacccaggagcgcaagttgtccagcgcggcgtcggccctctcgatgacggccatggacgcggcgccgacgagcgcgccgcggccgacggcgaggggcccccggcgcaggcagtgcgcggcccccgcggcgcccgcggcgagcacggagaccacggggtcgccgtccgtcgcgcgcggcagggacagggcgcacttgaaggcgccgtagaggccgcagcgcgcggcccacgtggcgctgatgcggggcgcgttggcgcggacggcgcgcgccgcgccggcgaggcggtggccgctcgacgagccgaggaggcccctggcggcgtggtaggcggagccgaccccgccgccgatcaggaagccgccgcccgcgtcgtcgagtatgaagcccgggtacggcttccgcggagggctcggcaacggcaagtccgtgtcgcgctcgtccggtcgcggcggggacggcgacgccatgatcggagcacggaggaggctgagctgtgcttggcttgcgctacaagattggtacagtagtagtacagagatcgaacaccgtgatcggcgagtacttgaagaaggaacttgactttgaattcgaaacagatttggattggattgaatttgcacttaatttagtcgaattctagtttccgtgtaatgtaacacaaatcaaatcctaatagattcacctcacgaagctaaaaagatgtaaaattaacaactccggcgacgccgctgtcgatgtcggtgtcctcactgacgctcttcagcgaagaagccgtcggaaaagccggagtcgtcttcgttgtcggcgacagcgacctccttaaccacgatgagctgacccgggaatcccggggaggcggggaggcggcgtggacggcccaccggtgcgcgcgcggcgaggccgcgacgaccgtccgccggcgggaggtcgtctagggcgcggtggatcgcgagggaggcgccctccgcgagcgcgaagaaggcggcgctccagagcgcgtcgcggccggcggtgaccgctccctggcgcaggcgaaggaagccgctcgtggcggcgccggcgaagacgaagttccacgattcctccttcccgccgcgcgcgtaggccatgccgcactcggggacgcagaaggcggcgaagaaggcggcgaagctgccggcggcgcggggcgcccccgcgcggacggcccgggcggcggtggccgcgcggcgagccgcggagccccttgaagaagtggaacggtgagccgagcgcgaacccggtgccggcctcgtggacgatgtggtccgggaacgggatctgcgccgacggtgcgtgcgagccgcccatggagatcggcggcggcggatatggcttggtgacgccgcggcggatcgcgcgcgatggagggcgtacgtgtatcgtaccgtacggggtttcgcgcggtgtatttggacgtgtgcttgtctaggaatacattacgaggcggtttgtttgcgacgtacacgtactcatcgtgtcgctcgcgtgagccgccctgcctctgtttgctccctcgtctgagttgtcgtcggtctcacattcctctgttcgacgcaggcgaggacaaataccagccaactactgcctccgtcccaaaataagtacagctatagatatccgtgtttagcgcttggaccatccgtcttgaaaaacttatgaaaaatattaaaaaaaattagtcacacataaaatactattcatgttttatcatctaataacaataaaaatactaatcataatctttttttcaaataaaacaaacggtcaaacattgaacatgaaccgtgctaaaactgtatttattttgggacggagggagtagattatagataaaattagcagggaacctacggattgtctattaatttaccgtgtaagtggatttatatatcgatccacttgcattactagatgcggtaagccggaccacaatgcgggaatccgcggaacatttaactcaatgccacttttaagatgtggtaattaattatttgccactcattgtctatgacatatgggctctcatttgtctatgacatatgggtccagtgataaataatttatcaccactcgtaagagtggcaaatagttaattattctggaatctactgattattacttattgacctataaacaaatttgcgggttggccccatccctaggctaacgtgattgtagtcactcctcacggagagacgtgattgagttgaggtatccctctggctgttaccatatgactctaaatattatggtttaaaaatttacaaatcactagtatttctatgaaatttactttaaaacacgaatggttttcaatttcgtttgccacatatatagggtgtagcgaattttttaagtttaaacaaatttgaataattctaaaccaaattcagaaaaaaaggaaagaaaagataaatcacgggcgaaacagtttcatgccataataatgtgattttttttataataatgtttgttcgtgccataggattatgatcctcactttgcatattgcgaagctatatttatggcgctatatttttcactaaaaaatagttagcatgtatttacattgtaagtacataaattacatattatgcaattagtttatgtacaatacaagtcccaaaaattacatatgtaaatcccaaaattattatatttgagagatgaagtgaataattcaagtcatcaaacaagcataatgaaacatccgacgcctcgagagaggaatattggagacattgctgggcccttagcctgctagtcaacttcaatctgagatgtgcccgtcaaccactcgaaggcggtgaccagatgtgttacacattcaggagacttgacaaaaatggctaaagatctacaacctctcaaatattcctaactcatactcatatgaatctagttccccggatgggcactagatccacactttcatcttaagcatgattatacatagtaaacacaactaacatgaaagaaacttaagacttacaacaacataataattacataggccgaccggccaaatagacttatttagagaacaacggaagcttgactacccaatcacaagcacaccgactaggggtttaccccattaagttctcatcctagaagaagcaatcggaacccgcatcacttaaagactaagactaaacctacaaacaaaaggttatatcaacagcaagagttaggacattaaacaagttaatgtactagcaagcacaagtcaatcctaccatactacatgtaaggcatatattcaaaggaaggcaatatgtagttcaattttagcataaagcaagttttgtttcgcaattcttttgtaaaggagttgatacttcaattaacaaaacaaattttaagtttcaataagttcatcataattccatcataatcaatctcttgttgtcatcctttgacaacaagtcataatatatcacctcacacacacaactcaacacatttatcaatttcaaaccaatgtcacatatgatcacattttaaaacataaagtctatattcatgacacatcaccaaagcgctcatgaccgtgagcacggctaatcgattagttttaaagaactctacagagtttgtacagctttacccacatgatatgaactctctagtttgttttgagtttgcaagactccaccacactcttcatgttgaatgtgatctagaggtcataacgaagactttacactacttagagcctagccttgtaccagcacaatatgtgtttctccatcctagacatacttggaatatacctagaaccgttaagtggcgggcctatgccttaaacttaacgccgtggtggcggacacgacgggaacccaccacatggcacaataccgttgtattggacacgcttagtcacctaaactaccacatcggggtaaataggaagctcctctgaattacacgaactcatacacaccggcctaccagaatggaaggctagtcctaaatcccatactagcacatgtggatgtacgaataactttaaatgggtgacacaagttcggtccttatggacttgggcaaacactccccctatcggtatgcaactaacaccatatgcacaccacttgccgtctaagtataaaatcacattttacacattttagttcgcaaatatccatcatattaattttattccagcaagggttcatgtatcaaaattcatattttaattatagatggaatgagcatttgcatatttctaagcatggctaagcaagtagttgcacatagagcatatataaacccatttgagcgcaaagagtgtactctaaccatttctaagggttcaaacagtaagaggatcaattattcaaggtggggtatgcagcaaataggtcataactaccttaacccaattttaaatatcgacatagtctaagttcacatgcaactttgcaaacaaatattttcattcctcaaatcatgggattcaatgtgttcaaaggatgggaggagaaaacttgccttgatcagagaaatgttagtacctaatccacttcttcaccaattatgtaattatctagataaaggacacgttatgcaattaaacaccgaaagagctaaaaatctaaaatactctaaaatgcatgatttatgcacagtgggttggtactgatctaaaatgaatttaggtgaaagaattactattttatcttattccattagggagttatgaattttagaagttttatcggtttatagtagtatagtcttatgtagtgttataaaatacttttgtaaagtgatttttattatattagacttcacaggggtgtagaggtgtgttttctaagactaatgcatttggtttcacaatttttggagttataatgattttcttatagattttacaagttacaacgtgttttaggcatatagtgttttatatgtgcatgactctcaagttgtagtttcagaacatgctacttcctatttaagttgaataaaaggaataatttggttaactaaaacatttttagttcatatgtttatggtctttactactatggttcatattttataaactagagatgctctaatctaaactagcaatatattatattaacctagaaattggtatatgagctaagttcttctaagttttagtggatggaaatgaaactatatatggcttcactggtcaatcaagtttttatttaggtttaattagacctaaagtgtatatatacttatacatgtttatgtattacttcaacaacactatgtgtttaaattcttatttcactaaattaaggttttgatctatgttctctacaataggtgccaaattttattttactatgttgaagctaactatttgctggttctatagaaactttgttcatttcatttggactaaaaatgaattttctacaagttttacaaattaaaggctgctctatattagcaaatcattatatgaatatttagagacttttactacacagtaagtatataatcttatttcataacatggaaatacatgttttgatgatcctacagaacttaaatttactcaaattgaagctaaattgggttctacatgaatttctaaagtttagcttatctaaactaatcattctagagataatagttttagaggcatttgatgcaaagtaagtaattacttttatttcacctaatcagagagtgcataatgatgaatctgtagaattttattttgtttcaaaatgagttgagatgaattttctacgtattttataagtttgtacatgttttatgtatgacctatcttagataaattttagagacattatttgtacagtgagtgtcaagttttatatttctaaaatagagttcataactttaagaatctacagcaactggaataatctcaaaatgagttacatttgattttatatggattttacaagtttgggtgttttcctgttaaacatttaatgttttagttatttttcctttgcattttcagatttttatacacatgggtccactgatcggtggctgaaccaatatacaaaaaggtccctgggctttatatgaaacgcatttaggtccgtgggtccacatgtaaacgactgaagttttatagtttgaaccctatatttttgatcatttacaggacaaagtcctcatcttcaacctccagcagcccgatggactgggagcttggccatggctttggcgagctcgtcggcgacgattggtggctcgattgggaatgaggtcaaaagataaaatgaagagaatgctctcacgattccattcctctagttttgttggctaggagacatcggagtagcgccgatagtgagggtgagcggaaggtatacatgagctgttactgcatgttgcctaggggctttgattttgctagatgcatccatgcatgtgtttcctaagaggtccaggaggctcaccaagctgtaggaagaaatctccgaagcttggatagcagcggcttcagttggaacggttcgacggcgacgctcctcctcgggtgaacggcgacggctcaaacgggacgacgagctgctaaaggaaggcatgcacgagggttgtgaggtcaaggagatggtgtatgcgcgaggaatcgaacaatggctcaccgaggcagtggtaatcgacgatgacggtggaggcgagttcggatcggcgtcgaggaagaaaaggatgtgttctccgtgttcttgatgtttccggctggggttcttgaggcgtcttgaagaggtggtcgaggcgagattcttggcacagcggcttgcttcgggatggacgagaatggccggacgacaacgatgtctaagcggcggcgctccggtgcgtgctccagggcgtcgttggcgtggtcacgttccggtggctgtgatgcacaaaactggaggtggtcaacagagaagtggtttggtattgtgtggagagatgggaacgcgaaagagatagaggtgaccttgactcaaacggagatggcgatagtcgtcacctccatggccggtggtgaggtcgctagtgacggagaggcggaggacctaattagtatgtaattataatataagtaggatatatattatgatatgtagttagtatgtaattataatacaggtatgatataattatggtgtaactaccatgtcgtcatatagatacatgaaaaaaccgatgctaattaaaaaaggcaagggattaacgataaaaaggtaagctgcaacctcaccagtaacgaaatcaagcatttatcccacggtacattaaacagatccaactattttcagcccaaaaaagatactacacatatacgataatactgcgcccaacagtaggggagaaaaatcagacgctgcatgtgcctgctactgcatgcaaagaccgataatactgataatactaggcgtcaggcgcccgacgggaggggagaaaaatcggacgttgcgtatgtctgtcaactgcatgcaaagactaataatactgggcgtcgggcgcccgacgagagaggagaaaaattggacgctgcgtgtgcctgccactacatacaaagactctctcctcacatgctcccttctcttatttcttcaaaagattttttttctcataaattatttatctaatctacgatctgattgcaccactaaattcgttacaattaaatctttacaacaaaaccacatatgattatattcgacaaaaaaatatttttgcttttttattgatattttttttatgttgcatatggtctcttttgatgtttcaaccagtagttttacgatctttcagctagtgtactcatgatgtttcactatgtacggatcaaatgttgcagtg

SEQ ID NO: 37680 - DNA, 6905 bp, Oryza sativa
tggaaactctctattatgggaatacgttttattttttattccaccaaaaatatttcacctagtgtacttataatgtttcactatgtatagacaaaatgttgcagcaaactaaaatattctttcactatttgctgaaacattatttttatataaggtgaaaccgcgcccgatttaaacgattgaaacatttttgatctactcagtgaaacaattccgatatacttggcggaacatcgtgaaacatttaaaaaaaatccaataataaggtaaattttttttcgtcggaatatatctgtggtcttgttttaaagatttaacaacaaattaatggtgtaatcagatcatgatttgcataataaataatttaagagaaaaaatagtttaaagtggttttgcacgcatgcatcatactaacgtcaacatgacgtgggcgcccgatcctaagttgcgtccaattcatatatgtagctcatctgtattgcaagttgcataatatctgcacctcatcagtttcgtggtacgcttggcatggctgaaatatagaaataaagacaacaaaacaaagtaaagagatcccaaagtacatattaagaaggcatactgttgttaattccacatttaaaaaatttgagcctcttcacctacgtaatagaatggagatatctggactaacttcactttcagtagagcatataccatataataaataaaagctaacagcgttaggaaataacttaaacgtaatgagacggtaagtggtcaaaatatgttacgtgattctatgatcctgaactaagtttgatgtttatctaacaaaatggtcctctcttccttcgtacgattcattagaaacttcagatccaaacttgaagatcagatgtccctgtacaacagaaaaacataactcataagcttgatggatattaggttaaaaaaggaacagatggaatctcaggaatagaccaaataatttactatgccaaatagataacttcagacaaacatcacaaacatgaaacatatatttgttggtgaattggaatatcacttttcctggcatggaagcaccatgtatttagcaggtgctaagattatggagtcttaaatttccttcgaaatttgttaacgttactagtaatactcgagggttcagatgttggaactctaaaaaagatattgtttgaaaatagagtaagtataagcagaacaacatttgtagcctatatgtcagtgaaaacttccaaactggctagtttgggacaggagacaccaaccgccaaaacatagctgtacaattcttaaatatcaactgttaagtatcaattgccattacaactgaaggtagtaaatccaagagtaaattccctgtgtacccctgaaaactcactcaatccctttcatacccaatccctttcatacccctaaaatttacccgatccttctgtacccctgaaatttcaatttcaatttgattccttgtatgcccccactgttacattttccatcatttcattgtgaaatttcaatttcaatttgatttcttgtatgccccccctgttatattttccatcatttcattgttacgtttggttgcaaatgtcatttttacccctgatgctttaggtttaaatataagcttcaaaaacaattgaaaattttatttgagtgcacagtatgtgtattttataaaactaatgagactaaataattagtgcagaaaattttgacataaattttgaaaataaaataaatgtaataaattaaattttttatttgaaattttaataggacaatggatttttttatcgggagcattcataaaaaaaaatgttgtgaacatgggtagtcctatctttatatgaatgctcctcatttttatgacttcttttaaaaaaataaatacgtattttttatttcattatctaaaaatatcttttgggataaataatacatcgcacaacaaactcataactataatagtctcatgcgagaagcttttatatttttaataatgtaattcatgaatttctttgttcatccaagggtaaaatggtcatttttatagaaaatacacggtcaactaacagtcaactgacgggaggggtcaaattttgggggtacacaaggaagtaagcaaaatacaagggtatagaagggattaattaggtaaaattttaagggtatataagggattttctctaaatccaaactagtagtatgaaaaatagaactaggaactagttcaagaatcttgattgtggaaaaaacattttgggatatgcttgacaacaggataccaataaactggaagctattgactttgttcaagagtaacctgcaccatttgcagcatgcaggacgacgcactacaggaaccgttatggatcaggttgcttatcaaattcggtttatatttgcttatttcttgttgaggattattgggatgggagctttattaagagtagcaaaccagcctcttttacaaggatggcttctattcaataaaggacatccggctttgagtactggctctgggaggcgagggatttgacctcgccctctggttgatcatgactacctttgcgcaacatttgtccacccccagcgcacaaggtgaattccatattttcagataaatcttaattcttctagttttgaatgattccattagctttgcataaagaaatgactaaaaaccttccgtaaatgaacgggggagaacaagagtgcatcatatacgcagccaacctccacattgaaacgaaactctaaaggttaactcagtaaaatcctctaaacagttaggcatcaaggaataaaggaactcctaaaaaaggggaacataggaagggagaaaaggttgcatcatgtatgcaagcgcaaataaatgtaggcagcatccacactgaaacaaaactctttaaggtttgaaagctgaaaacttggtaaaatcctctaaaacatttaggcataaaggaagaaaggaacccgtaacaaaggggaaaataggtgtactccatatggaactgaaccatgtttacacctctacttgaacatgactgatggtgagtggcaacaatttctgggcatgtcaaagatattagattccatatattgccacttgttgtgttgtgtttaattcaccagcctcctttctaacatacagttagctgtctgggtgaaatttcaaagttcctgaaataatcctaggaatcaggaactaggaataaattgcttgtactcagttacaaatgtaccaatgggaaaaccagagctgttggctagcatcagcggttcttgagcagcaagatataaacagtgatgaccagataacagaattcatgaaataacattatgtagaatgaagtgcaataatattaaaattgcagggtcacacccctgcagagcatacatgtgtgcagagtcaaaacaaaaattaagacagggagagagacccaaaacactaaatggataaaaaaaagttattgctaccatgcaacacaattattgacgcagccttaggggccaacattccaacaaggtgtgtacaccaatatataagatgtgaaggaccttggtaagtggtaatgtggtactgaacccaagcaattgctgcataaatcacataatatggttccacattattcagtacaacatatgagctagatttaaacttccttatttgatatcaccattggaagtttggaaccaaccatactatgtaagactcaatgttgaaaataaggactagtgaacagcaaacctactactgtgcatgtgacacctatagaccaggagctgggttttacccattacggccatgtgtgccctcaaatgtttcttatttctataataccgaccaaaaagcaatggaagattcagaaaaaataataaaattttgaacaataggcatccatgtttccaaaatttcaaattattgcgaaggaaaaggtatagatgagacactttaagttagactcaatgttcaagagtcagaattgtgagcatacagcaagcctacttcacctatcacactattgatcaattcaaaactaaataaatctatcagaggcatacatttaccaccttcgtttcagcataacgatagcgcatttgtcaatccacaaaatcgaattaaatctacaatgaagagcgcaatgtctcaagccaaacttgaagtaatgagattaagaaaagaaaaagaatacccttttcacctgtagtcgaaggatggaattggagggctgggcgtctcgaaggactccaacacgtccgacttgcggtcaccaccagcagcagcaggcttctcctccttcctcccgaaaattcccctaacccatgcgatagggctcgattcatgggccgagacctcctcaggcggcggcaccaccgggaacgggtaggcgtggtcctcctggggaagggtggccatggtgcgggtgagcaagatgccggcgccctcgacgagcgcgaggagggaggcgccgacgagggcggacgtcgcggtggcgcgcgggccctggcgcagggagaggacggcgccggtggcggcgccggcgaggatggagttccaggggtcctccttctggcgggcgtggaccatggcgcagtcgaaggcggagaagaggccgccccaggcggcgaagttgccgccggtgcgcgggacgctcatgcggacggcctgggagccgccggagaggcggtggccgttgggggagttgtacgcgcccctgaggaagtggaaggcggtgccccccaccgcccccatcgcgaacgcgccgcccacgtcgtccaggatgcggtccgggcacggctccctctccgacgtcgtcatcctccccactcccgctcgatcggtctacggcggcgacggcggcggcggtcggcggcggcggaggcgaaacctaggagaggaggggagagttggcttggatgagaagttgatgggcaaagctaaagcttatggtttatcggttcattgatcacagcgtgcggggctttcgcttctcctcgcgcctgtgatgggccagggcccaccaaagagtaggggttcgaaatattttactctttccatgaacgcttttcctgggggccagcttgacgtgggacccactccatgctaacgtgggcagggcagccacgtataggatgctaatccaacgaaggttagcaagttggatgggccgcgcaatttgcgcggctagcacctaaacaaaatcatatatttttttaagtatgattttacttaaaatttattaagtatctcattgtcttaagagtttaaaagaccaaaccttattatccccgtgtttctaattttatactccctccgttttttaatagatgacgccgttgactttttctcatatgtttgaccattcgtcttattcaaaaaaattacgtaattataatttattttgttatgagttgttttatcactcatagtactttaagtgtgatttatatcttatacatttgcataaaatatttgaataagatgaatggtcaaacatgtgagaaaaagttaacatcgtcatctattaaaaaacggagggagtgttttttaaaagtcacaccagttactatcccttatgtcatctccttctttatttgcttgctcgatctaccactatttctattcattcgccttgtaacctttaaaaattggatattatagtttttagagtttattgtcacgttgggtttcgtttttataatttctagacgtcccgtcaaacgttgccattatactcctctatagcccgtccattgtctcttctctttattgtcattgagattttaaaaatcgaacataattatcgtgttcatttttactttctagaagtcccgccaaaccgttagtggcttaatttgccattgtacttctctacggctcgcctgctgcctcccttctttattgtcattgagattttaaaatcgaacatgattatcgttcttttttttactttttagaagttccaaacctttaaaaattgaaccttgtagtttttagagtttgttgtcttgttgggtttcattttttataatttttagaagtctcgtcaaacgattctactatgttcctttatggcccgtccgccgcctactctttattgtcattgtgattctaaaaatcgaacataaatatcatcggaattcattttttattttctaaaagtcccgtcaaccgttggtggctctgcaactatacgcctatacaccctgcccgctgcttctcttttttattgtcattgagattttaatcgaatatgattatcaatggttttttttactttctagatgtcccggcaatcacctcatttgcttcacggtctgcctgtcgtccatccttttaatcgtcattaggattctatttggtgttttattaatagtttttatatgtcgtatcaaccgccaccactctactcatttataggcttgttacttaatttatctcatcatatgtttatggtcttttttttccatagtcttttttttatcacaaattttaattatttataaattgtattcctaaatgaaatcttatttttctttttctaatttcagtttttttttcaaattttaattaatatcctattgttcttttaatatttttattttttattttcaatttcagttgtttcaaaattgtattcctactcgaactcacttttaatttttataattttggatattattttattttttattctgaattttaattaatctcatattgggttcttatatgaattcttctttaaatattgcttatttttaattccgaatttcagctaaatttatattgtattcctacttgaactctccttttatttttttttgctaattttggattttatttttatttttattccctattttaattaatgtcgtattaggttcttata

SEQ ID NO: 37681 - DNA, 6925 bp, Oryza sativa
  unsure (1)..(6925): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagcaaccaagcccaactagaaaaaaaggagtcgtttatacaaacttctactttatacgaatggaaattagttaggttaagtagtgaactcaccagttcctgatagacgacggcatcacttttgttctcaaatgtgacagagccgtccgggttgaccttaccccttgcccgcgcccagttgcgagctctttgtttagggatgtctgaaaacggagcagggacattcgctgctgcagcggctgcatcttcttgggcccatattgcctccttgccgatgtaccctacggtgcccagccgatgtgggtgctcattccgctgttgcagtaggcgatgtgcctcgcttgattccctaaactcttgggtgttcttgagagagcagaattcctcccacaccgtctcggttatttgagggtattcatcgaacggcgtatgattgccgggcgggttgacaaactcggtgaagagcttcgacttccgattcttccaagctttacccatcttctggaatgccttccgcttgagcctatcctttgcttcagccggaaatgtgaaccatttctccattgccgtccaagctcgctctttctcggcttctgtgaccttgccgatatctttatggaggatcccgaagttctcacgtgccgccagcccgcagcagttagaccatcttccaatgacagtcctgggcgccgtgggcctaccactagcgtcaacttctcttataacttgcactatggtcggccatatattttgtgaccggggatttctactcgacctacttgcacttgtcccgcccgacatcgatgtatgttgttcctgcggcaattctgcagcacaaacaaaagggaacatttgctaaggggtgctagctaaaatttagtggtcatgtggtgaaaatttgtcctattaattaccatgaatttcgggttgttcgaccgccgttgtcgagggatgaccttaggcaagtgtctccgtggctgggtttgcttcttcctggatcctcgcaggtgttggggagggtggatttgcgccgggcgttgtcatggtctaattttcgcgaaaaagcttataaatttcctaccattatactaaatagcattaaatccaatgtaatacggggtatactatgaaagatatggcctcagttttgctcagaaatatgcatcaattaccatcatttgcatgaagggaaaaaaagaggaaatcacaacatcaaaatctgttcttatgcataaaaaaaagaacaagtgtatatagtctcctcttatcaaactagaaaaaagaacaagtgcagaaaatatgttcttatgcataaaaaaagaacgtagatactctgttcttatccataaagaacaagtgtagaggtatataaccactgaatcaatcatgcaaatttaaaaaacagcagcagcaagggtacagatagaatgttattgacataaaacagcagcagcaggagtatatatgccacaggggcagcaacagcagggggaaattcacataaaacagcagggtgaacaagtagccacagtaagaccaatagcagggcaaagatagtccacaggggcagcaacaacaggggcaaattaactaaaacaacatgtctagatagtctcctcttatcaatccagaaaaaagaagaatagataaaaaaaagaacaagtgtagataatctgttcttattgagcaattcatcactggccatttaacaaggaacacattgggcagcagcagcaggggcaaagatagtccacaggggcagcaacaacaggggcaaattaactaaaacaacatgtctagatagtctcctcatatcaatccagaaaaaagaacaagtatagataaaaaaaatgaacaagtatagataatctgttcttattgagcaattcatcactggccatttaacaaggaacacagcagcagcagtagcaattgtagattaaaaaaaatgaacaagtagcactaaatcatgtatataaatcatgtatgtggcaacagcagcaagggtatataagtcatgtgtataaacaacaattcatgcaattcacctattcatagacaacaagggtatataaatcaacaagtgtagataatctgcggccaatctatcaattctttcatttgaactaaatttcaaaccctaaacctaataaagttccttaattatcaaaaaatgacagaaaacaaaatgcatggagaattttggtgtctaggtcggttccgtccatggactacactgaccaatccaccaaaattccccatgcattttgtattatgtgatggtttgataacctcggaactacattaaatctgcggccaatcaattaattcttccatttgaactaaatttcaaaccctgtatatgctttatttataggaaaagggaacataacccctaactagctagctagacaaactatttctagctagctaccctacctagctagaaacactgttgccaatctatcaatccatcctttttcagctaaatgtaaacattatccccaaaattcaatagttctagcaaaagggaacaaaacaacatataaagcagtatacactccatgaatggttacatgtcaaaatggcacttaaatccacattcaagtttcaaactagctacacattcaagttttaaataacagttgcaacaatctgaacagaatgataaaaaaagagcacaattatacatatgcattttcaattcacatagaaaagagcacaattatacatatgcattttcaattcaaaaagagcacaattatccccaaaattcatcgttcatccaaagttcatcattcattcatccattccattgcatcatttattcatccatccactgcaccattccattcatccgtatcagagagagaggggtacctggagaggagacgacgagcagaggaggcggcgcacggcggcgatgacgagtcccggccggcgcacgacgcacggcttctcggcacggcggcgcggcggcggcttcttggcacggcggcactgaggaggagaagagggggttaatcggcgaacaatagtaaataaggggaggcggggggagtgggctcactgtggaggtcccggtcgagagaaggaggcggcggagaggagatcccggtggcggcgacgacggtcctggcgtggagactgagaggaggtcccggcggccgtcgagagagttagtgaggcggcagcggtggagagggcagcagcgaggagggcggtggagaggtcgaggcggcggtggagagggcggcgtaaagggcggagatggcgacagagagggcggtggagatggcggcggagaggtcgaggcggcgacggtggagatggcggtggagatggacggcggcggtcgagagagtgagtgagacggcgccggtggagagggcggtggagaggtcgaggcggcggtggagagggcggcgtatagggcggagatggaggcagagagggcggcggagatggcggagagggcggcggatttggcggcggctagggcggtggtggagaggtcaaggcggcggtggagaggagggcgtagagggcggcggagaggtcgagagaggcgagtcggcggtcgagacagtgagtgagtgagagtgggtgccggatctggattgatctagaagatgtccaaccctaggtcaaccctagtcaaactcacatgtgacgggcgccaactatggggccgtcacaggtggcctcacctgtgacgggcgccaactgtggagccgtcacaggtgaggctacctgtgacaggcccaacactctgggccgtcacagatgatgtcacctgtgacggccccacagttagaacccgtcacaggtgagtttgcctacagcaattttattttattttatttcacttagttcttttatttttcttaacatatttccacatacactatatatttttgttatacttaattattttatttcactaacagtagtaattgcacttcattattttactaattgtattattttatttcaatggttatactaatttaattattttatttcacttctagtgggtgcttcacttaattattttatttgactatttcattagcaatatactattgatcattgcgaacatattagagtcatacagataacagacatgtagacataaactacgtacataaattacaaaaataatccttcctcatggtcgacgcgtgcatattgaacgtcatcttcttcttcctcctcttctagaggtatttcttgacctatgccatggacgtgctggttgtaatcatcctcgtctgcaatattgtccaatccaacaattctccttttcccttcacgaacaacatgtagtttcttgttacacgggtcaactatgtagaacacttgaacaacttatttggcgagaacgaacggttcatccttgtacgcgttgttagccaagttgacagtggtgaaaccttcattgtcaacttttacattgcgaacatcgacccatcaacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctatgacaaccactaaagtgtttcactagacaagttctgcaacctggcaattcggttcttcagccactcattgaaagaagacatgtgcttatttctgacccaactctcttatcggcctgggttctcctgtcggagaactgtaaggtgttcgtcaacgtaccacaccacatcagtcatatgctgcagtaccgtgaaatgagctttatcgtacaccttccgatccaacctaacagtctttcttccaacagtaccaacaccatcaagcctcccttcgtgatgagatcgtggtaatccaattgaagaagtttctgacctatagtccacacaaaaatcgatgacctcttcggtggtgtaactctcgatgatactcccctcggggtgtgaacggttccgtacataacccttaaggatccccaggtacctttcgcaaggatacatctgcgtcataaatgctggaccacagcactttgtttgcctcacaaggtgcacgggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttagtgcaacgggcaacagctgtctgataagaacgtggcaatcatgcgacttcattcctaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagttccgagcgaacacccatttcttccagatctcgtcgggcgttgagaccatcctttttagtacctgggttaagcagtaatcccattaaactctcgcatacattcttctcgacatgcatcaaatctatgtagtggcgaacttcaagatccttccagtatggtagtctccaaaatattgacttctttttccacatgctcctctcttttgtcttttgtttttccacatgctcctctattttttccttcgacgtgctcttctcttttgtctttccaactttcctttttttttccaaactcgttggttattcccatcaccaagttgtgcacctctgtccctgttagctctgccgagggtccggctgtatctctgtgtccattgaaattctttttcatattcctatacgggtgataccttgggagaaatctcctgtgacccatgtagaccgtcttgtgtgaatgcttcaaccatttgcttcttgtttccttcatacactccgaacatgtccatttccctttcacagtttgccagaaaggttgccaagggccggataatcgttgatggtacaaaacaacatcgcatggaggttgaaatactcttgtgcatatgcgtcccatgtccgtgtgccctcattccatagcctttcaaagtcatcgattatcggttcaaggaacacatcgatatcgttgccaggttgtctcggtccttgaatgagcatggcaagcataatatactttcttttgaagcacaaccagggaggaaggttatagttaacaagcagaactggccatatactgtgacgactgctcaaatcaccaaatggattaatgccgtccatacacattgcgaaacgcatgtttcttgggtcatttgaaaattcctggtaaatcctatcgattgtcctccactgtactgaatctgctgggtgcgtcagcatactatcgactttccgttcttcggcatgccagcacactagcttagcttgttccttattcgcaaacattctcttcatgcgctccgcaattgggagataccacaccacctttgttgggcctcccctctttgacttacttccttcaccttcactctttgctcgtttgtatcttgatgccccaca

SEQ ID NO: 37682 - DNA, 1996 bp, Oryza sativa
ttatccgcaaatgtgacaaattcagttaccccctctctatactcggtagacgaatgatgcgcatagtacatccatctacgatccatctgaaatcaacaacatacgaagaaaaatatatgatgatcgatatactgagaaggaatggagaataatgtgttttttaccttgaattttagaaaaaaaaatcaccccccttgccctcccaaccgatttgtgaacagtgaaccgatcgggatggaaagcagttggcggtttggggggtatttatagacccaacacacctcaaacgggttagattaaaaaagcccgtcaaaggtgttggtcatacctttgatgggcttcaattgagttgcccgtcaaaggtattgacctacctgtgacggttatctgtgaccaattcataggcccgtcactggtatgccgtcacagatgtagggttctggcatagtgggcggtgaggaggactggattgtggcgttcgacctcgagccccgacctcgtcggtggcccgccggtgacgacgacgaccagagacgcgcgcctctacgtcaccctggccgcacttaggggctccttggtggtggcacaggacgacggggagagcgcggaagcggtggtggtgctcgacgacgggagggtcgtcttctgggtgtgggacaccacgttttcacacgccgatgccggcggcgtcatgctggtgtacgacccggccaccggcggccaaacggaggtggcggctatggcgggtgccgtccatgtcggcgtgtacacgggaagcctgatgcgtctgcgcaactagtgacttccccgtcttaagggtgtttttatttatggcagtagctacatttaaatcatgccattaatcttagtttgtatgcgtagtattttatagacctttagttaaagttaatcactgagagcaggtacaatagcagactattagccagctacaaacatattttaatgagataaaagatgagagagaagagcagcggactacagatctgtagccagctgcagcacgaactccaagacgtaatgtgtgtatgacagatgagaccatatactaatagtataataagcaattattgtatgaattggctattagattggctatagataaattggagctaacagtgggctatactattaaacttgctctctattttcctactgtggccccttttacttttcagttatatatatatgtcgttaatttcattgctcaccgtgtccaatggaaagcgtcgcctagaacaaacatgctgaacctggataggtttctagtagtagacatgcatgcagccgatttgtttcaagattacagccttgctattggcctaatttcgatttcatattagaaaagatccttaattcaattgtaagacacaaccttttttttttggttttacacaaggaaaaaaaagacatacgtgaacaaagaaagaacatacaccgtcccatccacagggcaaaaaagttgatctgataaacagacacgcctacgaatgtcagcatgtgcatacaatcgactgcagttatcatatatcatatactccctccgtttcccttcgtttcaaaatatttgacaccgttcactttttagtacgtgtttgaccattcgtcttattcaaaaaatttaagtaattatttatttttttcatatcatttgattcattgttaaatatactttcatgtacacatatagttttacatatttcataaatttttttaataacgcaaacggtcaaatatgtgctaaaaaatgaacagtgtcaaacattttgaaacggagggagtatcatagtaccgttctatttgtcatgctcactatctggtgcaggcatgcatcaatttgcgagtttccagaatttcatggtcactataggagattaagtaatgaaaaaaaaaaccatggttttatgaaccgaaaacatttttttggaaccgatatcattatgatccgtctttgaaagaaagccaacacggggacagg

SEQ ID NO: 37683 - DNA, 18658 bp, Oryza sativa
caataattaaaagcagcatactgtggattccagttttaggtagaaaataccatggaacaacccacaggtccaaaaactattcactagctgcataactgaaccatctgcagaaccaagaaaaataacaccccagtagcttgcacgacagtagcctgtccaagagtgttatagttttcaggagcggcctcaaattctccagtatgcaatcacaccagtcctgacatcggttttgctcctcttcttttggcacttcttccatttctgcaggaagaaaattattttgtacaacgcattcaggagagatttggcaattaacttcattgaacacaaaaacataaccacaataaccagcaaacagtttgctaaaatagtaggccgaaaattactatggttcttattccatttcaaatgcaaaatttactatgaaaaaaacttgatagaactattatgcacctttatattcaaatgcaaatccacacaaaaggccctcccattattttttttatcaacatgtcgagaagatatgtgctcattcaaattaaaaagaccctccttaaacaccaagtttagcaagaattgccaattgccagcaatgcaaaattaccaatttacaatacatctaaattaatagagtatatgattttaagtgtttgagtaacgattgaagtccttatattcctgaaacaaataatcaaactatataggcccatttcctaatttcagttggatatcatcttatttcgatgagcatatggaagcttttagcataaaagatacaagtagaagatgaatttgcaatgaaatttgtagaactgcatttgtgacagataagtaaatgacaaaatgatgctgtttatcaaatcacggcatgaataccaattatgtgatgatacgaaaccaaactttaccttgtcacatactctgtggacataattgatttccagtatatacacctactccagtaaagatactagcctttgtctgaactatctctgaggaagtgttggttactggattataaatccagaccatcccttttgatcctatctgcacccaaagtaccacatttccctcatccgtcacaagcaaaggttgcacaccatctccaaaaccatcaaaagcaaattcaacatttatcctatattctttggaccacataccattctcaaaatcaactagaaaccataagtccaccgcagaaatttgatcattgaaatgtgctgtacacaaagttccttcaagttgggctaacataagacgatcggtaaggtcagcatagttgagtgtgccattcgcttcctcaagaattctgtttactggcccttggagagccgtgctccactgctccgtcgcaaggtcgaaggaaggtatgcagcccgtagcaaaatagtaggagggatccatttgccagtgatccaagaagaagtaagcagccccttcgaagacaactccattggtgcagctcggatcaagataccccggtggactctccatcttcctccaccgtccattcatgtcgccgattgcgaaaacctcacacactggatcagcctcatatccatcctccaagtcctctagaatccggagtagtttgtactctcctgtggaattcgtctgaccaaatgcaaaccaggctggcctcatcccgttgcgacgcaccatatcctctgcaatgccgaagggcaaggcggagacggatcctgtggcggggtcgagcacgctgacgcggtggtgctccccggcgacgaggacacggtcgtagctcgccgtcagcaccctgcactcgccgcccacgccgaggatctcctcgacgacgttgccggacaggtccacgagatcaacgcagcatcgactggggaagctgtcaaccaagacggcgaggagcgggtgagggtggacggcggcgtaggcggcgaggaagagccggtccgtggtgaaggacagccacgagcggcagacggcgcggaggcggcagatcggcttggcggggaggcgcagcaggacctcgagcagcagctccgggggcaggacgccgtccacggctccgaacccgcttcccggtgcggcggcggcggcgcacggctctggggacgccatcgcggacgcctggattgggggtcaaaaccggatgaaaacttgaaccaatcagtgcgagaagaaggacgagttctctgccatcaaggagaagggtttacctcgagcggagcgcggtggccagccggagtccagcacggcggcggcggcggcggcggtggcgccgtctctcgtctctcgccgggatgtgtctgagaagagaaatcggacattctgacacttccaagagtgggtttcggcgtaatgccattccacgaaatggagtcgttaaaatgccactttaaaccaataccaaaccgctgctttgccatattcaccatttcacaggattttcatcatttttcacacttcgccttcccaaaatacccctccgagtgactgtcgccgtccgggtgctcgccgccgcctgcctccttttgcgtcgacgcaagggtcggtaacctcactgcccccgctctagaaaaatccgatggcgaagaccccgcaggagctcctagcccaacggccgccgacgaggaggaggagagcgacggcagccgacaaggaggaggagagcggcgcgacgggagatagccacgcagcgtgacagccttgccactgccgtgcccctgtcgacgctactcgcggccaccggcaaggagaggagagcggcggcgctggagctcctagatacgccgcgtctgggatgatgaattctggctgcggcctgtctacggatggaaggatcacgagggagtccggcgctggaagcttcggtatggtcacaagcggcgtggaggcggcggcggtggcaggtttgtctatgctggtaacgaccgatccgttccgtgagacaggtgtgtcgtcgtcgccgcagctgagaagcgctccgttcttgctggaggcggcgtcctgtgtcggcgccggcgccggtgcggtcgccctgcgcactctcgccgcgtcaccaccggagccgtaacggccgacgggcaggatggtgcccctccgcttcaagacctgcaaacacagcgcacgcacgcgcaagcacacacatcggtttcaaacgaactcagcaaagcaaatcaaagcggaaaaacacttgagcatgacgatctcgatgctccaacctaccttgccgacgccgtcaccacgacgcgagcgggaaggctgccacgcgcccgaagaaccttgtcgtcgtcacccacccgctccacgcccgcatcgttctccccattatctgcgcagcgcaccacggccgcatcccgacgccgacgtcggaatgactcaaccaactcagtttggtataaccgacttaagggcattttggtcagaccgggtgcaaaattaggtggaaatggtaataattggcccaaatggcaaaacaaatatttggcatctcttgtgggtggcattttaaccactccattccgtgaaatggcattgtggcgaaacccactcttggcagtggcagaatgtccgatttctcgtctgagaacgaagcctggaaggagatatcctgggccggaggccactactgacaagccgagcccatttaagcccacataatgaaaatcccagcccatatatcttgtgcgtttgggcccagcccataaaagcccatataaacgtagcacgaagccacgaacacgaagcaatccatccccactccccgatccccatcccctccgggctccggcggcgccgtctccgatcgccctcgactgagccggcggagaggctcgaggggagggaccccaccgggggaatccagctcggttcgacctgtcggcggcgggagcggccgccgtccacccatcgcagccggctcgacctggtgagctctaaccctatgtttcttggtcgcaggaaattttgtctggtaatgatgttctactgcgtattatacatcgatgtaatcatctagcgaatgcatgaccgtgttgtgactttagattctactgtgctttagtgtctttgtactattagagtagcagtataaattgcaaaattgatagttttccgatcatgaacttttagataaatagcttcttgttattaatggcaaacgatcaaagttacatcggctgtgtggcattggcataagatcgatctttcaacggtctcaaacaaaaccaacagaaaaaatgattttacttactacttactgtagtatattacagttcgagttggccgtacaaacatgatctcctctcctgatgctaaatagtactgaatgcttgtaggcttcagaagttcagatatggacacagggcgttcttcccagttgaccgagcgagtacggcgtatgcctgcttcctccaactctggcattctccccctggaggtgctgttcgacgtcctggtgcggctcccggccaaggagctctgccgcctccgcatcgtctgccggccctggcggtcgctgacatctgatccccttttcatgaagacacacgtggctcaccaccgagagacgttcttcttggccagctttaaggatgacgagacgcacatccatatcatggattttgcaggcaatgtgattaagcagataggcataccagctggccacaaggtgttatgcacacgcctcgatctggtttgtgtagccacaaataagaacagctgccatgttcttaatcctgtcactggagatgtctacaacttgccaaagagtccagcagaggagcacacgtaccatgtcaatctgcgcaagcctttcacctcatttgcatttgggcatgttgcctcaacaggagagtacaaggtgctccggatgttcaaccgtcctggatttacggaccttgggataccacagctttgtgaggtcatcaccgtcaagggtggcacaggccaggcacgttggaggggaaaacagagccgtgagttctttgttgaatgtcaaaaggcaaacagcggtgtcgtggttaatggggtggtgtatttcttgatagacagtgtatatgattcaatgataattggtggtgatggtgccggcattcatccagacttcatctgttcttttgaccttgaggtggaggaatggagggaagatatccagggaccaattagcaggaactttgtatatgacatggacttcccagatgagtatatagcaatttgggatcagcttagtttggctgagctgaaaggctacttagttctagtataccaccagagttaccgatcctcgaccatagacctgtggtatttaatagactatgagacccgcacctggattaaacaatatagcattcaaattgaatcattcgttcctgttagggagtgcaaggtaaagccactgctggtattggatgatgggaggatagtcgtatggctaggatcgaccggactgctactcatatatgatccaagaaccagcacttttgcagaagtggagatgagacgtctttctgaagttggtctgtacacaggaagcgtactgagtttataaaatggtgatgtggtgtagtattgtactccataatgttttgctactctcttcaaatgccagttaatcagcttttagaaatgatctttgggcacaatcattaatatacttggtcggatccttgtgtcttgttgtattggggcctgtaagatcattgtaaattcttgaagatgctatatctctctctcattttgtactgtcttgtgtaaatatagtgttaggtgtgtacttgtcagcatatgtcatctgacattatttagagttgctgcaactttgtatcatagctgctagccagttggttggatacttgggttatgtgtaaaaggatgtggcctgaaaatatttctatattctctgagctcttttcatatgccccattcaggtcaaaatgctcttcctttgttgcatgaaatcactccagtcattaattcagtaaggatggggcatgctcataagcattgcatggtgaatcagaaatgctcttttgaaatcgaattgtcgtgtggaaccctcagaaaaaaaatgtcgtgtggaagtctcgagtctgtagggcctgcttatgtactttatgttgcaccatcttgattgcagctgttaaacttgtaatcctaccattgggtttgtcgttgcagctgcctcgtctgccatgtttaccccaagataaaatccaagtatttcacacgatcatctctatacaatcttaaagaaaaaacaataataatagatgtgagtccgccatcaccattagtctgacaagtgggaccacagataattcacctgtcctctcccaaccctcttcctatggccccaactttgttaaccaatctgtctatacatatgagcaaggaggtggttaaaagcaaagcaatggaacaataagggatcatgagcaaaatccactccatcgtctcctccgtggacccgagtactatgtcgacaaggactggctcgagctttatctggccgggcgacggtgggcaagggacgacgtcagcgtccgtggtgacttggggattgtgatagcgtattgtgaatagggatttggggactatcagtgctctgcatttggggaactgtgattagggatttaggggactgtgattagggatttggatccagattttctctttttttttggctcccaaaaatatgttcactggcgggtcttcttagcatccgcggagaaaatcgttttttcactggcggcccgccagtgaaaatctatttttgctggcggtgcaaaaaccagttttagccgacaggaaagacttgttttgtagtagccccttccttctcgccgctgccctcttcccaatccctcgtccaccacactacatctctgttgaacccggcgtggagaccacatcgacgatggcggcttccatggcatcacccttttctacccccactgtcgcgtccactgctgctataccaacactcaccagcgacccatgcaacaaaggaagcccagcaccaagtatccggctcgtgaccgcgttgtgttaggggagtacttaagtaagtaggtgtgtgatggataggggtatcaaggttgtataacctgaatacagctctatcttcttccccaaacaagttcatctgcctacccccagctttttcttcttcctcaaatcttttctctcttcccaatccccttgtctagatcgggaacgtaacatctggtatcaaagcacacgatcgacctagagacctacgacaagccgtagtaccattcgcgagctcaactcaaggctaccaagatggatcaacatattgctgatctgagcaagacactggccgagatccatgcctagaacaatgcgatctagacaaagatggagtcgctagacgagatcaagaagccggtggtcaacaaggcgatgaatgaactacacgacgaggatggggatcttcatagtactaagataagatgtggtatattcagtattagattgacttttattatatggcagaggaagtattatacttcatccattttttaagtatgacgtcgttgattttttttagatactttgattattcgtcttattaaaaatatatttattttattatgatttgatttatcatcaaatatttttggaaaaagtatgaattaccccctgaactattatggttgaccgaattacccccatgaacctgaaaaccagacattgctcatcctgaacttttaatattagacgaattacccctccccccgacactattctaagcgattttggcttgtgcttgcacacgtggcgctaacgtggcaatccaatcagcaaaaatactccttgagcccacttgtcatatctcttccctctctctcctaagcgtcctctctctctcgaacaggcggctgcggacgggctcgggcacgcggctgtggacgggcggtggcggcgtcacgtggggacgcgcggtggatggtggcgcgggggaggcgtcagcggcgagcggcgccctctcgagctcggcgtcaacgtcgacaaggcttgtgtaggggacggcagcagagcgcgggaggacgcggcggcaacaccctctcgagctccgcgtcaacggcgccgtgtccacccccaatgactgcggctgcgtttgcaccacggcgtgagcatcaacgactccaagtcgtcgaactccatcccctcgaacgggtcgacaccgtcgtagatgccggcccgcgctactgccgccgccgatcccgccgagccgttcctggtgaggtcagcctcctccccctcctcctcgctcacccagccgcgcccgcagccggcgtcgcttgcccagccgctgctgccgccgcagccgcctccgctcgccgagccacccccacagccgccgccgctcacccaatcgcccccgcagctgccgccgctcgcccagccacgctcgccgctggcgccgctcgcccagtcgcctccgctcgccgccgagccatgccctcagcggccgccgcagccgcctccgctcgccaagccatgctctcagccgccgccgcgccctgccttgctcgccgagaaggcgagaacaccctagagggagggagagagaggggaagaggagaaagaagatgggagagagtatagatgactggtggggcccaccgttaaaaaaaagaaaatgctgactggagtgccacgcgtacgccacgttgaacaaaaccgccctggattgggtcgaggggggtaattcgtccggcattgaaagtttagggtgaacgatgtctggttttcgggtttaggggttaattcagtcgactgcgatagtttagggggtaattcgtatattttccaatgttttttaagcatgatttaaatattttatatttacacaaaaatttgagtaaggtgaatggttaaatgttaataataaagtcaatggcgttatacattagaaagcggtgaaaatatttgttttaaggttttcacatttttaggttggttacaaaacagtacacgaacatggtcgctgccaatttgttgatttgaggctgatagcctcaggccctaagttctccaaaacttttcccaaaaatatcacatcaaatctttgaacatatatatggagcattaaatatagatgaaaaaactaattgcacagtttacacgtaaatcacgagacgaatcttttgaacctaattaggccatgattagccataagtgctacagtaacccacatgtactaacgacggctaaattaggctcaaaagattcgtgtcgtggtttctaggcgagttatgaaattaatttttttcattcgtgtccgaaaatctcttccgatatccgatcaaacgtccgatgtgacacccaaaaattttcatttcaccagctaaggccttgtttagttaccgaatttttttcccaaaaacgtcacatcaaatctttggacacatgcatggagtattaaatatagataaaataaaaaaaactaattgcacaatttgcatggaaatcacgagacgaatcttttgagcttaattagtccataattagccataagtgctacagtaacccacatgtgctaatgacgaattaattaggcttaataaattcgtctcgctgtttccaggcgagtcatgaaattagtattttaattcgtgtccgaaaacctcttccgacatccggtcaaacatccgatgtaacacccaatttttttttcgcaaactgaaaaaaaggcctaaacaggccctcaaatgaatcaacgagaaggcgagaaggcaacgtgcattcaagaatagtagtgtgaaggcaacgcgagtgttttacccctatgctgttaagaaattaagaaagttgctgcttacctgtgtgccataaaaaaatttggagttacttgtatgccatgagcccaactttcgttgacccgtgtgccattttggatggatggagacataatagatgtgttaggggctgtgtaaagacagctttggccttgtatacaataatgggtttaaaaaaatcaaaaaagtgaaaaataatttagaaaaggcgttaaaaatcaaaaaatggaaaataatttttttaaaaggtaaaaatcagaaaaagtgagaataaattttaaaattttttaaaaatccaggaaaaattaggaaaatgtgggaaaaattaggaaaatgtgggaaaaaaatagaaaatggtggaaaaaaaggaaaaatcagaaataaaatttaaaaaaaggaaaaaacaggtgcatgaacattacatactgacaaataacgacatatcacatagacaaaacaaatgcataaccattgcaccatagcaacaagtgcatatcaaaccatacaagtgcatatcaaaccatacatgaccgttcatccatagtaacaagttcatatcaaactaacaagtttatagcaacaagttcactagttttcatcacactaagtccacacataaaaagtactagttcactagttttcatcacaccaaaccatatatgtcttaaattacatcaaaagtagtagttcctccacataatttattcaagctgaagtttcttcttgcttctagtattagaagctaggctggatgggttggccactttaattggagccctccttggtgtacacttcttgacggcttacttcttccttagtgtgtccactgtctgtggagagacttcataggatgcaatgtcaatatacaagcattcatcatcaacacccacatgctcattggatgggtttgggttagcaagggattcactatctgcagatttagtatgctttagttcaactgattgcccactcccactcccaatttcccactatgaaatgtcaggaggctcactgtccaatccggcgtccatcctacagatgaacaatcccccactgtgaaatgtcagtgatgaatggacatgaaagaatagaggttttacttcgctgcttccacgggctgcttggaggcgaggtgggcacgggaggcgacctggaggcagggtgcgccggcctaaaggcgaggtcacaggagctcgctggccagggcgcgcggcgacctggagccgcactggagccggcttggaggcaggggggcgacgggccgacggggcgagggcgcagggccgcgccagcctgggcgcggcgcggcgacggggcgcgctggcctggacgcgccgcgacggggcgtgccggcctggggcgacggggcgacgggccgacggggcgccgacgaggctaggcggcggcggggtcggcggcgacggctccggcgaggccaggcggcggcgtctagggttagggtgcggctggcgtgcggcaaaaatagggagagagcaggagaggagagagtgagagtatagagctgaaaatagagcagaggcaaattagtcattttgatacatgggttccacatgtcagagatatggaaccgttaagttctaacaaaagttggacggaatagcacatgggtcaacgaaagttaggctcatagtatataggtgactccaaactttgctgtggcacacgggtaagcagtgactttcttaatgccacagggtaaaagacttaggcaacgcgtccgtccggctcccctccccgaggaatctccatttccattctccactccccgccatgggcatcaccaccagagctcgagggaagaggaggaaactgcagggacaccagaccccgccgccgccgccgccgtgcggcgccgcccagatcagcctcctccccgacgacgccctccgcgagatcgtcacccgcctcccatccaacgacgccgctcgcacgcagctgctctcctcccggtggcgccacctctggcgctccgctccgctcaacctcgacctgcgcgacgccggcgacatctcccgcgtcctcgccacccaccctggccccgcccgccgcttcgccgtcccggacctcggctcgtctttccccaacagacgcgccaccttggacgcctggttcgccgcccccgccctcgacaacctccaggagctcgagctcatgggatcctatcgccctctcccgccgtccgccgcccgtctcttccccacccttcgcgtcgccgtcttctcccggtgctccttccccgacgatcccgccgccgccgcattttgtttcccccgcctcgagcagctaaccctcgagtacgtcgccgtctcggaggccaccctgcacggcgtgctcgccgggtgcgccgctctggattgcttgctgttgcgcggcgtgcgcggctgcaggcgtctgtcgatcagctcgcccacgattcgagtcgtcggtgtttgtgtcactcgcgcgttgaaggaactgatcgttgaagacgcgcctcgtcttgaaagattgttgatgcctgaagtctggcaactcctgcgggtctcggtaatttcagcacccaaactggaggcattgggatggctttccaatcactgcacacttgagattggcaccattgcaattaaggtatatgtctgcaaccttatttcttcacacattcagtagacttacaagtacctttggggagtttcagtagacttaccatgctcctgtgttcagtgctccattggggaatttcactttgatagcttgacaacggtggcacgcggtgtgaaggtgttagctctcgatattgataatcttagtctggatatggctattgacttcatgagatgctttccctccttggagaagttgtatatcagggtaattagtcttcatcttgtggactctctagttcacttattttacgttcctttttaatgatatccaaggatgagcctcgttttcgtcttgcagaaatttagtcacaagtgcaacaatgtatggcgccaaaagatgcgccataagatgctagatcctattgagtgccttgacctcaatctgaagaaagtagaagtgtcaggatattgcggcaataagtcccatattgactttgccatgttctttgtattgaatgggagagtgttggagctaatgaggcttgagtgtggaaccaggcgaaacgacagaaagtggattgaaaatcaaaaaatgtgtctcaagctggataatatggtttctaaagatgctgagttccatttcactcgtcgtactagttggaactattttacaaatgtcaggcgtgcccatgagctgttgatagctgatccattttgcacttaaatgatgaacccgggcttattgtctttataggatttgtctagttttgggcactcatcagtttcaagaaattgctcgttcttgttgttttgctacagtatgaatggcttatcaacatggggacgtaatagctagggaggatagctccatgcctccatgtaatcagctgcagcctttaacagagaatgagagaccatgtctgacgcatcatatatatgtaataacattgctcttcaatataaacatctgtcagccttcttgtaacagataaaatctgtgcccaatttcatcatcttatgtaaaatgttgtttgatacatcttcattggtctacacaacactaacatatcagtgtgatgcttaggtgctatacatattaagattagtatgttttgagaatagccaactgcaaaatgtcttggaagttccttgattttacatttggtgatcatgtagaataaacagcaaaatttcttgatcaggccttttaagtgcttttagcattgtgtatgcttctgtttcactaaagaaaatgttttatagttacaacaactgattctagagaacaatcgcatcaagagtgaacaacctagctaaatgtccaatatggtattttgcctatagttgcattcatgacctcatcaagataattgttttgacataatttagataatgttttgtaatcagaaattgcatcgcttcatagcagaagaaaagtcaggtctgaactattggacttgtttgagatgtttataggactcgagacttctagtgtgaaatagaagccatgggtatgctcttgtgacttgtctacctagctcttgattaattaagaacaacaagtactcgtagtaagcattttggaaggtattctttttttgaaacgagtccagccttggttggctttatattaaagtaggagggaaaattggacatgtatggccccaggagaccggtaaggaaaaaagagaactaaaaaggggctgtggaatcccttataggcgtaaactgtacttcacagcaactagcagaagaagtttcataatcctagtctcctggcatgatcctccaggcagagctagcctctccttcccttgaactcagcttaccatgggagcaactcatcttgctagattgggcactagttcctgctcattgatatcaccctttgcccagttggatttgctaaagtctcgtgcatgattccttttctgtcagttggatttggtaatgtttagataacctgaacattaaggagcctgctgatgctaaattgctaatagtactaacagtgttcgataacacagctgtaatgcctcaattttatctttcaattgaactagtgagtctggcctcttttgtctgagattgctcagcttcttcagataatgtaagcttgtttctgcctactatcttaccttcaatttgcttctataattgtttaattgttgattataattcagtttggaaaggatgaggaaattaaatttggtgaaattcacttgacacaagtgttactggcaatgtacagatgatgggacaacagtcatcatctggctaggattgacagaactgctatgcatatatgatacaagatggagcacttctgctggatataacacatcttacaggagttggcttgtacacaggaaaccaattacgtatacaaaatggtgacatgatctaatgttgtaatattttttactccagtttgtggtcagtcagttttgcgaataatgctcacttcacttgggaggttttacatttgacagtgatggtaagtggtcgttgctcctggagcagaggacgtggaggttgaagcagggattggtgggagtgtggcggcttgaacaagagcagcagaggttctccctaacattgattctgttgtttttgttgctcgatgcaactgttgaattttctcctttgtgcacagagttgatcgatgagaaattgtacttcattgaattgaaatgtgggggaactcagcgtcaaaaaaaatgtgggggaactcaaagtctagcgaggacgagtttgggctatcattgcttttaagctgatatatcctctagtactatgatgtatgacttgttgatggcattgtgcgatcaggtatctgttaacttgaatgcatggcctaatgggcttgattgagggtttggtgctatcctgttgtggttctgacccaggaaccctaaccaaattggggatggcatgttctgtggcgatagaggttaggccaactcattgtcatgggactttttgttgccttcatgagaatacagaaaaggagtaatcatgaatgcgtatataatgggcactgccactgtagttctgtgtggctgtgaggtggattttaaaaggtagtttcacattatttttaatatgtagttaactagttatccaactgtgccttaggattttacacaaatgttttgtgacatagcaaaggtttccaaggtctcagcttatcatgggagactggccttaatggttctggactagttccttctgacatatattacccttaaggccttatgttgcattgaaagcatagccttgatcgcgtactgagttttggaaaactatgactgtaattggtgtggcatgttcttcctgagatattcagtaaataactttgcttccatctactttcttacctcaggttgcttttatgtttgtttaattgtaggtagtacttcagtttgggaaacatgatgagattaaatttggtggaagtcccttggcacaagtactgctggcaagagacatgagactaactagggactgctgagtactcctgaacaatgtaaagccatggctgccatacatgatccaagagccaacacttccgcgaaagtgaatatcaggagatgagacatcttactggcgttggcctgtccacaggaagcctactgagtgcacaaaatgatggcatggtgtggcatcgcaaaatttttctaccgagttcagtttgaagtttaaactgttttgcaggaatagctgtctcttgttgcatcggagcctgtcaagctgttgtaaattctcgaggtcgcacattttgtacagtctcctgtaaatgtacatataatgttagatgtaatgagtcctggtaaagtggtacctgacttaaattaaaggaactgcagctctgttagcatgatggttgtgtaatttgatgcaagagaagtaccagggtgccagtggcattgtatgttcgtttaattgtaaatcgtccatgcttttaagttaaaagcattgactgcttcatggtgaatctgaaaattttgtttttggagactgttgtcagttctttaaggattatatccatgctgtgtaaacctgaagaattaccagtaaacctgaagaattactgcatgctggtttgtgtagttcacaatctgctggctctaacagacctgttacttaaaaagtaatcgaacagagaagtactctgtttctgtatgaacaactgcactccgtttctgttagttttgggatatttgtgtctttccaactcaataagagttagcacatcattgaacttgaaaggaagaacttcactggatgtatatcactcaacaagtttgacagagcaatgaattgaatagggaatattttcattgaacagaaatattacttatagcgatgttacttacactgaaatcaaccaatcaacagcaatctcaactaataagagacatatttcgcataggcttattacattcaactcatcaattaatcaattactcataaatacatgccattgcacaactatttgcctctgcactacagtctacaaaccactgaaaatctcttcctacaaggtcatccatataacagctatcttcactcttcagaacgctacttaagtgctgatttcttgctatcattctcctagtccaccggcagatcgaacagctcgtccatggtgaagtcgcggcagctcgtgtcgctcgtgctgaagtcgatgtagctaagcacctcatcaatactctccggaaactcaaaatctgacaatgccatgtcctcgccgtcattgaactcgcagttctggttgtccgccgatggcgccgatgctgcaccaccaccagcaatggcttcctctgcttgcgggacgaacaggtgtggcatgtcgcactcgcgcacaaactgctggtgctcattgtcatcaatcatcccaggaagatcagggagcagcagagaagagtcatcgcccatcacacagaaggagctctgatcggcgacttcagaccaatcctgttggttctgatcgggcagagcagctccagcatcagcgatcaggtcgggaagatcacggaacaccatgtcggtcacaccggaggagctctgatcggtgccatgatccgccgccgccgccgcgggaggaggaacgagcagtggcggtggcggtggcccgacctccagatcgaacagagcagtctccgcctcagcccgccggggcgcgccatgtgctcgaccgtcgtcttccggctctctcttccgcttcttgccgtagccgctgaatcggatgcggtagagccggagcggcgacgaggcgaggtcagccggcgccgtcacggagtactcgtgcatcacccaccccgagctccccctctccccctcggcaaagaagctcaggacatacttgcgccacgcgatctccagtacttcgccgccgccgccgccgtcgtcgccgccggggacgagcagcttcttgccgtcgacgcacatcctctgcccctgccagaaccctccaccctcgacggtgcgcttctggcgcttgcccttggcgttcttggcgtgcgcctccgcgaggaagaaggcttcgtcgccgccccggccgtgatccgcgagaagcctccatggctgcgcgctcaggggatcggcatcgaggacgacgccgtcgagcgggaggggctggccctggaggcgccggagcaggtaccggccgacgagctcgtcgtcgctggggtcgaatctgagccccggagggagcccatccgcgccagccgccgccattggagtctcgatcgcgagcgctcgagaatttctagggtttagggtatcgagagagagagagagagagagagagagagagaggagaggaagcgggcgggtgaatcttcccccacaaggacgggatttgaatttatcgaagaggaggaggggggatgcgtggggtgacgtcagcatgagacagccctgctgcgcgcgcgttgcctcgctcagccgcacgggtagatttttattttgtttttggaaagcttaacgaaataacttgtgttagcaacctgattttggaacctagttttgatttgttttgaaattttagcagaaatttgaactgtcgatcaggggcctcaggctgtgcattcttattgctgctcatggtgattctgaagatgcttcctgcattctttggactttctgacggattctatctttaggataattctaggtgggaagcagagtatacttctgaagacaatcaaactataggggaaaaaccttaatattgttggtgat

SEQ ID NO: 37684 - DNA, 9135 bp, Oryza sativa
caaatggagttctaagatcagatatcagttagatggatcagttattcagttgagacttgagttcgtaaatggattcaaatagctgcacaacgtggactattgcgacacctttagtccggttctcaaacctgctacactgaccctaatgttgtctctagcagcagtttcactgggctgatctttattccaactaggaaggtagcccgcgcagttgcgcgggcactttgtttgatgttgcttaaatttttattacgaactttttataattgtttgtttaagggttctttttttctgaaatgttttttttccaaatccattattgtttaataaacatgttctatttgcacaataaagctcgtgccctctaattagttagctttttgttacatacttattgcagtctaatcatctaagaactaaaaaataatgcaatgcttatgctaatgggtaaacatctaattagttagctttatatgtcaacatttttataaatatgaatcaacttttgtgtaaacatctaatactaaaataggttcctgttgtttatttattcatggattgaggggattcaaaactatgttaaatacatattcttgtagagtccaattctattgtgcagtgtaggagacaacccataagtgtgcgaagctagcgagaacacaattattggatggttaaatattactacaaacatatcattatctggaatgagcttttatatgattgttcccataatttcattttttaataaaatttttagttaaatattaggaattatgtaatcgaaagtaaccaacccacaaatattttgtttagctagcttgcattgggcatgaattagtaacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatgccctatggtgacaaaaagtaaggcctagctggactcaatagcactcctcttatcctctattgatgcactattattatctcattaaaactggtctactcagtgtctccctgctttgcttgctgtctcattctagtttgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggaggttaccatacgattcattgtagtagtgtttacagtttcgatcatgtttagttaatctttcttttcatgtctcggtgtatcgtaacacataaatggattcaaaatttaattcttcaagtgaatatgtgcatggtgacatgtttatagaaagttaatgtccatatatatggatgataagatctttttaaaggtttgtgcacagagaaaacatacttttttttcatacccgtaaggtatggaatataagcacatagccaccggcaagtatatatatgtaccatatactaaaatgctattaaataccgtctaataaagtaatttaaatgttacatagaatatattctagagcacttatgtagaagatcgtttggcactcttggattatttgagcacattttagagaattcatgaattcgattgtttcctctaactggcaaaactacatttttcgatcaatcacaaataaagatataaaattataattgttatggtagctagagtcaaaagccgaccttaaccaaatatgtcattctggatatgtattggcagtgaaaacataaagtaaacatcgattgtaccaatatagcccgaggggcattgtatgtatgtacatacgtgcaccatcgcccaacatccacccctctgccctcattcatgccctctccccatgtattgtctctcatgttttcatcatatattaatcatgaaccctaatttattataatcttttaaaataaataactattttttatcgaggacccatattaactatatttgaacttctaaaataaatattgtattttttgttatattctgacttttttcatatcatttaaataattattaaaaatatgaaaaaaccaatgatatataccttacctgttgaaaatatttttggtgaattttctttgcatctatgtataatttaggatttattacaattaaaataccaaccaaataattttgaaaaattccaaatgatttgagaatgttaatcttacacaaattaaaatttaaattggatctacttaaaaacacaactaaattacatggtttgcatttttacatagttcaaactaccgttatatatttgttaagtaatatttgatgccataaagtatatagtttgatgtgattacttttgaaaaattgttgtggagttaattaatacatgtggatgtcatctgccacaatgtattttgtgctaaaatatagcgaatataagacatccatgtaaaatcataataaaataaatgataattacgtatttttattagtaagatgaataatcaaacacatgctcaaaagtcaatagcggaaaaaagtaatataaaaatatttaggggtatcctaggttaaaaaataacagtagggtgaatgggaagaaaaaaaaaggggatgagtacgtactacctgcctacatacatacgtgtgagggagggtggaatatgtacgtcagtacgtgtactgagggagggagggaagagtagatgtacgtgcagggacagaagaggaagggataaactattggttttaatctaatctaatggtgtaaaataatggatccaccagtttaaatgaaaattgagggttagatgtttctcgtctattaaaacgccatgtggcggcttaggagcatttatagggggtgccacgtggcggtttaggagcgtttataggaagtttaatggacttttagtatataataactaggaaggtagcccgcgcgattgcgcggatatgcgtcgtacgttaagactgagatatttataagagcgaaatattaaccggtgaacatctatcacgatttctccataaatttttttcgtcgacattaatttcctttataattttctaacctattagctttctattatatcatatttaagtaatatctataagcaattatttataatcttcttcatcatttgaaaagaaggtagacttttttcttaagaaaacatgtcaatgaaaagtaagtgtaaagtaaaactaaggtatttttctttttttaattgcatatatattatcatgatttattcgaggattaattgggtgggacgtgaagctccactaaatatatgggtttatatagcctaatatgattgatataatttgagagccgatccatctatgaacatttcatgtagagtgggtcagaagctccatgcacaataatattttttaaatgtgatgtaccatgtatagacatatgtttttcttatataagatagatctaactgttaaatataatgattccacatgcttaaaaggcattggagtattccagaaatatagcttaaaaattatggttgttttaatatctaacattattgtgaagtgaacttagctcaactggttatgtttgttgtgatggaatttgcccacttgggttcatgtcctagacttggacaaattctttcagtaataggtaacatacccatcgacagcgagaagtacatagtgacttcgtcaatctcaaaatatgtcatcctagtctctcggaagtactcataggggtatgtgcatgtgtgagttcatagaggtgagtgtgcgtgttgtgagcgcccgcgtttgtattttattttaaaaaaatatcaaacattatttattgtttctcttttaatttaatagataaaacaatagggaggggacgacagtgttgtgtagatgtgagagtgaggaggaggtggagattttgtttttccaatttttataatttttctaaatgatttaagtgaaatcctatgacggggtgtttcattttttctaagaatttttaaggtttatcccttttttaatagggcgtgccccatggtaacttaaaatttttctaaaaaaatagatcaaatagttaaaaataatggatacgtcaatttaattgaattaatttaatctagcacctcgtatgtccagccacgtgtccctcggtgattcgcagtcagtgttagttatgttctttttgtttcttttcgtgggaaaaaaaggttggtggttactccctatgtcaaaataattagagataaatatggacaaattcacatttatccatatcttaactacttaaaaattagtaactttctaatcgtcgtcacaataattttctgtccgtcaatccgaccaagcggcaccctccatccacatacacgcaattacatcccttacgatgcccaaagaaaaaaatggagtttgattcaaaataagctaacatttctcacctattttgaccggaaattataaaatatttcctccggtgtcctatagccaattacacaattttcgtagtgtccatcagccatgtcacgtttttacggtgtctcccaaccaaatacacgttttttgggtgtcctgtatgaaattttgcctttttcttataattataggacatattatatggtgatttatgagcgctctagtgggctttaattgatttttgttacatatagtgatttagcataacataatacatatgttcgattaatttttcttatttagttgccatccaaacgatagggtctaccatcaaatgatgtattttaactttttatagtaaaatatagctaatgttatcttgatttatttatttaattataaataaaataatagttatattatgttagttaaaaaaataagaggacataattgaattggagaggagatgatgggtgagccagaggtatacgtaaggtaggaggaagggaggagattattgtttttaacatagattgaatgggtcctagttttgagttatctatttttataaacacatataatcttagatctattagaaaatactttgtgtgttgtactttttaattaaacaacttaaattgtttaaagttgttctaatttaagtgtatgttattaatcataaggtttaaaaatctatatatttttcttaaaaatgtatggatcagtgaaaaacaatagttattagaataatatgacccagagtaatgatttttttaataatatagttaacttggatcttcaattttatgttttatagtaaataatctaatggtgtgcaccaataaaaagctagctatatgatttagataatataattgtctaaaattgtttatcctaaaatattttttccatctaacagaaagtggaaaataggatagaaaggaaataggtggagaggtacgtacacacaatgagtccaccgtatattagtgaaaatcgacagccggatgttttgtttattctcgtaatttttgtgatttttttaatttattaaaataccacgtggtggtgtaggagcgtttggtggtgtaggagcatttgtagaagtactacgttgtgttttaatagcgtttatatgatatttaatggacaaagctctaaatatgcttcaatgtgataatttttaaattaaaatatagttaatatcaaatgtagtcgtaatattttcccacatacatctatttattatttagataaatttattagaggacgggtgaatgttgatattatgtataaagatttgaggagtgaaggacggtgcgtagtttgtacaaacttgggagaatattttttctcaatccagtgaacagtagtacgtattttacatttgagattttttttcacttttttgggtgaaccgtacatatgtacgtgtcactcgtaacaattaggtgggaccgtggcagggctaaaccttatttttttcaattgtaattacagttttttttttctttttttcagtgagtagcaaagtacagaagtacgtatatatacgtgtaactattcacgtgattttttattcgagcaggttacgtgggatgtattttaaataaatctaatctaatagtttaaaaatagtgggtccaccaataaaaatgattggatgtttttttctcacaatttacaaggttttctctaatttattagaacaccacgtggtggcgtagaagcattcgtaggagtgctacacgactatttagaagcgtttgtatcaagtttaataggtctctaatgttacctattgcatgtcgacccgatgtgtcatgatgtatttagtaccacaacattacttttatacaccgatactatatataattaaaagaatacaatcgatcataaattgggcatataattaaaaataatttaaaagataatgtttagagaccgttcatatgatatttgatatttatattatagatcatatacttccgtatattatgtagtattatattttatattatacaaaatactattttagaccgtcattttttccaacagtactaactacacatttttttttggctttatcattttttatcgtacacagatgtttttattcttccgcctaaccgtaggaagctttatttgtttttttcaattatacttgcgtatggacattttctttccttttcccagccaccagttgcatattttttttaagaaaaactatcaatttttttaataatagatctaatctaatggtctaaattaacgggttcaccaatttaagtgaaaatcaacggtgagattagatagtgccacgtggcggcctaggagtgtttgtaggagcgccacgtggaggtttaggagcgtttgtagaaagtttaatggacttttagtatataatagatagatagatagatagatttgatgtaaaattttctatgcacggtgaacttcatctagatttaaatatgcaaaagagaacctcatgtgttctttgatcctgctcactcaatacgtatctggaagctagataaggtgttgtatggaattaaccaagcgccacgtgtgtggtactatgaagtatgaactatataaactgagtattaagttgcaggagttggggtttacagtttacaccattcaaaagtgatatttttcaatttatcttccatcaatctggtgtcatcatttacatctttgtctatgtggatgatgctactattgctagttcagctgcaaaatctgacactggaggactgattcagtaaattacagccaagtttgcaatcaaggtcacaggggagctgtcatattttctgggtattgaagcaaataagcaacctggagatggagtgaatctgacacgacagaatcaatttcaatttgccaaaccgaatgctaatcctactatcctatgtcatgttcagacaaattagctctgcattgcggaccttttggcttctgactttcaggagctgagatgagatgttaaaatactctgaaatactcggttaataaagtgcttcagaattcacaagttcatactgtggtcagctgtaaaactgattttgccgatctcagagattacagcgttctctgaaatttaagcccagtagtgtgacttggacccaacatgatttcctgttgtcccacaaaaaccgaacagtcccacgatcgaatacagtctgattataaatgcttgacgaatgcagaaaaaagaactggttttgtctgaaagtaaaatatggacacttttttttttctgaaatgaactatgggcacaaacacagtcggtagttttgggcatattccttttcgattcttctcctgcaaagcatttttgcaactgtttttcattttgtacttttcagctgataccttaacaatgtgcaactacaacattttggtgattggtttgcagccaccgccttaatattgtcctgtgttttagctgctattttattggcttatgtgaggcactaaaattcagatgtttgacacccagcatctgcttgggccgaaccttgcaaacagcagcaaatatccagcccaccagcccatgagcccatctccctcgttagctccttcccccaatttcgcctggatttttttagattggtaatttcgcctggattttttttagaccggtaatttcgcctggattagcgggagtagttttcggatcagaaactttttgaagttttgaaatttgaaatccaccgcctaatttccatttcccacgaggaagcaactacttatgcggttatgccgagaaatccgcgggggacgccacgatcagttgatcaccatttccaccgatcaccaccagagcgaggaggagacgatggagccgaatcggcggcggcgcaagacggaggaggcggagatctccgccgccgaccgcttcgccgcgctgccggacggcgtcctcgcccggatcgtctccatgctcccttactgggacgtcatccagctctccgcggtgtgcgcctcgtggcgccgcctccgcctccaccgcgccgcgcccgtcgtcaacatcgacctccgcgagttcgtgctgttcggcgccttcctccccgggtacgtcgtgctcggccaccgcgccgcgctccaccggatgcgccgccccgtggacaagctcaggctgacctacttcgccgccgaccgctgcatgaacgaggaggccaacgccatcatcagggccgtcgccgcgcgcgagatccgcatcaccatctgccacggccccggcggcgctcgcgctgcccgcgcgcgccgcctggacgagtgggacgtcgacgtgccctcgacggcgacggatctagacgtccgcgggtctggctaccgcgcgccggccgtctacgccgactgccttcgggtgctcaccctctatcacctggagctccacgacgcgccgcgcctcccgtccctccgttcgctgacgctccagagcgtcctcgtcgccgcggccgtgccgttcgccccgggcaagtggtgcccgcagctggagagcctggagatggagagctgcacggtggagtaccggcaggtggacatccgcctccagctgctcaagctgctcgtcatggacgacgtcagcgtcgg

SEQ ID NO: 37685 - DNA, 43015 bp, Oryza sativa
accgtgatggacgacggcgagatgatcccggaggagaggctcacctgcgaccttcgacgcctcatctcgtcgcgccacgtctgatttctgccgtgatcgccggatcgatatccacgaacatatgatagtattttcgtctgatttcttacctgatctgctgtcatatacctgatcaacctatttgctgtcgtttggatcttgaaagaaatatttattgtctggttgtccgaaatgtttgattctttctcctgcaaaatgaatgctatatggttctttaatccttttgtttgaataggcatgttcaattcatcttttacaacaagtttgttgatgatcttggtttatttttaccctgaagattctggttggtttctgttgctctgataatcctagaaaatataaggctgtgccatgataatccttctgctttttgtgcaaacaatttcagaactacaataattaagtgaatcacaccttccaagagcgaacattcttcttgtaattactaattacccagttaccactgatagccaaatcagcagccaacataatccatcccaaaaccaaaatgtttagcaaagacattgatgttatcttacagacaggtatagggatgagatcacaattatgaaattactgggaatgttagataaatgttcttagaaagataagaatacggtttcaaattttttgcagactcaaccctcatccatttcagcggaagataagaattgcaattttttttggtgatacgggaaatttggaaggaatgaaatgctatgatcccagggcagagattagtactaccaggtaggcaaataccaacacagcaacatcccagcctttagtcctaagagaaagagttttcccttcttaatggatttgttaacttctccattgtttcagtcttttttaatcaaggatattattactaccacccagtttgctaactgagatatttgtggtgacattcccatgagcaaaactctttttagtacattgtaggaattagtgacatgatcaatcacagaatcacggcctatcaactgatacaagattattattaaaaacccaatgattattcatggcattatgatggaaatagatcctcagacgtaacgtcctccctgacgtggtcagggacatataggcctcaccgccctcaggcccacatgccactgaccacacgttatggctttacgttagagcatcccaatatcatagtcctagcatcaagtttttagaattcagaatgacaccatgtatcgcacaagcctatcaatggcagcattagaagctccatcatcctccacgctcttgcttgccttcgccttgagaccacgcgccttgtccctcatggccgcgccttcttccccaaccatcagcttcctcaccgcctcggccacgcggtcccggtcgaacacctcgccgagctccagtccgacgccccactggtgcgtcacgtacctcgcgttcaccgtctggtcgccgaagcatggctgcgcgagcatgggcaccccttcgcagatgctatccagcgtcgagttccacccgcagtgcgtccagaacccgccgatcgccgggtgcgccagccgccaggacgtctctctgtggcgcccatgtcaccacctttcccatgccgttgtccacgacggcggtgagtggttcagtcagaggcagggcgtcggagacgatgccggtgacgaagcctgggcggatgacccagaggaatgggacgccactgccggcgagcccaagggccatttcgtcgaacacctcgcggtcgatgcgcgccacgctgccgaggctcacgtacagcacggaccgcggcgagtgcgcgtgcagccacgcaacgcagccgctgtccggcgcgtgcaggccgtgctcctccggcgcgccgagcagcctgtgcatcggcccgatggcgaacgccgggatcctcggcaggtggcgccggatgttccgcagcaccggcttctcgatggcgcggaaggtgttgatcacgaagcccatcgcggccgtccgcatggcgttgtcgacgcgggcgatgaactcgcgcacccgctccgcgtcgccgccgtcgacgcggatcaggtcgcgcccgcgcagcggctcgaccggcggcaacacctcgtcgcggctctcctctgcagccaagaatcagacgcgatgagcactgctgcaagaatcgccatgaacacgatctcataccggaaacaacttgcctttgatcgggaggtagccggagtagcggaggcgcgagtagctgagcatgcagtggagcgcggcggcgttgtcggtgcggagcgcgagcgcggcgacgccgacctccgccgcggcggtgagcgccgcgtaccagtaccactgcccgtcgaccaccgcgcacgccacctcgctccacccccccccccccccccgacccgcaccacccgccggagcgcctcgcggaacggcgcctcgcaggcggcgttgagcgccagcatctgctcgaccaggtcggtgccggggtcggtggcggcgtcggggaggcgctcgtggatgggcacgaagatgagctccgggtggcgcgcggcgtcgggggcgttgaaggtggtgcggacgacggtgacggcgaggccgcggccgcggaggagctcggcgagctggagcatcggggcgatgtggctgcggaacgggaacgggaacatcacgacgcggcggcagtggcggcgagctccggtcatggctggcaacggcggcgagctctagctggggtgagatcgtcgaggacgacggcaaggttggcgcggtttatatatggtggcgaggtcgcgcatgggcgggggtacgtggacgtgcaaatgaaagtgtgagactgctcctttgcttgctgtattttcttactcagtatgacgcgaggcagggctaatgtgtgttatccattgctagcattaataattatccttttgacatagaaaatctgctttgtgatctatacgtatactaagttgatatctcgtgctttgatgcggaatatgtggatgaatacattgctatatattatagaaatgatagatgtatgtgtttaaataatgtgaaaatgatatgaagataatgatttaacattgcttgcatattgagttctaaaaatgcaacaaaattataaatggtatgtcacattaatttgcatgatatttaaagtactctcgataataatttctagtgggtcattatgtgacactcttgcatgtgatttaaaataccctacataataattgctagtgggtgatgatgtgacacacttgtatattgtgcttagtacttagtgggtattaactttacaggaagataggatatggtttttaaacaaaataggaagttcggtcgtgataggcatctcatttattatttagtctctccgtccccatatataaggaatattgaacggatgtgacgtttcctagtactataaatctggacagggagcatgtccagatttataatactagaaagtgtcacatttatccaagaccccttatattttggaacagagggagtactagcaaaatgccccttattgcaatgggtgtgtaggacctgtggtaaccattttaaaggtaaactctcacttttattttatacttagtaatatgataatgcattataacaagagaaagcaattttaattgtatgtacgctgaaaaaataaaattggtatgggaagagaacatctcaaactccctggggagatgagcaagcaagcgtgctaaggttcaaagcacaagtttcaggtgttaattaaaggagtaacttacattatacacagcgaaatttatgtgaacaagatgaatacaagctgggagaagaattacacgtcattgacactcatgtagcagtacgtgttgaatgtgttagtcgtcaagttaaatcttggcaggaacatctacgaattagcaaggtctaaccaggaatgtgttgtttgaagaatacaagcgaacgttcaagcgaacctgcaggctagaccttgctatttccaagtacatcttcgcagaagaatgcttgcttggagtacctcgtcggcagctacaacattagccgggacatcatcgaggtcgagcagcttggactcttggagtacaccccagccgcagctgcgggtccatccacatgaacagtagaaggctcaggaacccatctcgctgaacgccgctgtcggcagccgaatcggctggctcggcaaacgctaatgcgcacatgaataaccgccagggagctgcgagctccttgatgccacgcttgatccgttcgatcaacaagggcttggattttagctggatgaaaaccaaaatggatatgcagaagcgcgtgcttaggactcaaaataatgtgacttagtcccaaggtaaaaagtgaagaatgctgaatagagctgaagctgcatgattatgtcctagggtgcttatgaaacctttttctagtccaatccccataaacattggcaagaacatcgaaagacccagctgcacaatagactgagaacccatagccacttgaagtgcacgattccctcccatccgtgcttgcttcataattgcaaactcaagtccatttaatgctaagtaaagtcttccgtccaagaaaactagggtttagtggcgggcctcgtgtggacgatgcattgaagcagagcacacgcagagctcccaagaattggacaaagctaatacatggaacggacgtaccaaaattctaacagaaatatttttaatttttatgatagtagtgataaagaaaatgctttaaagaaagttgatcttgtcaaatttgctttgaaggtcacttataatcgtataaaacaaaaagaagaaatctatgttgtgaaatagataataaactccgattaaatggtaagaatgtctcttatattgcatctatctaggccatccatcctgtaatcggtggatgcatacattgacccccaccaaaatactccctccatttttctttatttaaactaaccaatatcaaataaaaaacagagggagtaattaattagcagctaacaaactaaaagaatctggtgtctccgggaaaaaaaattcaacaaatatgcaaagccgcgggaacaaaatgaaacacgccgctccctcgcttttccggaccaatatcaaagaagatgaatctacatctcatgtacatttatccagaaacaagaaggaaacaaccaggaaaaaaaaagtcctcaattgtatcaaacaagcgagcgatgcaggcaaacttccatctctgtattgttttatagctcaccaaccaaaaaatgacagcagccaacagatgccgcctttctgcaagctgaaagtactgatacaggttggaatgtatctcaaacattatgtgttggtcaagcagactcatgtcaaagatacaaatgggaggaactgacaattttctcctctcattgtgctcaataatttgccgaactaccatgccaaaaaaggaagacaatgatgttctactaccaataagagcaattgcatctctaagctcacatttgaggctgatttccaaggagctgtccaactaaattagtcacctgaaaaggtatttcaggaagaacaatgagaaattaacttaaccggattgaaagcaaaactaaccacaatacttctaatctgttagaatgatgatgattatgcttactaaaaaagaaactgaaaagaaccacaagaatattactcggaattaatttatggtcatgtttgtttatatgaagggaaagagtgcagatcaatataactaaatggagaactatgcaattacaaagctgtatacactataggggtgaggagcagccttccttgcactgtagaaacaggaggaaacaatcagagaaaattttcaattgattccagaacaaatcagccatcaagtatttcctatggaaagcagattggctggtcctttatgtaaacagtaagcttctttgaacagagagagctacaccttccaaagccaacagttaacaatcatcttaaggaggttcatttttcacaattatttcttcactacaacaggctgaatctacttcaggaagctaaatgggaagtaaatattaacagtccagaaaactgaataaacttgcctgccaatacttcgaagcacatcgatcaatgcagctattctcacccatatttagttcagcttctttatgcctagagataacagaagttgcataagtccaaataatcgcatgtagctcatcagttcatgtgctaaaagcatggctatgaactccatatgtacagagatgtcgtattgtatgccatttttagtattgagccttgaccatttaactcatgattatttttccatcacaaaagggtttacagaacagcaaaacactaccttgactaaacaaatctaattcaacttttgtgaattacagcgtcatgggtgaaaagaaatgaaggttgaagtcactaatagtaaaaacagaggaccctgaaatacaaaggcaaaccccatatgttaccttttctcaatgcacttgctgaaacatgtttgtgtaagcctgcataaagtgaaacaagggtagacaatcaggaaactgccaggtttaggttaattgctttagcatactactgtaataaacttgaaggatgcaaaaataaagggcgaacattttgatttaagattaaagaacagtcacactaaattatatgctacatgatatctcagtatacatttagataactccatgccgaagaacaacctgaactctctgatagctaaaggtagaactaatcaaataaaaagaagacgttacttcactaggtcactcaccgattgaaaagatccaccctatattccatctctttctctgccaatccaaacatctattcagacacaaagaggaaaaatattattaatctttagtcaaagaggttataattatcaggaaagccttagtcacaaactcataataacaaaggtcaaagtataaactgaatgacattacatacaagaactatcaaagaaaatgataggacaaaagactatctgacaaaccaacagttccaaatactgcaaattagactggataagtaaattgtaagacgcatagtggtggtctttcttagccatggcaacatagaatctgaaaactatatttcaaacaacaaatagagtaacatacaacagtataaacaccaacagtttgaaaaatacaaacatttgatttaaactttcttttaactagtacgatgttaggtaccactaggactggaaagaattttcagcttcagtgtatgctactccaaggaaaaatggtagcaaaagtgaaaaaaaaaagagagaaaaacatatattccctctttttttatatatgacattggttagtttaattttgaaccaaccaacatcatacatgaataagaagggagtactaatattttgtcttgatatatgtacatctcaagactcattcaagtttctgtgggtcaaatgaagtgaattatcctaatgctttacaaacaaatattatacacaatttcctagcttcctatttattttaaaatcactctagctcctatataaacttgttaatttcaccttacctagcttcctatttattttaaaatcgctgcctcgctgactggtatattctttttatgtatattgttcgtttatcactgttaaagaggatgttcaagctgtccttgcctcctgctaacccgactacagaaacaccataaaaaaatgtagaacagatccatgcatacatctggatggcagatcttattaacgcaaacgattctcagaagggcaaggtgcagccataacttgcacaaatctgcccaattttcaagattgttgggatcacaacaaaatcagcaagtttcagtttccctctaatcacatccagagcttcagcgtcagtgtaattaaaaaagcaggaaaatcacttgtgacaaagtagttcgaaaactgttactgatatcaccatacaaactgatacgcgaaatcagatgaaccaacacagacctgctccttctgcatattcacctgctccttctgcacattcaccggctgacctttcgcggccatcgctgcagctcacttcatgaaaacaaaatataccactcagcgaggcagcaatggattaatccagcaagaaaacatcgcagagagggggggaaacagtacaagatcccccgggggtcaaagaaaggcagggatccgaactcacctcagcaaactagaccaagaacgaatcggggaaacgggggcgggggtccgacgcgccgacacgacggcgatcgcggcaggacaaggctagggttttcgtggcttgtctgatcgattggagatttggaggcgaggaggtgttttgcgatttcggagcttgaggatggtcgatctgcaggtgggcccgcctgcaaacgtggtttggaagccctgtttggcctggtttgaaatagcttacggctgtaggcaaaagataattaggagtttagattaaggaattgatggtgagattaatatgggaatttgattttttaagttttaatctagtattatttagtacagatggtgggaattgatagtgagtttaattcaagattagatcttaaatgaaaatagatggtttcggatttatttaggcaaaataaggaggaatttcctcccattaccatccctataaaggaagttactccctcaattccttatccttattcatcaaaactccaatgtctttcaaccaaacagaacaatggcacatccctctaaactcctaatccctcttaaaactcccgccaaccaaacgacccgttagggctagtggttttgtgtttaaaatttgagggattcttaaataaatccctactttttttttgcattttaattagtcttcaggcatcgtcaaaaaatacagttgttttacatgatatttttagaggtgttttataggaattttagtgtacttcttcaaggaaacaattcaattctcccatggattgcagaatggtccgaacatgggatttactattgagtaaatatcatgattttgtcaactaaaaacatatataacttttgtcaggacaaccgacagttttagaaaagaaaatgatcagagtataatattctaaagtgtgagcttatctactttcccattagccataaggtttcttgggtatacacgtgaagagaaaatgcttgtccatcttattattggtgtcttcctattacttcctccatcccaaactgaatgttttaagatttctcagcacctctatttatttgattcagttgctatttcagtactccctccatcccacaatataagggattttgagtttttgtttgtaacgtttgaccactcgtcttattcaatttttttttgcaaatataaaaaacgaaaagttatgcttaaagtactgtagataataaagtaagtcacaaataaaataaataatcatttcaaaaaaatttgaataagacgagtggtcaaacgttgcaagaaaaactcaaaatcccttatattatgggacggagggagggaataggacatgcacttcaaaaggttccagggaatatttcatgattgcaattaagtaatgaatcattctacaacaatcattagcatattcaaacatttgaattaacctatggagggtgcttttgacgccagggagtgcccctctattttatataaatcctgaaggaaccatcttatttcattctcttcatcaacctataatctaactcaacaacacacatattaaaatggttagagatcttaatttaccatcagaagatgaaagaaatgaagaagctttccctgacctcaatggaggagaagctgatatggacgaaaatagaagaccagttgttgcctaaggagatataaccttgttcaagttgagcaccatgaacatgaacaagctgtaattttttatctcaacttacatccttttgatcttaactttaaggctacataagaaaaagaacaaatgcatcaaggtaaattactttgctttaaggctttatttttcaagtcaaacagcttggagttggggacgtcaccacttccttgtcctcaaagtcaagcgtgaagccggtgtcagggggcagctcggagtcggggacaccaccaattggcctcgtcctcggagttagggatgaagcagtcgtcggtaggaggagggggcggggggagggggggtagctcggtgttgaggatgccaccatgtgcctcatccttggagtcaagaacgaagccatcattgggatgccgctccatgccgaagatgtagccacctgcatgttgctcctcaatgaggaagtagaccttgttggtgccgagcaccccaccaccacgtcgcatgcctcatccacgccttccttaattcatttgtctattgtgagtcgacatccgcttccgccgcacttcacttgcgtgtggcccttctgggcagctgagccgtgacctctgcgaccgtgacgagcggtgaatcgtcacgtgtccgctgctccattgcacatgccgatagtggagaggagaggagaggcaagctaaggatactagggattagggatcggggatcggggtaggggtgactcaaggtattgagcgacatgagagtgaggaaacgctcaatagggaaaaaaattagaaacatcgagtagtcttgaatgagttaacggaaatagactgatctcacttctctaattaagttgctaaaatgatttttttctaagacctcactggatagtagtatctagtttttttttgtgatgcaagacatatgtatcgtcattatattgcatgttaccgcactcttactttcctttaccttcctctctgtcacgaccggaattaacccaacgggcattccatacgtgtgtgtattgttctttgtcccaggaggcaaggtacaccaaaagttgatacaattcagagtttaacaagcggaagcataaatagttaatttattacatgggcgacaaaggcccagcacacacgaagataaacggaaaacagcggaagactagggcgacgaccacaggcacttaacggcaggcacgagctaaacaccaaagccttcatcctccaagaactcctcttctgggttgggggaaaaattgagcaagattgagtacaaccaccgtactcagcaagacacacccacaaatgcagattaaatgcaaaggagtacaagggttataatataggggtaggatttgcagtaaacagcatttaaaggtcatttagttgcccaaagctattttataaagacgatcctagagctacactgtgttattactcaaggccgtgaacccacacgaacctgccttaacccaaggcctatgatgattcagaccgaactggcaaccagacccaggtctcagctcgttccaaaccaacccaggccaaccattcaacatttttgttgttaagcaggttttaagaaataaaccactaacttgggtacattgctaggcttgcccataaccgagggcgtggctattcgaatagattatactccgatcagaggtgtacatctttacccacaagacacatcttcctcacgtgtaaccacgtgccacataccaccacggcatacggacgaaagacgtgacatagttcccaacccatcctagcaataaacaagagtaccgacccaaccctggctacggccggaatcctgagacaggtaaccaaggttgagcccctagcagcaggacaccagccctgtgccatgacatctcgactaccgggccgcagctcatgtagccttcatttgccctagagatgtccatcgagccctgacgtcatccatctctatccgtgtactttttcccatgaccagactgagccacaaactacgccttacccactagacatgtggaagtacggtagtgctttgcaaccgaggcccgaagaccagtccttatagtggccgaggtgctactagcaaaaccatgcacctcgagcccagcctaaaaccattttgggggttttgaaaggaggagaaggggtgtgtccatttccacataatccaaccattccataatgtccaaatgatatgagcattcccaaagtctaaggttataaaaccacctaatgttgcctaattaatcagcgaagcagctagctaaattcatactagtggaaccatgaatagagtacccactagttggggttttgtttatcctagggtgaacaaggtaataataacaatagcaataataataaggtcataacaaaggtaaatagtcatggctaaataaaacagtgataacacgggaatttaaataaagcgataatgtagtaatttaaaccaaaatagttttataaactggaattcaatatgctcaaggatgatgtgacttgccttgctcgctttcaaaaacgtcggcttcaacatccacgtagagcggatcttccgaagctgcagcgtctacacgaccaatgagaagaaaaaaggcttttattctaataaactccatataacaagcagaaacatagcacagaaatgggttcttgacttaaggaaaaattagagacttgaacggtccaatttcgagttcaaacgaccaagttatggccatttgaagattatatgctctttaggtgaatatttacaatttccttcaattacttttgaatttaaaacgattattgcgccagtcgaggggaggcgtgcgtgcggaccgggtccacgagagtggtgggccccacgcggcagcccctcggtccacgggcggctgatggccgggccacatggcgcgcccggacgcggccacgtcgtcgcggccggcaggaggcggcgtccgcgccccgatggtcgccgccggcaaccactggcgcggcggagcggtggccgagagaggggagggaagggggaaaggaggcggcactccacggctcaccccgaggcgacggcggcgacggaggaggcggccggagcggagggaggcggtggcgcggctcgggttgacggggtcggcggcattccggcggtcggcgaccgaaatagaggggtggacgatgtcggcgaggtcgcggcgaaaccgaaggaggcagcgccgaggtgggaggtggtccggggcgacgacggcggcggaccggagctcggcggcgacggcggagagagagagcgacgacgcgagctcgattccggcggggagaaggggcggcgagtagcggaaacggtggtggggagctcggggagggtaatatagggttgggagtgagagagggcggccggaggggaaggaaaccggagcgggagacccagccgccattaatggcgccggcgagattaggggggcttccatccgaaataacgagagagagagagaggggaaaaatggggggaaagggagagggaatcaggggggaatatttccccccttcaattttgaacgggagcggcggagcgcggcagatttggcgacggcggcggcgctaggcgcggggggagggaggccgagtgggccacggggagaggagagagagggagggaattgggccgaattcggcccaagagagagggggagggttttagggttttctttttataaaaccttttcaactttgtttatttcttgataattattatttgtgctctgaaaattccactaaaatttatttacacatttttaggcttttaggaaatttaaaaaaaatcctccaagccttatttgacttttaactttgcacattttaatttttggaggttttcactaggattttaattattctaggtataatttaaagaatatattttagggtcgttttgggacgtgacactctcctgctcacttccaacttctctcccaaatttaaacatgtgcatcagcacactaatttattttccaacagtttgcaaaaaaaaatcaataggcagtaccaccaatttatatcgttcttataaatatcatacaatatttcaattcgacatcaatacatattccatcatttacctatttaccccccgcaatactaaaaaatctgatccatctcaaggaagaaccagatcatggtgatgccaatagaggaatggtaaggccatcccaacccgaaaactatctattaatttccatacttaccatgtcatatagtcactatgtatagaaactatatctccaatggatggtatcttcaaattaaattttcatccaatcatctctcaaatctcctttaatccacatatcccctgttgtcatttttggttcttttgtacatatggtttcttgcatgagaaatggtttcatcatctttttacccctctcatcattaattcttttgccacatcatatatttttttttcttatgtgacaatgtatttaatattatggacactagataacatgcagggttgaggatggtctaagagcaagtttaatagtatagcccactactagctccaaatcttctatagccaatgtaatagtcaattcatacaatagttgcttaatatattagtaatagttggtcccacatgtcatacacatattacgtcttggaatccgtgctgtagctggctacaaatctatagctcactgctcttctctctcttcttttatctctttaaaatatgattataactggcttatagcttgttattgtacctgctctactaaggttcctttctaatgctctttttgccattagaaaccatcgttttgcatgcagaaaagtggcaacgactacgtggcaataatcaatttctaatcattaggtatctgtgtctgtgccgacgtgctcacgtacccagtcatgtggataagccgtttgtggccgcctcaaccctcctgaccctctcaagacccacgagagctcaaaacgcaccacaaaaaaaagaagtgaccgtgcacacgcccacgcttcacaggcgcacacacatcacgtaggcacacaaaagctagcgatggcgtcggttggtttcggcaccacggtggcgccggcggtggccgccgggagacgcctgagccaccgtcgggcggcggcgccgccgccgccgtccgcacgcgtggcgcggccgtcggcgacgaagagcgtcacggcggcggcggcgacggaggagaagggcctcttcgacgccatcttcggcgcgctgtacaaggaggagcagctgctggagaccgaccccatcctcaacaaggtcgaggagaaggcccccgccgccgcgtccagggccaccaaggccagcggcgctccggccaagaaggcggccggcgacggcgacggcgacggcgggttcagctttggcgggctcttctccaagaaagagtagacgccgaactcatatctgctactgtctgaagaagaaagctccatgacttgattctgataatctgatttaagggctcgcaaacatacataccactttgttgattctgatccatgatgcgattacttctctacttctcatgtgatatgtttcatcaatcaaagagtagtacagtatttatttcgatctcttgataattcacaaatataaatatacatcagaggaagttaattcatggataagcaacagtcagtgattttttgcggtacaagataaaccctacaacgtgacagaaatgtacttcttctacaagtaattattattactcaatgtaatcacatttaactcacaacagattataccctctcgcttctacatgcatatacaattaccgacatgaaatatttctaagtattatatatatcctgtattcatgtgcatggcagaagttcttgatatattgcttttgacgcttacgaaagaaccaaaacgttcttgccatgccgatgcaggtgatatatccctcagttcctagcctcattcataagctggcaacctttgcactgtattaagtttatttgctgcatcgacgttgaaggtcgaactcagatccccttatgagtttcaaagatgtacttcaaatgcaacaaaccagaagggattgatatctgcaagtagcaagatttgtatttaaaagcaatagatgatgctacacatccagtaagttggtaatggatcctgacaaagtcctgtacatactacaatgacaaaaactatttggtaacttaattttaatgtctttctttgttcatgcacagactaaaaaaagaaaaggccaaccccgagaagttaacaaaaactcagtcatgattgaagttggaaatccatgtaataaccataaacacacctcctctcacaaaaagaaaaaaaaccataaacacacctcggatcaactaattttatgaaagttgatgtttggacattctagatctgagagctacaaataaactcgtgctcatgccatatctcacggtactacagatccagatatgaccgacatatcagacctaagttctgagttatttgaaattttgaacagtcatccaagtcatagtatctaaattccatgtcacaccaaataccgtgaaattgtttttgggacaataaatctactatgcagtgtgtgggaggttattgagaatatggtagctgtcgttaaactcctatcaaaagaatatgttactgtcctcacaaaggagtcataaacaagataaagaaactttctagaatgaacatccacaatatctatgctaagcttagtggcagaacttttctattataagccatgtaacatgtatatggagtagttggacatctataatatccttccagctatcaatatcaaaatgattatgcatcttgttagtttgcagaagaaaataccgtaccacataggcaattcaggtgttgtaaacaataaacagctttggaatttttttttgtttattgtgtgcgtatatattcttgtttattgataccaacatttacgaggagcatttcttgtctaccaaacttcagaatggtgcgcttttgtccaatcgaactgatatttttataatcctaattgaataaagcatttggagaaactcacctgcaaatatttcctttggtgattctctagataactgtaccatctggaatcaccgcatttttaagcactaccgttatcccagaacgaatgtagaaaccctctaatggtctctctgcttcttgcacattctgcattcacacaagcaagggaaaactcttaggtctcagcatttgaactgtaaacttaatgactaaagaaaaactgcatatatatttaatagcatagacaagcaagttgcaaaagctgctacgatgaactatgtgcaatgaaggccaaataggttgaaagagcgctttagtagattgaatgaattttcctcccaccattcttatctaaggagatatgaggctttttttttctctaagtagacattaacactaatacatactttgctacctttccaaaaagtgcattttttccttgctcctgcgatacatacttgttacaaatttcgaattccataaaaccaacatgctcaatgaagtgaatgaatttaatggagtcatcttatcttcactaaacggttgtggaaatgagcttgcaaatgttataaagatcattgcaaagaagaatccagaaggctctcctagacaatgatactaagaaatagtcttatgcatgggggtcatacctgtgagttcataatcattacattctttccaattcgagcattcttgtcgatgatacagttcctgtatgtcaaaacttagcattacataacaggcaagttaccaaatacatatatgcatcattgctcatactgaccttattatggtgttttctccaacgccaactggtacttttccatcagacaattcagaaaatctctcagcttcagtctgatagtaatctgcccccatcatcatggtgtcctatacccagttgattttctttttgttaacgatattgaaataattaaacatccattgttcaataaaaatgaaaaaaaaaatccattagaccattaccaacatgtagggtacttagtgattgcttcagcataagttggtatgactaaatgtactttctgtggtttaaaaactatgtgcaaatctttcatggttaagggcataaatgccaacaaaactaggggaaaaaactcgcatggcatcaataggacatggcgagactgcagtaaatgcaggtattgaagaaaaaaagagaacactgtgatcaagggaaaataaatggaacttgcaacctgtttcctgtggttctaataatgttaatgataatagaagctaaaataaatggattgtatccaaatggccaaaatattagaaaaaagactaatttatctctggtttatctagcattgggatttgggaaacagtattttctctttaaatacaatttccgaagattgttcgtgcaggcttagttcctaagattctgtattggtatgctttcatccatctctgcctcaattatttgaatggcaaacttatgagttccaaataactgtcaagtacattgaattatgagtattcaacaattcaccttcagctgcacccccggttctaatcttgaacggacaccaataacagagcgatcaacactacattctgttagaaagcacccatgggaaactatagagttcagaacctgcacgtaaatggttagatcaaaaaaagctgctactgaaggtataaccaaagaaaccatctctaagagaatctgaccttgcagttttctactttcgttggaggtaaaaatctaggagatgtgaatatgggcttcacaggatcataaaaatagaagtttggcgactacaaagaagataactgaatttagataaattgtccacgcacataaagatatagatggagatgatgttaactaaaaaagtaaacctgatctgtgagagcaagatttgcctcaaagaatgactttattgtcccaatatcttcccagtaaccatcaaatagataggcctgtcaccacagaacaaggaatattgcattcatattcagggttttgtgaaaagtaagatcacatgctcattttgggatttgaagaatttctaacggttgatttatgacaatggaatttcttgcgtacatacagtttgaaggattatgaagttgtaaatacctgcacattgtagtcttttgcagccattgggataacttctgacccaaaatcattcgctgtaggataatgtcctctaaaagatacagaacaaagagaaagagtatcagcatacctcaaactggcaagaaaaataagaaccaaggagtgcagacaatcccaggaatgctatctcagcaaataaaaccaacagtatgtcttatcatatataacaaaccatttgttatttttgcacatttgactttgccatgcatcagaaaataaagttacagaaaccaaatgcttgatatagaagataaaactacaatgcaactggaacatttatttatcatgcaaacctagtttccaagattaaggaaagcattgctcatgagatattatcattagaatttaccttagtcttaatcattagcatttaccttagaagtcttaacaagatatcagtcctgaatacatatattcccattgaagccatgtatttgcatgtatctgcaacttctgggcgcaaaccaaaagttcccatatctagttgctgcattaataaatatcttagattatttaaaaacttattcgttagagccaataaatcaaggaaattgagctaatgataaagaaataaagaacaaatctccaataatctagataacattcacaaaagcaaaacaaaagccttgtgaataaaaccgtggatgatttaacatatgcaattaaaggtgatggaatgcattcattttacacctttttcaggtaacaattcagtttaaacatgtgtaaacaaataatttttagtattcatttgtctttgattcagtgaagaggcatataccattgatttcaagctttcatccttgggcttttcgagaaaatcagtaatgcgtccattcttgtcagtcttcatcaatccaaaatcagaagctcgactgcaagtagatgacacaaattttaaaaaaatatgagaggtgtatgtcatcatctgacccatcaattaaatatggaaatccacgtgtattgtctacttgttaatttgcaatacaatattatgatattcacaagtaatattgatgattagcgtgacaaaaagtaaacttctaaaactgtgaagaattacagcatgtacagtcctgctaactagctagaataaagacagattaaaaaaaagaaaacgattcagatagggcaattatgaataacctctcatccacaggaacacaagcgactgaaatatcagcacctttgtcaacatgcttctgcaaaacaactcatcatttagattttttttttttacaatactcaaataaagtgcaaaaataatctttgctctagaatatcaacatgaagttcacctggacaaagtccatataatccatcctatacagatgatcaccagatagaattagtatgttctctatgcgtttgagccttgcatccttgtaaaaaaatcaggcaagttaaaactgggaaagcgataacatcccgtgataagagtacaatatcatgagatgacactagacaaacctcaaatagccacaggaactgcctgacagcatcggctgttccctggaaccatcgctttcctgattcccctgttgtctgggtagctgccagcacctacccaacaatcaaaacaaaccaccgtagaacattatcaattagagatcaccgacccattgccacagctgcatgtttccactcgatttcacctcataacaaacactaatcttacctccacaaagccatcaccaaatccaaccccctcgccaatgttataagtgcgcgcgatgtgacggttgagagactgggagttgaactgggtgagaacgtagatcttgttgatcttgctgtttatgcagttgctcatcgggatatcgatcagcctgtaacatcccccaacaggcacctgacgtaccaagaacatacagctcaatcactaatgatgtaagcatctcacgattcaatcaaccaatagtcaatggtgtcaatagcaaccgaaatccccactattgcacacaaccaatgaaatgcttatcaaatgcatgacgaaatgtgcgtgtaaacactgtaaagaaaggataatgtgatttgattaccgcgggcttggccctggtccgcgtgagagggaagaggcgcgtgccggcgccgccgccgaggatgatggacgccaccgtgtccggccccacgtccctccgcgccgccgccgccgccgctggctcgaccgcatccgcctgctccaccttggcacaccaaaacacaaaaccaaaccaatgaatccgcacccaacgcacaggagatcagctcacgcaatcccaacacgcacgcacgcgcgcacgcgcgaacacggagctagccagccacctaccttgagccccttgggcgcttcggcgaggacgcagctggcggcggcggcggaggcggcggccgtgcggcggagcgcggcgacgcgcgagcggcacctggcgggcgggcgggggggcgccgccgccgccgtggtggcggcccacgagcaggtcgccattggcggacgcgggaaggttctagaagggcgaaggtggcggagtaggagaggggaggggagagtggtttgatcgaggaagggggggttttgcaaggggaagggcgcagatcgggacgatgggccgagaagagtggggaggcgcgagttacgagggcagcggggtgggcggtggggaggtgctttgacccggccgcccctcgcatccaccgtccgttttgcatcctgacatgcaggccacatgtccccgaactacgaggttcacaaggttcttgcacatacggtactcgctccattccaaatttaagtatacaggatttgtgtactagatttattttagaaagaaaagaatatataatttataacttttaatatattgttaactgatttttttatgtacttcctgtatactccctccacccaaaaactcaatttctaaatttgaatttcgtcctataaaaaaatcaacttcaatatcatatctacccttaacatataaaacgataaattttatttctttaataccctttgcctacctatcaccattactattttttttcatattgtcaaacaaaaaatacttatgtgggggaacggtagtagaggtggcgaggatttggtatttttattataacttgttaaatttgaacttgtatattcgtgaagtgatatgtttcatactaatttatcacctccatcccaaaataagtgcagccgtgggaatccgtatccaacgtttgaccgtccgtcttatttaaaaaaattatgaaaaagttaaaaaaaaagtcacatataaagtccaattcatgttttatcatctaataaaaaatactaatcataaaaaattttaaataaggcaaatggtcaaacgttggacatgaacagtgcaaaactacatttattttgagacggagggagtatcgtactaattttataatttgttaatgattatttatgtgacatgtaaggccatggccaacgctccacactagagcgtggtctcaccattcccgacgcgaatattcgcaccagctcggccgggatcgtgccctcgcaaagcgttgcaaccctctgcagagcgtcgcataatttcctcaacttttggcgaggaacgggtgaggaaccgcattggggagaggcatcgctccgtaccgtagcccagggacattgcaatcaactacctccacgccaagggtgaagaagacgaggaggtaggcggggggagaagaagatggggcgccgccacgcctcgatccgcctccaccactcgatctgccgccgccgtgcctcgatccggcgccaaggagcggagaggcgccgctgggaggggagaagaggggagagacgccgctgaggaggggaggagagctcgagctagagagagtgaagagttcggctggtgaagtgggatgacgtaagaaggggattggggtgtcggtggggaaaagagggagggaggagagattttatattaatttctagattttagggtgtttaatataaaatttggatttctatataaattgaaaaattgtgaggaataaaacaaaaaaacaaaccaggggctgaaataaaaaatacgagactgccacccgaaataaattagctttttgggtgttgccccatcctagattgcaattgagggtaacccttgcgttggccatgccgtgaagaaaccagggataatctgctcgagagatgaaaaccccatccctcaactcccacttcagtagaggcagcagcaggcttcccgtgtacacgccgacatggacggcacccaccatcgccgccacgtctgtttgaccgccggtggccggatcgtacacccgaatcacgccgcggccgtgctctgaactgccgttggcccacacccagaagacgaccctcccgtcgtcgacgagcaccaccgccggctccgcgctttccgcgtcccacggcaacggcagcccgagggcgtggtatggcatggtcaccgtgtacagcttcgtccaatgctgcggcccaaccttgccgccgtcgccgtcgccggcgaggaggaaccataggtccaggacgccagctcggtggtcgtcgtgggccaccaccaaggtgcccctcagctcggcaagggtgacggtgacgtcccaggggtcatcgtggtctccggcgggccaccgacgaggtccggtcgccattgctccgcctcaaggtcaaacgccgcgatccagtctctcctccatagcctgtattcatagagcagcacgaagtaggcgaccccgccgacgacggccgcgaacctgcgtgacgtgctgacggtgtaaggctggctcggccgtacctccctccacagcgcgaggcggccgccgttgacgctgtcgcaggcgagggtgaggaccgagcaggcctgctgctcgccgtgcttcagctccccatccttggtgatgtgcatcaccttgtactcccccgtcgatgcgatccgcgcgagcgtgacctagtacttggtggggtggctgatcttgtagtcggggacgacggggacggcgccggacaccgggtcgagcacgcggagcagctggttgttgtcgacgaggagagccacgccgccgtgcgtggacacctcggccggccggtcgcacctcccggcgcaggccctcttcacgatgtcgccggaggacgcgtccacgacgtagacgtccaccagctccctcccataggagttgagccggccgcggacggcgacggcgaggtgcggggccgggtgcctcgctgcgtgggcggcggcgaagaccgggtcgcgagacagcagggcgcgccacggccggcacacggcatggaggcggcagagcggcctcgctgggaggcatagcaggacctagtggagcagatcgaccatcaggacgccgtcgttggacactgcgacgacggggtagtcgccgccgttagctcgcgatggcggtgccattgccatgctaaggtttgtgttagagtatatggtagttagagtcatattaggatagttagagtatatggtagttagagtcatattaggataggattgatttgtgtggactccttccatatctgtaatccttccttatctcttcctcatgtattcctatatataccggcccctgaagctcattataatcaatccatattacacagtatatctctcctatactatccaatatggtattagaccgcctccgctgccgtcgcccccgggagcgagatcgctcccgggagcgagatcgctcccgggggcggccacccttttcttttcttttccttcaagttgttatgcttcatcgacgggatcgattttgatctcctcggccgcggcctccttcgtcgagtgtacatcgctgtcgtcgtcgtcctagaggagatcgatctcctcaggcgttttcgtcatcttcacttcatggcctagcaccatcgcgtcgacctccatggcctagcagatcgcatctacctccatggcctagcaccgttgcatcgacctcgccgccggggggatgggcccctcgccggcgcgtgccgctccaccggccggccccgagctcctctaccttggctgccgccggcgggcgctggatctccttcgcgccccggcaactccaccctccgccgccagcacgcctcctcatccccatctcgggtcgctgccagcagtggctcgtgctcttccacaaccttcgtgcgtggcgcgggtcatcgtcgggtcaccgacgctgccctgcggtcatccgcgtcaggcgccggagcccgccgctcctcacggcgccgaggtccacgggctaccatccaccgggttcccaccgcagacgccggtgtcccgacatggggggcttgtaacgcctcgattttcgttcggggttaaaattcattaaataatatattttctagaaattaaataaaagttaaatcaatttaatcaagtgaattattgggaggaaattagagaaaattaaaatttccattaaaaatcattagccaggaatatttagtaatattctttgtgtcctaaaatacactccggatttttccgcgaattttcggagctcaagaaataattttaatagtacaaagatcatttaatcaattaaataaaaagaaaacaaaattaaaatccccttcctccctttcgggctcgggcgaaaatcctcccctccctccttctttcccctccggcccagccgcctccctcccctctcctccttgggccgcttgacccgttcgctccctttccctccaaagtccacatacccccagccttctcactccctctctctgacaggtgggacccgatgaaccgccccgccggcaactgccatgggcgccggttccaccccacgacgccgctgtttccacccacctcctccactcctcgcgcacgcgctcgtccgtgggacctagccgcccacgtctccgctcttatccccctttcacgctcgcaaaaactggccgccaactcccccatgatcccacgccgctcccccactccgaccagcgattccgcccctcccggcctcgatctccatccaccgcgcccataaaaaccatccccgtgccctcctctcgagtttccccctccttcctgagcttgccgtgcactccctcgctctccccacacgccgccgctcaccggcgtgctccagccgccgcctcccgccgccttggccatcgccgcgccgtgccactgccaccatcggctccgccacgccgagccacacctcggcatctgctctgcctccctgtatccctgtcggaaccacctctgcaccgcgtacccgagccaccaccgccgttcgctgcctcagtagcccgccaccgccgcttcaacctccaccgtgacttgccgcttgcgccattgacttcgccgtcgcaagagcaaggccggccgccactttgtttgcccagtccaccgccggagcaccactttcgccatcgatccgaggtcgccacctcatttgctgcctccgatcgctgattcccgccgttcccgacctcctcgcggtacgccgtcgcctccctcggccacgcaaggacgagagcaccctcggccaccacctcctcgccgccgggagccaccgtaatcgtctccccggtgagtctcgccacaaatgttgtgctcggctggtgttcctcgccgtgccgcgatgcctctccctcctctaacccctcctctttgcttcccaggtcctgctgacctcggccgcacctccgccgcggtcgggagtcgccggagcgccgtccccgaccccaacccgagaagcgccaccgccaatcctcgtcgtcggccgccttcccgacttcgcctcgccgtccccgtcctcttggtgagccccctctcccttccccgctgccacccgtgtgtgccgccacatccagcgccgctgccgcccactgccggcgaccatcgggccgagcgccaccgctttccggccggctgccgccgccctgctcgcccgtggctgcccggcccctttgccgcgccgcgcctgcccgtggccgttcgatcgaccgtcctagccgatctgggccgtccacgtggcctccctgtgccgccccgcgtgggtgctctcgtggcgccacctccgctagcccgtccgccatggccaccacgaggctgccacatggtgcgcccgtgggcaacgcgcgcgtggaccgagtccaccgtgcgccgacctcctttgagccactgacaggtggggcccgcttgtcggcgccacctattcccctcggtgacatcataaaccattttaattgcgcaataaatcggtaataattctataaattcatataaatggctcaaaacttctaaaattcatatctaattcatacgaactccaaattgggccattcaacttgcaaaattcatctaaaattgagctctacatgtttgtttactttttatgtactgttttcttggtttttattaggttttttttcttgttttgcatgccagcgtgtagaatccgtcgtttcggaagatcgcgatcgcgaggaaaagagttcagaagattgttgtgaagaagcaaggaaagtaacacattcctcttgagcatgttgatcccaatttataaatgttttactgtttgcaaataaatatgcatcgttttgctaattacatgggatcagggtttacctatctgcttgcttgtccttcgtcaaccttgggtgataaatcgactagcttgtgttactttgatgacctagctagaactatatgcttagccatgcttaattaccactagctcagttgatgggataattacagtattagacattttggtatcagaacgagctgcgtgctcgagacacccggccatgttttattggccgtaattatccaactaaaatgcgactgaatggtgggctgtgggtgcatggttttgctggtcgcacccatagcaattaaggaccggttcacgggatgcactggaagacatacaatgcttgccacaagcgggaatgggtaactgcctgacttgaagtatagctcttctctggctgacgcatctaagcaatggtgggcgtgatggagcgggatgggccctgcgacggcctttgtcgcttccagattcacctaggcacgagaggggactgctcgctgcctgctgggggcggggtgaaacctaaggtatggtgtgcttggtcagagagggtaatatgaagggtcttgtcacaatcacttgacatggtgacgcctccggccgggcacggtgacatgctgatggattgtgtcttgtaggtacagttgtgcacctctggccagagaaactattcgaatagccgtgcccgcggttatgggcgatcgaccagaatcaccgtgattagtctcacacttaataaatcgactcaatgcactgtagttcatatgggttggttgggcctgttcaacgtgatgtagcattgatcagtggagatttaatgttaccttaattaaccaactgttttactgttttactcaataaaatgttttacaaccgcctttatgcaaatagccacaagccgttcttaaatccacttgcacgtctgcatcattggtgtggtttgctgagtacggtggttgtactcagccttgctattattcccccttttcagaagtgtagtgcttctgagttgaagacagagttagatgaccaaggctcagaccccagttgagttttgcctgtggagtggagctgaagccccactaggatcgtctttttccactgctgctgctttcatttcggtgtaaggattaagtgcctcttctgtaagtatttatgtttagaactgtatattacttaccgttttgtgtaccctggctaattcttggacaggaaaacacaaaatagtctggaaatttgggctaaattttagagtgtgacagggctcacggccgccaccgccgccagcacccatcgccggcgtcctctccatccgccgcttcgagagacttggacttgtcttcactgccgccggagggagtgcgcggctaaaccagagatcccgtcgggccacacgccatctggcctagggccctaggctggcctctacccgttggctactcggctcctgcctcactcgctctctctgcagtctgcctatctgtttctctttcctgtcatcttgcacgtggttagcaaacagaagagagagaagagagaagagagagagagaagatgggtgtagactgtagagggctcgttgaccggcatgcatggagatggagggttctggtcttcgggacatggtgctaccgtgctgctgcagctggtgcttgtatttgtgtgtttttttccttattagagatcggatttgcgtcgtccaccgtctcgtcgatatctgcacatctccgatataagcatagactcggcttccacttcgtcgtcctgccccgcgcatcattgacttgatcacccgttcaagcgctcggctatgacgacaccatgttgccggtcattttcgagtacgtctactacgctatcgagcttcgggttgcggctgcgttgccccctcggccgcggtgccactgcctgcggtccacaccaccactagttgttgtagtgctgagaggcgccctcctcagcatggctacatcaccggcggacttctcgccattgcatcgacatggagttgtagctgtgttgtcctctcggaccgcagcttcgcagctagcgtcgtcttcatcgccattcgcgcatcaacaacctcgccgtccgcactggttatcgtcagccattcagggtcttcttcctctacttcgagcatcgccgccgtatctccaagttgccactgtcgccgctctaggccggtggtccagctacctccaaatgcctactgacatcgccgtccaagccattggttccgctacttcgccatcttcttcgtctagcatgactcatcgccagcgtcgccgtatcttcctcgactacacttcgctcttctccggcaactgcgtgctgctccagcaattctccctctatgctgttctcgcgccgcgaccgtcttggaggccttctctgttagtctcctccgacattggcgtatggttcatggtggtccctgccttgcccgtgcggtattggcaacaccggcgcacgcattcgtcccgagttgtcccggggtctgacaaaccttgtgtgacgtctcgtccttcacggtttgactacatcggctcttcggcgtcatctatctcaatgactgcctcgattgcgtcaccgtcatcgtcttcagcgcgtcctcgtgcacctcactctacggcgccccatgcgcgctctgtggctcggctacttcgacatcagcttcctgactttggctacatcgaccacggctactctacgcatggctacctcgaccacggctccctcacaccctacgctttggctacgtcgactacggcacaaagggctatcatccgtattgagcactcttgccggtttattctccagtccaagtgtctgcgctgcttggacttctttcatatctgtaattcttccttatctcctccccatatactactatatataccggatccctagactcaatacgatcaaacagtttgcctttcatgaaaaagggatctcgtgcgccctccttataacctaacacaattcggtcactggaactgattataaatcctaacgcaattaggggtgtatttttgtttaacgaattcagctagtatctctttttttttcaagaagaattaaactatttctaatggtttttaaattgattgttatttttatggagaatgaaaagatacctgacgatgttccgtccaagggagagaaaaacgatctccctcgtgttctggctttagaggattcagattaagagaccccctagctctttgataatctcattttgttgggaaagtgattccatctctcgttctgtgcatgccacctaaataatcatcaaaaagtttgaaaaaatttggcaacatagattaatatgaaatatgtcactctacaaacatgcaagtttaaattcgactactacatgttataacaaaaataacaaatatagctgcgaagtttaatttgttctttttgatgtaacttgtagaaattgaatttggtcttgtatgtttgtgaagtgatatatttcatattaatctatattgtcaattttttaataattatttaaatgacaatcaaacaacgaggggatatcccatcgagggatgaaaatccacatcccattttgtttgggataaaaagcatacagcaacagtgtcttgatatttgaactttcaataaaagatttgaagaaaatgttaactatataaaaaaacaagcctttataattactaatttttatttccctcgttttaaacaaaaaaatatatttttttcacaatctggtgtgtgcagcatgcagagctaaagggtctcacggagatggcatagttgctctcttcaggagcaaaaatcataacttccaggagtaaaactaacgaatattgtttttgtgtgcaaccttgtagccattggaagatacccgggccttaccttcctcctctgcgaaacctgcagctgtactcgtctccaagggcaagaaatacgtgcctcacctggcctggcaaaaaaaaaaaaaaaacctcaccaagcacgcaacactgcctggtccatccaaatccagcatcgtgttgatggtgcaagacagaattaatcacaaacgcataagtttatatacaagtagacgcatttcttcgtaagaaaagaatctggatttaattttcgctcagtgttaaattttgaggtgaagggaagtttactggcttttatagagagaggtcagactggaataagtagattgcaaggcattggattttgttcagtggtgtcactagtctaactgtcactggtggtgggaccgaatatggaaaatggcaagatttggtggaaaaagttcatgcagaaccaagtcaaagcttccatgcacatatgattgtaaattatgttatcatggaaattgcaatgcagatgcttgatgacattatttctgacaaactctgtcttccttttatctgactgcaggcataatggacattctactcgttaagcatgtgtttgattggagggttttgctaggttgggttgtggccatcttttttttttttacagctgtttggtttcaagactaggtgggttggtttggtttaaaaaaatgttgagttttactgatcaccaaaaaatgaccgggccgatcgaaccagcttcccgctcccaccccctctaccatgcatttttccccatcgcatcgctccccaatgaaaaatgtaggcggcggcggcggcggcgcaagaagcgacagcaaccacacgagtgcaagagagagctaacggcgacgactcgtggccccatccctaattcgtccccccatcgctgaaattcagttggtcaacatcgtcatcctctcgccattggctgctgcggcaaaacaagattcggtgcccccatcccctaacggcatcgtccatgtcctcctctctactctgcaactgctcatcctcgcaatctcagcgacaaaggtaaggaaaccctagcatgaaaccctagatcttgctgaatttatttttatgagatgattgccccttgttgtgaaaaggaatagttgaagcaattaattcatagatgattaattcactcttgaaaccctagatgattacctattgatgtggtattttcttgtcaagttattcacggtagatttatttctaatgtgagcaagtaatctgtgattatatgatctatgcttgagaagagattttttttttgctttcctttgattattgtaatgtagatggataagaggaccaagtttttaatttttgctgctgcggcaaatatattattgtagatgatggccatgattattcaatctagaaaaaaaagagaggtgcaaggacagaaggtactaaatatggcccattggatgaaagggatagaatgagaattgagtacctagacacaaaaatttggagaatgatataacttgtgtcaacatgcttagacttagaagaaatctttcttttgattttgtaagctgtttagaaatcggggtttgcttgaggatattatccacatgtgttgaggagcaggtggctatgtttcaaaacacagcgggggcacaaccttagaaataggttaattcgcactaattctgataggtccagagaaacagtttgtcattatttcaacaaagtacttcatgttattggtgagctaggagatgaactaatcccccccctcgttggacaaccccaactaaaatatcagggagccacacatgggatccttacttcaaggtgtgacatccatctgtgtctccttttttgatttttagatgtaaagatctctgtggtcttgcaaataactcaagttcagatcatgataccgaagatattgaaactggaaatgaagaggtgaattatgggacaaccactattgatcttgatgctgaaacatcatatgtgagcaagccaaagacaggctaaaacaattgaaagtgaagatgatgtgctgattagggcattacctagtgttagtgaaaagctcgccgctggtatagtgaaagccggtgagccagtcaatacactgccagcaagtttatttgacaccctgaaaagccttcctggttttaaggacaaccacatatctttctactatgctcatttggtggccaatcctcacattactatagcttttgatggtcttccattcaaaaacaacctacactgggttgctttgttcattagtgagaaatttcctggatcaatgtagggttgtcggatgagttgtgcagttaatttgctattatgaaatgtgttgccagtgggtaggcattatatgtaagacttgaaagtatgtttaaggcaaggaaattatgtgtagcttctatgcttgaactgccactatgcttggactactatgtgtaagacttcaatgggctattatgtgatcagactttaactcattatttgtgtcttgaacttcctatgtatgtttatgtgtgattgtttttgtttttgattctacaatatgagttatgagtgagattattgttcttccacctaaattatgattgaatggatatatgtgttgtacgtatggtcagaaaaaataacatggtttggagagccctatgttttgctgtaattagaagttcataattgttgatcattttgtgttgatctcggtttgaatggatgcatgtgtcaaacggtcctattattctctatttttctgtaatcagaaggactgcacatcaattttaatcttgtgttgagcaatcctcttgtgtcatgatttatcaaggatgatggcactagcaatatttcagacctaagtcttgctcctgcatttgaatgacgggtagagaaaggaaaaatgttctcatcaaagacaacatccctagaaatataaacatgacttgaagatatatcaaggcatttaaaacctttttggcgagtactaaacccaagaaaaacacattgtttggagtggaactaaagtttgtgggtattatagtggtgaagatgaggccaataagcacaatcaaacactcttagggacgagtctggttttcggttgaacaattatgagataagtagccgcaacaaaagcttcatcccaggacttaagatgcattgatgcatgagacaaaagagaaagacccacttcaacaatgtgatagtgtttccgttcagctaacccattctgtcgatgggtatatatgtggacaatacaaatgatgatcgattcctattttagagaaaaaggaattgagcatctattactctcctccccaataagccggcatggcaataatttttctatcaaacattcattctaccaaggcttgtaattctctaaacttctcaaaacctcatatttatatcttagcaagtatatccatgtaaacttactaaagtcatcaataaaactcacgtaatatttatttctcccaacagactctagagcaagtccctagacatcagaaaacacaagttcgagaggagattaagacacactggtaaacctaacataaggtagctaatgactcttcgctttttggcaagcattatacacaaactgattggctcactcatctaagcattggagatttttttttactagtaacttgcttgacaataggaagaaatgagcgacctaagcagttgtgccacctggatagagatagcttgacggctccaagggcttgtttgttggacgaccggccaaaggacttagtgatcaaacagagaccatgcctacatctccctttaaccagaatgtccttcgttacctggtcctttaaagaaaataatttaaagtgaagctcaaggaaagcagaattatcagcagctaattgactagcagaaatgaggtttttctttgcttgtggcacatatagcacattattcaaatgaatattatgactaggggtatgaacagtagtatgaccaatatgactaatatcaatacctgcatcgctagcggtgtgaatctgctcgccgctgttgtacttctcctttgtgttgagtttctccagcacaccagtgatatgatccgtaccacatgtatcaatataccaatttgtatctacaacatatgaattagtggctgaagctgctagtttttcatccgcaacatagtcctcatcaaagcgataccagcagtcgattgctatgtgttctcgcttgaagcagacttgacaggtgggacgcttgtccggtcctcttgtgccgtgtcctcggctgcgtccttggccaccaccgtgtccttgcgacgtgcccctgtcgctgctgccggagttgttgccgccatcgtgtctgccaatgcccctaccgcaatttgtgacaaaaggcagcccccccttgactggtgttgcggtaaaggtcaagtagggtttcatagttgaggagttgagagtacaactcccaactgtcataggtttagtctttgtgcacagagtggagacgattggactgaaatcttcatctaatccggtgatgatgtactggactagatcctcctcatcaaggggccggccacctactcccatctagttgccaagggccttcatcctggcaacgtactctacaaccttcatggttcccttcttggtgttgatgagggcgagccaagtgttcactgacctcgcgcgagtgcaagaggagtaaatcttctcaattgctcgccatgcttcagtcgctgttttccacatggcaacttggatcatgacatcccttgacagaggcgataggaggtagccaaaaacttgctgatcattggcctttgttaacgccaacgccaacagtatactcagctcaaggtcagtatactaatactaacaaaccttatcttctagaagctctattgcatgtataggaaactatatttcacacatatggtatggaacttcacattagtgaatgcccaaaataaaaggaatattccaagaaaatattaattaggtcatattgaaagaaattctataaggatatcacaaaacatgcatgtgtatgtggtgtgccaaattaaggatcatataatgacaagatttataagacgatcagagggtggaaagaggtatcatatgaagtaaaacaagaaaaaaaggtcgatctaggtagatgacgaagcctatgacctttagggcgtttaacttattttattaagtagattaggcaacttgacttgatattgttgctgaatatttgtactccttccgtttctaaatatttgacaccgttgattttttagcacatgtttgaccgttcgtcttattcaaaaacttttgagaaatatgtaaaactatatgtatacatataagtatatttaatgatgaatcaaatgatagaaaaagaattaataattacttaaattttttgaataagacgaacgatcaaacatatttaaaaaagtcaacggcgtcaaatatttagaaacggaggaagtacaggcaacaaatatcaagtgtacgtatatgcaatatttttagaacatatttgtgctttctgaaattaatgttgatgagttatgttctttgtttgctatataggacactaattttgcgcttgatgttggtctaacgcttttgttaggagttgatgtttggtaatttaaccatgttctgagagaaaaaaaattcatccctccgcccagggaaataaaataaaaatgtgcgggcgtgcgagtgtactaagtacacaaaataaagtggacggaggaaaaatacattttattataattctcgaagaattacaaaaaaatacagaatccttggtcaaatacactccacggcccataagcaaggtggatctgacttggcgattgtgatctcctggttcccaaggtttcggaagacacccggttaattactctcgcgggttaaacccgtgagatacctccgattaagctacgctagtcatcgtcgtctgtcttcgcttcacgttctctcatgcatgatggtgatggtggtgcaggtgtgtgagtggcgccggtggtgttcgcggcctcgtcggtccgcacgccggtgttggtgacgtcgtctagatgtcgactccacccgccctgccattttagcctcataggttttggatggcgtgttggtttatattgttgttgaagatatgcatggaatagtgtagcctggatgacccgacgacgtaggaattgcatcggaattacattataaaagtaaaatgatcaatgcgaatgatagccgaattggtcatggctgggaagtttaatacgcagcagccccaaatgagtatgaatctgcaaactcatttttgcttgtcaccatgtacagtagcaagcatgcatgtcttgttttgttggctcgtcaccgtatacaataacatgcacaagtcagtcagcatccgcgacatgggacggctcagcagcgtagcgccctggcggctgcctcgactccctttggcgtgctctagtgaggcacaatgacaaaaaaccttctccggcgagcagcggatgatgacgagcatcgcttggtagcgttgcgtcgtctacggactcaggcggctcggcgacgacgcgacgtccccggcaactccgacgagatggcttacgacgtagctggagctagtgacgccttgcgggcaccgagtagtggcactccggccggcgttctcctcgagcaaccagctgatgagttcgaagaagatggtaacgtcgacgagagcgagcggacgtcagtgatgtcgcgaagaggaggctgcgaccgggaaggtgacaacgtccagcgtctcggcgacatcacaaggcgtcgtgggatagaggttgcggccggcgaggcaaggacgtcgtggcagcaggtagatgtgtcaccggcgaccgacgtctccgatgagagggagtgacgcgatctccggccggcggtgcgtccgacaggcggagaggacgctatatccggcgggccgaacagcaccagaaacttgcctcgtcgccgtgttgtgcatgcatgatgatctgaacagaaagagcaggaaaacaaaagagaactaataagctgtacccatggcaatggctgggtacgtgctccggcaaccgtctcctcctccgcgcgcctcctcgccggacgccgaggcactgcggccaacgtcaccgaccgccgagcgcccgtgttctcgctggacgccgagattctccagccaaaatggtgtgtgtgtctctctctgtcacttttgtatgcgtgtgtgttctgtctgtgtgtgttcctccgtttctgtgtgtgtcctcgttgtgtgaaatggcatggccttttatagtgaagaaaggcggttccagccagtacatgcatggctcgatcagtgcatgcgtgatcagccaattgcctaatttagcgattagcatttctttccatatgttctgtgattcttccaattaacagagatccttattcagcatgattccatccgtgttacgccgaccgatctcctttccaagttggaatgatacagagggatcattttcctcgtattctcgtatatacgcgcaatctgtccatggtgaggcatcgataagaaatcaactgccggcaaatgatttgattattgccctctaatgatgatgctacagtggcatgcttccaaaatcaatccaccgtcgtttcttctttccgtcggtgatatcgcttagccgtgctgccacttattccaccatctattccaggcatatgtatttatatattctatcccggctggaatacattatatatatatatatatatatatatatatatatatatatatagagagagagagagagagagacgtgagtatattcacgcctgtacattaattgggcagcactgcacgtgtcgtgtcatataacattctcatgtacgccagattgtatcattaatgatgattaatcactaattttactattgtactgtcattcccggaattaatattttgacgcaccccatttcttataaaataaaaaaagatgtacaaaatatcatcgaacaaacccaccagcaggaacaggaagacgagtcaaccattattttaaaacgagaggatgacgccggttaaaaagctttgatacaggacctaaaagctttgaaacttaatttgaaaatttcaaatctgagttgaaaattttaaaatatgggtcgaaagttttaaacttgagttgaaagtttttaaatttgaattgatttttttataattttgaggtaaaagttttaaaaattttaaattgaaagtttcaaattcttagttgaaagtttgctctttttttaaaaaaaattactttttttgaaaaaaataatatataaattaaattaaatggatgtagctttcttaaatggagattaattaatggatcacgctggattaaatttcatgcatgagccagctactgatcggaatatcggatgataaatttctcttggtcttttgtgtccagaagttttttttttgctgattacattgggattgggatggagggagtactatattgcttcccatcccacaatcacaagttttgtttaacatcggtatattttaataaaatataaatataattctcgtctgatatccatcgagaatcaacgggacatatatatgcttggtgtgagatcaacttgtcacactgatggaatgcaaaaataaaacatgaatgggatattattgtgcttggtgtttcgagaattcccgatcatatatcacgtactaatgacagaaacaaaacatgaaacgaaggagagaaggttaattttaaccccatgaaaaggaagacttaacttatttacgataaaaatacatatacgtttatgactagggttcaccaccataaaaatggtccgtacttttattaatttgtgatacaaaccatatatgatagatacaatcactacaagaaatataacattctgcgacgaattcctcgtgacatcggagctattcatcattagcacattccatttcatgactattagtatgagatggggtggcttagtgatgaaaaaaaggtgttcatcgttaataccaactagaaatcatcataaagtatttcaatgggacattgtgacgaatattaatttgtcataaggggcaaaaagcaaatgtcaaatatttatataatgcatttctagaaaaatatattaaaagttgaagcaatttaatcaggtgaattaataagaaaactaaattttcctttaaaaattatggccggaaatatttttgtaatattatacgtggtctaaattattctctgaaattttccgtgaattttcgaagctcaataataactttaataccacaaagttaatttaacctattaaaataaatggaaaacgaattaaaatcactctctctgtcctcgggcctttttcggcccaagtgttactctctcccttcctcagtcggcagcctctctctccctcctcgggccggcttccccttcccctcctcctcttcaggccgccggcccaaccctttcgttcctccctcgccgagaagtatattttgcctccttcctctcaattcaaataattttttaggtactaaatgatttcaaatgaaaaaaaattatcaacaacaaagttgcataacttatcaatatctaaaacttctgttttggccattttgttatatgactttgtttcaataatttgaatttaaattttaaattatgacaatttcaaacaatattttcaaatactaaatgatttcaactgaaaaagtcatcaacaacaaagttgtataactcatcaatatctataacttttattttggtcattttttcatccgacaaattgatagtaacattatttacaaaatttatatatcccttatagtttataaaaccatataacagatataccgtaaaaaaaagtccgtacttttatttatgataaaaaccatatttatagatacaaataatgactacggactctcttattcagcatatattgtacgtaatatatgtatcttaggtgcattcatgcatatagaaacggatcctctaacttagtacgctctctaactaatatgtaggttcttaattataccgaacccatatagtattagctagtaacccacgttagagagcagtttattagaggagactcgatcggcttaacgtagctagtaggggcgctccccgttaatgttgccacgcgggttgtagttgcaggcgatcagcgtgctgctgcgaccgttgatgttgcagccggtgacgcgcgcgcagccgatctgggtggtgcggctccacaccacctgcgtgtagtggccgcacaccttcccgccgacgcatttgttgctgctgcgatcgtagtacggcttctcgcccacccagctccccatcgcgtccgctggcttcccgacccagccggcggtgctgctccacccccaccacaggttctcgccgtagggcccctgtatgtggtccgtccggcacgtgctggcgtgctcccgggccttcgccgccaccgcctcgctccacgacacctgcgccttgacgccgaccgcggcccgggcgtcgttgtggagcttgacgaactgtgccttctcggcgtccgacaggtcggcggccatcgtcgtggtggtcgccatcacgatggtcgcaatggccaccgccagagcaaaggcagctcctttcttcggtacacttcccatggtatctccgaattcacgagtgatcttagtcctgctcagcttggctagctatctgagactgtatgcagaggtgatgattaacgcttgcattaggcagtatttatactaaatgagtttgctctgcatgcatggatgcaatgtctctaatacaataattcatttttgctctatggttcttacggaaagatatacctcgtgccggtatatggatgtagggcacattggttcaactcggaaaaacgttatatgcctatatgttgtcaacgagaaaccatcaaacgtttcatgatcgacgaccatatataaatgttactttcatggttgagatttagcaaatctgttcattcaacttaacaatcttttttttaggcaaaattggttatatagcatcgaagttcacgttttttgttttatagcaccgaaagttaccggttcactttaatagcacccaaagttcaccatgttcccatttttaacacttctgtcaattctcgatcattttccgtctgtgttgatccagccacacacacgatatgacgtttctacccctcacaagtataagtataatgcatgtcaatgaggggtagaaatgtcatatcatgtgtgtggctggatcaataacgatcaagacggacgaaaaattgacggaagtgctaaaaatgggaacatggtgaactttggatgctattaaagtgaaccggtaactttcggtgctataaaaccaaaaacgtgaactttcgatgctatataaccaattttgcctttttttattaacttaacacatacttaactagctaggttcatatccaccagcgtcatcctctcgttttaaaagaatggctgactcg

SEQ ID NO: 37686 - DNA, 47870 bp, Oryza sativa
  unsure (1)..(47870): unsure at all n locations
ttaagttgaatgaacagatttgctaaatctcaaccatgaaagtaacatttatatatggtcgtcgatcatggaacgtttgatggtttctcgttgacaacaatttttttagagaagggtattttttacccgacctctatatccaaccgaatatatacggctattaaaatagggaacttaaccccgcaaacaacccaatctgaaattcgctccataggagatttgaactcaggaccttggggtactacatataggcatataacgtttttccgagttgaaccaatgtgccctacatccatataccggcacgaggtatatctttccgtaagaaccatagagcaaaaatgaattattgtattagagacattacatccatgcatacagagcaaactcatctatctattatatactaaaagtccatgaaacttcctataaatacttataagccaccatgtatcgctcctataatcactcctaaaccaccaagtgacactacgaaatgatttttctttaaattggtgggtttaatattatcagccattagatctaataaaaaacaaaattcccctctccacatataccgatctcccctctccggttggtacgtatgtacgtatacgtacgtaggtaactcctcccctcatctcttttttcctttcctaatctccaatctctaatttaagccacatatcttattttttattgttattttaattttgacaaaataagtaatttaatatctatgttgttctatgcgccatatgctttatatggcaactagataaaacaaggaaatatttttaactataaaaaagttaacagcatatattattttactttaagtaattctacaaacaggtgtctctaaattatatccactatatccaatctatctataaaagtccatcaaatttccaataaacataactaaataccatgtgacgcacatataaatgctcctataacgccacgtgacgttctaataaattagataaaaaaaacaaattttcactaaaacagctagctctaataaatttctgtttaatcgttctctcattataactaaattaacaatataagattcatatgcctatattttgctatataattatagcatttgggcacagttcacctgtgcactttgcagccatctaaatactttaaagtcttacaacaaatattatatcactatgaatcattctacattctataaacatgcatagctaaattaaatctatagtatcgaaatagaaataaaaaacatattcaatttgacaatagaaaaagaaattgttgtcgaaacgacaaccgcatacgtcgaaagacgtggttactcaacagtggttggaaaaatgaagtgtattaaattttgaatttcacttggggatcccccgcgtttttactaccagggtttaggttgtacaggggaatttacatgattacccttatgaaagggacatttacaggggtacataatgtcatagggctcatgggcccctgatgggccgtctggcgatcgtcggcctgatgggccggaggggcttcctcagccctcgcgggagcgaacttgtcaaggcgaagtcatcctcctttggcagacagtcttcgccttgcacccttcgcctgagacgcctctggcctggcgctactcttcgccttgcgccgttcttgctccatagccttcgccatgggtttcagtaggttgggtcgaagggcctcatgccacccgccaacaagcccctcacgggcaagggtgagattggagcttcggccgagactgtgcaaactatgtggtatggtatgcggcgccccctttcgaccgatgctcctgccgaaacctacattattcctgcaaatgaagtttgttatttgtgcggctggtattatcttgccgcgcttcgcctcgtgggattgatagttatatatattcttttttcctgggccgaacggaacagtattgggccttcctatcttgggctttttactgtgccgctcggtcgatggaatttaccgtttcgcctacccttgcgatacgtgacactttattactggtaggtaggcgaacggtcgcctgggcgggctatatattcccgttgctctttccttttcaccgccacacttgccattttaccgtgtgcgctttctttctccgtctcttcctttcacagcatctttcgacccctcaggcgtttcgccgaatcacttttttcgccaccgcaaacggaccgttcgccatggccctccgtaagccaaacccctcttcggcgaaagggccagatcccggccgagtcgacgacgacagcaccgcctttctggggatttctcttgtgcacgacgtcgagctggagaagctggtcagctccggagcgttggtcgaggggcaggctttcgccccagggaaaaccgtggtgccgaaacttgtcgacaatcggacggtggtgttcgccgtattttttgaggcagggctacggtttccctgcaacgtgttattgccggagatccttcgcctcttccaggtggaacttccgcagctgagcccgtcggcgcttgttcggatcgctatcttcgactgggcgtgccggacttccgggtttgagcccaacgccgagctctttggcgccatatttttcaccaccgtgaactcgaagacggtgatcaccccggctggaacgaaaaaaaccgtgttcgggagcgtgaacttcaacgtttgccccgagcggtctgatctctggccggtgaacgctgctatgtcgaagtgggtccgccattggatggcgaggtggttctaccacaccatccccttcgaggctggttctgaatcagcgaaagctctccagtgccggcgtagggcaattgcgccgaaccggagacccaagatcgctgtggacgacgccatggaggcgcggttcgttctactgcggaaggtttgctcccgccttagctgctgtgacttggtggaggaattttgcatgcttcacatttttcccctctcccagtcatggcaagtcacggttgaacaaggcgaagaagtcgacggtttgccgaacctgatactccctgagggggcgaacaataagactgttcttatgttatataatgttgtgctttgttatttcgccttatttgacttttgacgtagcttcacgctctacttttacagtgttgaccctcgaccaggccgaagccgaagcccgcaggatgatcggcgatgtttcggtcgtcgagtatagtcagctgttaacgcgtcaagcggctgggcgggcgaaccgggtttacaatggcgaactgcctccccgggcgaatccccaaaaggccgacgacgaggcagggccttcgcgaaagcggatgtgtggacaagtgaagcttgcccccaagaagcgaagggttcctgcttcgtctgactctgacgccgacgacgaggatgatgccgaagaacgtgacggcgaggaggaaggagaggaagaggaggaggtggaggctgtggctgataaggccatgggtgaggtggtcgaagaccgcgccgacacccctgggtacactcctaccccaagtcctggtcacaacgaaaccagggtggagtcgaacagctccccccttcgtcggaaggatttggaaggggcgaaggccttagttgcgttctcttcgggagtggcggcgaagggaggccctgtcaaaaaggtggctaaaaagaaagggctcgttgatgtcgctcgcgtttttagcgacgacgagtcctccgacgggactccgacttcgcccgctggtcgcagccaggatctttcggccgcccccattcctccacttggcgccgctggagtggacggtagtaccgccgttggggcttcggcttctgcggaaagaattgcgatggccgcggcgaaagtattcggcagtcctccgcatcagccggtagcctcgccgctgatggaggcgaagggaaagggagcggtcgctgaaacgtccgcttcggaatattcgctctcggtaccccgcttcgcccctggcgacttcgcgacgcgagcggacctccttccttttgtggagggggtaagcaatcttgtactgcccgccagcgccccgagcttgttcaccgaactgaatgagttcgacgaggggtgctctgctataaaaagcctggctgttcgggtacgttttccccctctttttatctttactcttcctcgatcttgtttctacaattgacacttgttctcttcgccgctcgtattctgcgcccagatcctcgcggctcagtgctcaacagagcaaaccgtgcgagctcgacttgatgggttcaaaagccgtcttcgggccaaggatgacgaactaggccgcaagaatttggagatggaggcccttgccaacacccttaaggaggcgaaggccgaaaacaagcggattcaatcggaactagagaaaggaaaggaagctagggccgaagtcgattgcttaaaggccgaactggagaaagagaaggcccacaccgccgtgctcatagatgtggcgaaccattgtatattcggcaaactgccgctaaacctttaagaaggcttttttgcatacttggactgtatgataattttaaccactttttaacgatcaaagtctttggcatattattattttgctcattttgcattatgccataccttccccttctttcgcctattcttaccatgcaagatgtgttttgccttttctgcactgtctaccagggggtctgccgaaaatcatgcattcggcccccttctgggagctggcgaagtcaaaacgagaaatttgtggcattgaaggatttgccgaaggtacgatgtccatttcggcctgtttatcgcgaaatggaaataaacggtcgcagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcattgttacagtttagtctgtgtttcaccccctactcctcttaaggttgtgtatgatattagtagtgatgacgaacctagttcgtccgaccattccttagggagggataatgattactggagcgaaaatgtaacttacttgtaaaatgaattgtatcaggttgtaaaccttgtactcttcgattattttttcgaagctaataaagaacgtgttttatttccttttcgctatttttcacatcatcacactttctgcttttgttaggtcggaacatgccggcccctttgcatatagtagcgaaataggtgtagtgacttttcagcttttcgtcgttcgttttcgatctgtagcgttctgtgtcgagagaaacgcttttgcgtttatgctgatcagtcgtaacgtcgttcggctatttattttccgagacaagctgttatggtttcaacgttcggcgagcaatgcttcggccgattcgtttcgccccctagcctttttcgctgatcaggcgtttgccttggggtttttccacaaattatcaatcacacgaaaagaaataaaaagaaataaaaagaaggcggaggagacagagatttttatactggttcgggcctccatggtggataatagccctacatccagtttttttttctcttctcttttttcctttttttttcttgccgaaaggcttacatagtgccgaaaggcttacatgacaatatgtacatttttacaagttggcgatttgggtgccacccattctagacatagaagcgcttgagggaggcggcgttccaggaatggtcgaactccacgccttcgagtgtcgctaggcgaaaagatcctgtcctggacttgtgtttgatgatgtatggtccttcccactttgattcaagcttgccaaccgctactaggttcgcctttttccttaggacgagatgaccaggcatcaactccgtgggtcggactttttgttgtaagttgccgaagtgcttgtggcgtacttgtgcatgtgctcgagcgcttcgacccttacaccttccaagagttcgagtgatacctcgcgcccctcttcgcccccggagaacataacccttggtgagttagcccctagctccgctggggtcattgcctcttcgccataaagaagcataaatgggctaaacttggttggtcttgtgggggtcgtccgaagggcccaaagaaccgataacaattcttctagccatttgcctttcgccgccccctcaagtcttttctttagtgcttctaggatcttgccatttgtacgttcggccgccctatttgactgtgggtgcgcgaccgacgcgaacctgatttctaggttaagcccttcgcacatttctctgaacttatcagagtcaaactgcttgccgttgtcagtaatgaactcttttggcaccccgaaacgacaaacaatgtttttccatgcaaactttggtactgctgccgaagtgattgccccaaggggttcagcttcgatccatcgagagaaatattccacagctacaattgcgaatttatactcgtttcgcgccaccgggaatggcccaataatgtccagtccccatctggcgaagggccatattggtgcaatgggctgcagatcatactggggcgcggcttggcttcggccatggcgctggcaactttcgcacttcttgatttgctcaacacagactttcaacacagtgggccaataaactccttgtctaaatactttggaggccactgttcttgcagcctggtgcgcgccacatagcccctggtgtatttcctttgccatttcttcgccttcggcaaaagagatgcaacgaagtaagggttgaagtaccccggagcggtaaagctgacccgagaccatcttatacttcgtggctctgagttgcaaacgcttcgcttctgcttcgtctaccggaagccagccagtttcaaggtgtttcacaaatggggttcgccagtcatatgggtcttcacccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttttggtctctaggcaagtgttcgaccgttatgccggtgaagcatttttccatggaccgaacagcctccagataccccttcattccctcttcttttgcctcgaaggatttgtcaacatggcctgctaccaacttggagtcagttcgaattagcaggcgccggactcccagtgctttcgcctttcttaggctcaggagaacggcttcgtattctgctgcattgttggttgtgtcgaactgcaatctcgctgcgtaccgaatcggcacaccattcggtgaaaagaggactgtcgcaacgcctgccccattgtgcgaccacgaaccgtcagagcacatcacccagaactggtcgtcgggctcggggtcgggggcaagtaccggtgtccattcagctacgaagtcagctagcacttgagacttgatagcagagcgtgcaacaaaatgcaagtcgaacggggatagctctgccgcccacttgctgagccggccagtgacttccttgcctcagagtatttcgcccaaggggtactgtgatgggactatgactttgtgggcctggaagtagtgcttgtgcttgcgcgaagccattactagagcgtaagcaagcttttccatttcaatgtaccttgtcttcactccttgcagtgtttcggagacgaagtagaccggtttctgtccggactctttcttgaacgagtgcagcactgactgccactggcgaagctgccaagtataatagcagttcgcttcctgggggtgggcttatcagagctggtgggctttgcaagtattactttagctcgtcgaatgctgcttggcactctggtgtccaattaaactttcccgcgccctagagggtcttgaagaagggcaaacctctttcggccgcctttgagaggaatcgactgagtgccgcaattcggcctgcaagcttttgtacttcatgtacgcttgacggaggcttcatttgttggatggcatcgattttctcgggattcgcctcgatgcctctttcggaaacaaggaatcccaacaacttgcctgcgcggacgccgaaaacacacttctccggattcagctttatgcctgccgcgcgcaagctgtcgaacttctcctgcaggtcgatcgcatggtcgaaagccttgcggctttttacgacgatgtcgtcgacgtaagcttccacattctgccccaactgcttgccaaggaccttgtacaccggcctggcgaaagttgctcctgcattccttaagccgaaaggcatcctgaggtgacaaaatgtgccgaatggagtgatgaaggacgttttggggatgtcgagcgggttcatgtggatctggtggtaaccggaatatgcatccaggaaactcatgagctcacatctagctgttgaatccacgagctggtcgattcgcggcaaggggaaatcgtcttttggacacgccttgttcagatctgtgaaatcgacacacatgcgccatttgccatttgacttccgcaccagcactggattcgccaaccactccggatggtcgatctcttggataacccccgcccggagtaatttttgtacttcggccttcgccgcttcttggcgatcggcagacatcttgctcaacttttgttttcttggcttaatattcagcttgactgctaggtgatgcatgataagatccgccgggacgccccccacttcatcagggctccaggcgaagatatcgatattctttttgagcacctctagtatgctctcaacttcttcttcgcccatgtcgcccccagtgatacgagctttgtggggtcggcatcatcaatctgcacttttgttaccttgccgtgaggggtgggcttcggcgtgtgcttcggccgctcatgcggttcggtctcaacattgtgcactgctctgttgattatggctagatcgcgttttgaagcggacgaaggctgaagccccttgactactatcacccctcttgggccaggcatcttgagcttgagataattgtggtaggaaatggcttcgaacttgttcagggttgcacggccgaagatggcgttgtagttgtatgggatgttgacgacgtcgaacagtatttgctcttcgcgcctgttttctcccgagccgaaagctatcagcaaaagtgcttggccaagaacttgcactgcctctccgccgaacccccggagcgacgttggtgccggtgtaagagcttgggttggcaagcccatcttagcatatgcttcggcgaagatcacgtcggccgaactccctccatcgaccaggattcgtcgaacttcaaaaccggctatctcagctgagatcaccagtggatcttgatgcgggaacaggactccttcgacgtcttctggcctgaaagagatcagctggttcatgtactgtggagccccctcacccgctgaagtgatgctgtggaccatgcggatctgcatctttctctgccgtttcgacaactggcttggtgggtcggctcttgtaatcacttggattacccttcgttgtgtatcctggcgttgttcggctgggggtgtttgctcctgaactgcttcacggggtgcttcgaaagttgccccctgctgcggccttgggtcttgcgcgttgccacgttgcctaatgtttcggcattgctccgtggtgtgcgaagagcgtccgtgaaaggcgcagtagaggtcttttcggaccttcttgcgggctggctgctgatagttgcttgcttgctgggcatcgaactccttgcggagggcttgcacttcttcgacagccatcacagccttgcccgctcgatctgttctgaactttctccaagtcatgggggcttggccttgccttggcggctatccctggatcgccggctgagactggcgaacagagaggggaggtggttcggtaatttgagcttgcacttgagcttgagcagtggcgacggaggctttatcgtactcagcttgtatagcttgtcgtcgcctagaatcctcctcgccccttgcgaacccgtcaataatgcgaagtaggtgctcgagcgtctgcggctccttgttagtgatttttcttgttagttcgccctcaagcagaccagccgatgcggcgtttatgaccgacgcctcggttatgtcttgaacttggcaccgggcttgcgagaagcgacgcatgtactcccttatcgactcccccggcctttggcgaatgccgagtaggtgttgttgcgtcttcggctcctcgtaggtgcctcgaaagttaaggacaaaaacatcgcgcaaatgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcctgactagcgcgggatgggtgggaacttgaactggggtggaattggacgagtcttgattcccccactcagcggtagccccttttcgcctcccgccctgtttacccaccttgctgcgggtacggtgtggcgaagggcgaaatcgcagcttgtacgtgaggttgggccatggcgttcggctgcccggctccaactggaggcacttgctgagccgctatggatgggtcaaaaattggctgcgaccacgtcatggcagcttggattggtacttggtttgttccgaagcctggggtcggagcttgctgccgaacggttggcgcctaagcaacgttggcacagtcgaactgcggtccctgattctacggcgaagctcccgagcctgactgaatcggtggcaaccaagtaggcgcaccttaacttgtattccccaccgggtgagccgatggggttgtacttgaaatgtagtagggttggttgagttgctgaaggaaagcttggtgttgcgtctgcagagctgaagccccttccgccactgtttgtggcacttggccaggtgattgatgctgcccggtgaagtacaccggcacctgtgcggcttgtggcggaaagggctgggtcgtcacttgcggatggacttgaggttggacatagcctgccgaatactgaaggattggagccgacgtggccttgacccgccttgccgcctcgtatgcttgttgttgttcttgcatttggcgaagcatgtcttggagccgtgtcatgttgtgccgcatagcctccatgtcggcttcggcttgtgcttcgaggtcaaggctggtttgggcctgtacaacggcgagcgcggttgtggtcgctgccggctgtgatggagcagcttggggcaccaccggttggcttgtcgaaaggatctccgccatggtctggagtgcccttgccgccgcagccgccttcgccacgtcggcctcgttcggctcttgcaccgaagttgcaggggccgaaggcggttgtgatggcgcttgtgctcctccagcttcggctacgggcgccgaaggctctgctccttcctcggcggccatgtctggtccggcatcgctctccgttcgcctggcaaccttctccttcatgaccctcttcggtggcattcgctctaagtggttttgctcggagtccccacggtcggctccaactgttgtcgaaacgacaaccgcatatgtcgaaagacgtggttactcaacagtggttggaaaaatgaagtgtattaaattttgaatttcacttggggatcccccgcttatatggccctaggggactatttatagccccattacaggttcttactaccagggtttaggttgtacaggggaatttacatgattacccttatgaaagggacatttacaggggtacataatgtcataggggctcatgggcccccgatgggccgtctggcgatcgtcggcctgatgggccggaggggcttcctcagccctcgcgggagcgaacttgtcaaggcgaagtcatcctccttcggcagacagtcttcgccttgcacccttcgcctgagacgcctctggcctggcgctactcttcgccttacgccgttcttgctccatagcctacgccatgggtttcggcaggttgggtcgaagggcctcatgccatccgccaacagaaataattcaacaatacaagtcacaccatgatctattttgaaacatgtatagctaaactcacactatataagcaagaataactagctgaaatatagataatctgagccactgcataagcaattgagtgcctttaactaaagaaaatattatgtttttttctaaatgtgctcaaataatccaaacaatctaaatgatcttctataagttttgattaatattctgcctttataagtttctcaaacacagtctacgattcatgcccacgcgaacgcgtgggctacctttcttgtttagtataaatactgcctaattgcaagcgttaatcatcacctctgcatacagtcagatagctagccaagctgagcaggactaagatcactcgtgaattcggagataccatgggaagtgtaccgaaaaaaggagctgcctttgctctgccggtggccattgcgaccatcgtggtggggaccaccaggaagatggccgcggacantacacaagatcctcacattttttacggcatatctgtgatgggctttagcattggtcagtgataagggtcacctttgacgggttctacgggacgcggtcattggtaaggcatctttttccaaccggtccaaggtactaattacctgtgacggttccatagtagaaaccgtcaaaggtgaggtaaatctcacctctgacggcttccacatccggcccgtcttacctgtgcgggttgcatccttataaatcgtcaaaggtgaggttaactcacctcaaacggacccatcactggagcccgtcacaggtggggaggggggctgactagactagtagatggagatatgtactcccttatccactctctctcttatccactgaaacaaaaggacctctctctctctcccttatccaaactcacagaaacaagaggggaggctcttgcggcggcggcggaggacccgacggcccccgggagaggcagcggcgtggcgacgacggcggcgccgcggcggtggttcggcggcgttgggcgacggctcagcggcgcgtggcagcggcggtggtgcggaggcgcagcgtcgaggtggtgcggcggcggcgctgggcggcagcggtggtgcggaggcaaagcggcgaggtggtgcggcggcgctaggcggcgagcggcgtcggcggtacccacatcctcctcccccttctttctcccctcctcctccttctcttatttccgatctggtgcgtggctcagcggtgcgtggcggcggcgaggaggtgagcggcggcgccgcggcctcaatccccgaccgccgacctccaggagctcggggtcactggcgccaagctcgagcgacgacgacgatgaccaccgacgacaaccgctgagtctgcctccaggacgcggatctggcctctaggacacggatctggccgccgacgcctcccccacctcccggccgccagcgcctccaccctttcttccccgccgatgtggtcgatatggatgcgcacctccggccgacgagtaccgcctccaaccgtctggcctcgcctgccgcgagctttgcttccccttcgctccggccggatgcgcctcccaccaaagggtgtcgccgcctccacctcccgaccgtcgatcgccatgactgccatccctcgctcgccgatcgccagatctgtcaccggtgtgcccctctcgccccctatccttttgcattgatatgatattgttgtctctgcattgagaaattcttgccatcccctttgtgtgaatacttctatatgagatctatcggtttgaatttttttgtgtgataatgaatgtgagcaaagcagctgtgagcctgtgacaacgagcaccaccacagcagcgtgcaccattgttttttgtttgtttttcacaccagtgacgggttgcacgctatttcttttttttttgttgggttaaagacatcagtgacgggtcacaaaataacaggtcgtttgagataatagtacctgtgacaggtttgatatgtggttcgtcgcaggtagccttcaccactgacgggccttcacccgtcaaaggtgatgagagtaatcagtgaccactaatctctgaccagagctatatccgtcagaggtgacagtttgggcccgtcactaatagccttacccagcgtagtgcgacctgtcggacgccgagaaggcacagttcgtcaagctccacaacgacgcccgggccgcggtcggcgtcaaggcgcaggtgtcgtggagcgaggcggtggcggcgaaggcccgggagcacgccagcacatgccgcacggaccacatacaggggccatacggtgagaacctgtggtgggggtggagcagcgccgccggctgggtcgggaagccagcggacgcgatggggagctgggtgggcgagaagccgtactacgatcgcagcagcaacagctgcgtcggcgggaaggtgtgcggccactacacgcaggtggtgtggagccgcaccacccagatcggctgcgcgcgcgtcaccggctgcaacatcaacggtcgcagcagcacgctgatcgcctgcaactacaacccgcgtggcaacattaacgggaagcgcccctactagctacgttaagccgatcgagtctcctctgatgaactagctgctctctctaacgtgggctactaatatatgggttcggtatagttatgaacctacatattattagttagagagcgtagtatgttagaggatccgtttccatacgtatgaatgctcgtaagatacatatatattacgtacaaatatatatacatgctgaataagagagtccatagtcattattgtatctatcaatatggtttttaccataaataaaaggaaaaagtacgaattacgagtctgaactatcgcggtcgaccgaattacccccctaaacccgaaaaccagacattttacatcctgaactttgaatactggacgaatttccccccttgacccaatccagagcggttttgtcctacgtggcgtacgcgtggcaatccagtcagtattttctttaaaaaaaattagtgggacccacctgtcatatctcctccccacctcttcccaatatctaccggggacatgcacaagagcagcagctgggtcaacggctccggcacggcgtccgccagcggccgccctatctgcggtggcctcctgtcgtatctctatcgctagagtgtcaacgtcgatgcactggcctgggagatctgcttagctccagtgcaggtctaaagattgatgagatgcggacgtgccagttagtttaatcttgcaactgacaaaatatgtaaacagtagataaaacaaccgattggctgacaagccaatggagtaattctagccaatagctgatattagccgatgccgataacaaccgatgtcgatagggtttttagcaatccgctatatgtccaatgtagataataatataaagacaatcggctgatgataataaaatataacaataatatagtccaatagaaaccaatcagctaaaaataatatgataggataagtactgatccgatagttaaagcatatatcggctagagattcgatgtcattaaaatcctcaagattagataaacagtaaaacctttgttgcaatcggctaaatccaacttgtatgtaatgcttgtaagccgatgcaacgtccagataacttatcggctagcacctcgataaaacactagcatgaacctatcgacttaacaagatttatcaataacaatctagtaggtcggacctaaccgatgcagcacgagattatatatgataatctaatactcgatgagccgatagatttgtctaatgtgatagatataacaaatctatttataacaacattgtgattgtagagatatatcggctaagacagaagatcggacctaaccaagatagttcctactaaaccgatgtatctctaaacataatgcaattagatatagaattgagatatcaggtaggcaaatatatcaaccaaaccagaccgttctaagagatcgaaagcaatgcagtcttgaataacaccaatgtagccgatagattcaccagggccgaaagaaggtaggacttacccatttgccggagatcgaactgaaccaatgtagccccgcgtcaggtgccaaattccggcggttgataagtaaaaacctcagaaaaaagggtggcgatgcgccgagagtagttgtattgatcgaaagatagtttgtaatgaccccgggtgtacatatttatacccatgggtagatgcttatccttgtaggacaagaaagaaactttccaaaagataaaacgaaaacataaagtccttatatgacactaaacatacttttctaaagataaaagaaaactaacaaaatattcctaattaatagataacttgccatgccgcatcctccttgaactcatgtacttctggataagcttcctttaatatattgatttccttaaccgattatagcaggaatccgactattggcgatatgataattatgttagaggcttaccaaatttcactattaacatctagctagatgacaaagcctataacctttaaggcgtttaacttattttattagtaggttaggcaacttgacttgatattgttgatattgttgctcaatgctggtatataggcaacaaatatcgagcatataggcaaggtttttagaacatatttgtgccttcttaaattaatgttgatgagtgggaggccaaggaatacgatgcttatgttttctttgttggctatataggacactaattttgcccttgacgttggaccaaggcttttgttaggagttgatgtttggtgatttaacccaccagcaggaacaggaagacgagtcaaccatttttttaaaacgaaaggatgacgctggtggatgtgaacgtagctagttaagtaatatgtgttaaaacgagaggatgacgcgagtgaagaggaagatgaaccgttgtagttgaacaggaaatagtcgcgagaagcacatccaaaaaccttattgccaccttctaccggtgcaggatgttgaaggtgaaggttctggagatctgctctcccgatcatcggtgcacgccaataagcgggatgaagtagaccacgagtgatgacgtagtaccaaggaagaggcaaaccctagattaatcaggacgcttgcacgatctccactccgtgtaaccgaactggataagtcacgtgtaacttatccggactccacgccatttcacgcacctgattattcggagtgtttccaaaaaataaatctaaatttcccgcagtaaaataaaactgcaaaaagagactgcatctgcgcaagggtgaggaaccaattttggcggaccattcgacgcgtacatcgtgcacgcgcgcgccatgccaggcgaggagagcatgtctcaagttgctaggagagcatcctcccttataaggaggtttccctctgctagaataggcaaggtgtactaaactccccatgcatgctatcccataaggtgagctttctttatttttctaaagaattatctttgaatgggctaacacccatctattaattccaacgtaatgttggtatataggctgtgacggacgccgtacccgattgagatggggttgccgcccgattgagatggtggttaccgttctagtgaatggtttaagaatatctatacatagatttggacataagacagagaattatgtgtgaagtgctcatgattattttattgtattactgatgtgttagtctctttttatggtattaatacaattccatttatgaaaagggacccaactttcaagacaataataatctgtagtggtgataggtgagtttatatctaagcatggactaagtgatttttttttttgaaatttgagatacattcttataatttagtatatcaaagtctatgatctatttcacggcataagtatttttcttccattttagttaccattataagataatttaccatctcttatggtgaatttctaagatgaatatggtgagataatacttcttttagtgttctctttatcattaaaaataaaatgcccgcgtatcagtgcgggcttccttgttacttaaatttttaaattttttgaataagacgaacggtcaaacatatttaaaaaaagtcaacggcgtcaaatatttagaaacggatggagtacataggcaacaaatatcaagcgtacgtatatgcaaggcttttagaacatatatatatatatatatatatatatacatacgtgtatatatatatatacatacgtatatatatatatatatatatatatacatacatacatacatatatatatacatacatatatatatacatacatatatatacatacatatatagtaaatttgtttggtgctccatggtgcccgggcaccattgttgaaattgagtatatacccaattcaaatgagtatgaaactttttcaattacttaggtattaatattaactactttactaactagttcaaaacaaatttgaactgaatttgaacttgtttttgttagattttgattcttggtatatagcatccatacatataattagttaggtatgtaatcatggattgtgaaataaagttaaatttgagttgttttgttgataggtataagtatgaatcaaattattataactaggtatatactcacaatttgaaaattttaaaaattttgagtgattttgtgcatttgataccatggtgcccgggcaccatggtgccccatatgatatatatatatatatatatatatatacatatatatatatatatatatatatatatatatatacatatatatacatacatacatatatatatatatacatacatatatatatatatacatacatatatatacatacatacatatatatatacatatatatatatatatatacatacatatatatatatacatatatatacatatatatatatatatatgcgcattctgaaattaatgtttatgcaagaagtaggatcgattggttatgttttctttgtttgctatataggacactaattttgcgcttgatggtggtctaacgctttttttaggagttatgtttggtaattaaacccaccagcaggaacaggagaagacgagtcaaccattattttaaaacgagaggatgacgcgggtggatgtgaacctagctagttaagtaatactacctctatatttaaaatatgtatgacgccgttgacttttggtccaacgtttgaccattcgtcttattaaaaaaaattatgtaattattatttattttattatgacttgattcatcatcaaatgttctttaagcatgacataaattttttcatatttgcacaaaaattttgattaaaatgaatggtcaaatgctggtcgaaaagtcaacggtgtcatacattaaaatacggaaggagtatgtgttaagttaataaaaaagattgttaagttgaatgaacagatttgctaaatctcaaccatgatcgtacgtcgatcaagaaaataatgtatgtttgatggtttctcgttgacaacatataggcatatagcgttgttccgagttgaaccaatgtgccctacatccataccggcacgaggtactactatatctttccgtaagaaccatagagcaaaaatgaattattatattagagacattgcatccatgcatgcaaagcaaagcgtgcccggaactagaagccggcaaccgactgatgcatatttgtctgattttgtttacgcttcagttcacctaaaaaaatcttaactagtaagtaactagttgaatggagatttctctcttccaatacagtgtacttgttaatggcaaaattgctccaagcaatattgtttgccttcccatcaatatacaactagaagcatttttagcgatctattccaattcaaacattttgctgcaagtatcatatgattcagcacatatccctcacctctgctacaaacacccccagtaaatgaacaaaaacacacagaaaaaagggagagtattagcttactttgattttaatttggatgtgatacgacgagccccatccacaggttggggattcaacgaaccctagaaaatacaaaaatgaagagatgttaaaaacgaaatcagaaaatcgatgaaaaaagaggattgagagaaaggggtatcgtgcgcaccgactccgccgcagcagccgccgccgcaaccgccaccaccatgctcacgccactctccctcaccggcacagctgacctcgtgcgcaccggcgtcgctaaagtggagtcgtgagcaggctccaccgccaccggcttcgtcaccgccgccggcccaccgccgcagccatgactcaaatgcttgggagtcatttgagagctgtaggtgtctgtttgggagctgctcagatgcttcttcagggtgtgtatctgattcgtgagggtctgtctgatccgtgagaaattgtcctgtccaggaccgaccccaaacggtatactggtaagtagcatttatttatgatgttttagtcataaataagttaagtcttcctttttcatggggttaaaaccttttctctttcgtttcatgtttttttctgtcctttgtacacgatatatgatcgggagttctcgaaacaccaagcacaataatatcccattcatgttttatttttgcattccatcagtgtggcgagttctcacaccaagcacatatatgtcccgttgattctcgatggatatcaggcgagaattatatttatattttattaaattataccgatgttaaacaaaacttgtgattgtgggatgggaagcaatatagtactccctccatcccaatcccaatataatcagaaaaaagaacttctggacacaaaagaccaagagaaatttatcatccgatattccgatcagtagctggctcatgcatgaagtttaatccagcgtgatccatttaatctccatctaagaaagctacatccatttaatttaatttatatattatttgtttttcataaaaagaatttttttaaaaaaaaatgagcaaactttcaactaaaaatttgaaactttcaatttaaaattttaaaaacttttaccacaaaatttaaaaaattaattcaaatttaataacttttaactcaagtttgaaactttcaacccacattttaaaattttcaactcggatttgaaattttcaaattaagtttcaaagcttttaactccaatatcataacttttcaactcgattgtttatatgttgttttattgtaaaaacactaaatacgaattagaaacgatattaatgctaagctagagttagcggcgggagttaagggcgcactgcgctcagagaacatgggccgatttgctttcagggataactgcgtgcaatagaaaggcccatcctaaagtttctactccctccgtttcacaatgcaatgcaagtcattctagtatttcacatattatattgatgttaatataaatgtgtgaaatgctaaaatgatttacgttgtaaaacggaggaagtaaaattttacataatatattaagactttcctccaatatgtatatatatttatgaaacgaacaacttttcaaaacacgagggagtagtaatttctaatgggactattaaaaaaagtattcgacattgaaatttcacaaggcgacagatgcaagcttattttggtcaaacaactaaattcggctagtttttaaaacccgacagatgcaacttctattgcgacatttgccatgtgaacgaggtatattttagaaaaatatgacaacaaatataatataatatggtagaagtagctattagaaaaatgcaaactgcgacatatgcaaggatattttggtcaaaaactaaatgcggctagttgtttgaacccgaaagtgtccacgctgctgacccttgcgcagcctttcaatctccgacgtgaaccgctccatggccgccgccggcagcacgaccggcacggccacaccatcttccccggcgccgttcttgacggcgatcaagtagctcactccataccaagcgtgcgagggcccgccgtacaccggctcgccccacccgaagtccacgcggtggaagccggcgagccggacgtcggagaggaggagcaggttcgccgtgtcgatggccggccgcccacgcatcaccagcgtgtcggccacggaccggacgtactcggcgttcaccgtcttcttcgcctcgcgcacctgctcgaccacgtcggcgagcgagccgcgccgccgcagcgcctcggcgggcatcgccaccgtcaccggcacgcacacgttgccgtagtagccgcggggcaggcggagctcgccgttgttcctgaagctgacgatgatcgccagccgcgcgtcctcgccggcgggggtctcgagcgccctggcgcgggcgcgccagacgaacgacgcgagcacgtcgaagctcgtcgcgcggccgcggaggtgcggcgggagagcacccttgagcgcggcgacgtcgccggggctgaaagagaaggtgcgcatgaccatgtcgccgagggcgcccacggacggcgccgccgggggcgcggcggcgaagtcgttgtactcgcggagatggaacgccagcttgggaggcttgcgcgcgtccagaagctcgcgtgaccacgccggcgagacggccggttcacgggcaccgcgggcgagatcggcgacggcgtccatgaactgcacgatacccgaggcgtcgcacatggcgtggttgaggcgtatcccgaggacgaatcctccgcagaggagacgggtcacctgttcgtccacggatcaagtcaacacgtggacatgtgccatgcatgccacaccattgccgatgcgtgaatgagcaaagatgaagcattgaagcttacctggatcagcagtaatggcgtgccgagcaccgcggcggagccgtccacgtcgaagagcagctgatccatgcacgggaacggcgccctgagcccggcggcctcgagctcgacgacgcggacgtcggcgtccgcctcgacgaacatcacgccctcgccggtgcagtcgacgacgagcttccggccttcaacctccctgagccgcccggcgaacgggtagtacggcaccagcgcggcggcgagcgcccggcggatggtgtccacgggatcagcggccgcggctgatgggcggtagacgaagacgacggggacctgccaccgcagcgactccggatcgtctacgtcggagaggcgcttcgtctcgcggggcgtcggcgcggcgggggcgacgagctccgtcgcgcggcggcgcacggcgaaggacagcgccatggcttttggttgtttggctttgcacctagttatatcaaagctattgaacgtaagttcaaatgttggccttcaagctagcctagacaattaatgggcgttttatatgatgaaacatgtacatgcttatattttctaggccctgtttagttctaaagtttttttctaaacttccaactttttgtcacatcaaacctttcatacacacacaatttttctatcacatcgtaccaatttcaaccaaatttccaaactagcgtgaactaaacacagccctattctaattccaaatgacttttcaaagtaattctcgacaacgcactgccggagggggtagctgaggggcaagcacgtggaaggaatggaggagctggtctacaccgtgtggatggatggtggcggtgcgcgacatggaggcccgacagtggtgcagatgacagggtggtgagagaggttgtggacggcagtggcctgacagtcgcttctctctcgccccctcctccttcccgcatttggcgttgacggcgacaacggcggcagcgggcgacgccctcccctccaccagatccggtgggatgagaggcggtgggcggctgcattatcctcccctccaccacatccggtgggatgggaggcggcggcaacatgcagcctcccaagtgacttcttcctctccctctccatcggccatccactggtggcgcgcagatccggtcggggtgggttggtggcggtggccaagggaggcagcggtgggtggccaaggatttttggcggcgacatcactgatgagttcgtgcatggattgttcttgctcgtgcagttcttgcttgtgtagttattgatggatttgttattgttgacatgtgattgatctgcgttgatctgtgattgttattgaccggggaatgggttggctcgtaagcataagctcggctcggcttagagccggcttctccttttttttttttgaatttaggagagcacaaagatgccggttctacgaccggcaccaatgacactaggtcattggtgttggctggaaaactgacacctatgggcatttttgtagtggtgctgttttttcatgggtataggtcttaggcaaatgataaggggaaaatttaattatttgcctcaaagaatgtgctattctttaaatgccacttctatcattgttcatattcttttaccacaatagccctatgaaatgtctattgtgcccctcatctctctcggccaagtaagagtgaaggcaatggcgcagtagtggaactctggcctaatgacaaaccgacgatatagcttgagctccacccttgatcaccaaagtgccagacgagcaggagaacttatgaatcgagatgggagagcgtgggcgcatggggtggagatggtggaggcaggtacctttcgagcacacagaggttgtcaaagtgatgcatagtggccttctcctaggggacgatgagagtggtcttttgactcttttccatgtgctgctaggcatttagtggtgttattctagttgtcgatgaagagtgcctcgaaccgccggtgcgcgcgtgagccggatgtttgggatgagctggctagcccaccccagtcaccctttggttgtgctcctctttctcctactcttctgtcattttatgggatcgatggaggagtccgggaaatgctttcgccttgttgtcaagctaaagcttcaacactactcaagccttgttgccatgttactaggctcgagctccattgcttgcaccattgtatggcttggccagcgagaagcaagaggcgagagtgggggagatgagggggtacaatgaacattttatagtgctatagtggcacatctttagaatagctccattcgaaaatataacaacctagtattgaattagatacaatttagtactatgaatctagatagggttccaaattcattatactagactatgctaatctaatacgatgttgctatattttgagctgaaagatgtactccctccatacttataaaggaagtcgtttagaacaatgtttaagtcaaaccttaggaatataaatcattaataaccctcaagttgttgagtttgaaaatataaaaattatatgaatatatttgtcttgaaaaatactttcataaaagtatacatatatcactttttaataataatatttttatagaaaaaagaagtcaaagttgtgttttggagactgcgtctctgtccaaaacgacttcctttacgagtacggagggagtactttctctatatctataaaaattcaatcctaactatgaatctgaacacacatgtgttcaggttcatagctagaatttgattttttttataggatggaaggagtactttcttcatctcaaaataagctaatttatgttataatgagacattatctaatacaacaaatttagaatgttttttcttatctaggttggctaacttagtttattttagggtggacaagtatctgttaaaattattttaggctgatctttagatgttactaaaacttgtaagtctttatcacattagatgtttgaacactaattataaatattaaatgtagactattaataaaacccatccataatcttggactaattcacgagacaaatctattgagcctaattaatccatgattagtctatgtgatgctacagtaaacattctctaattatggattaattatgcttaaaaaatttgtctcgcaaattagcttttatttatgtaattagttttataagtagtctatatttaatactctaaattaatgtttaaatatagaaactaaaattaagtttctggatcccaacaccaccgacttggttcgattttcagagagctctgggcacagtcaaaactcaaatccccaatcgtaccattccacacgcttccatttattattcacccgaaacgaccctggccccccaccccccctccctacccgccgcgggccccaccccctgccatttcccaacggaatccacccggccgacgccgggtttcccccatcccccccccccccccgccccctcctcgtcggcgccaccgccgccgcaggctcgccgcctagggttccttccactctcggcgcaaggggcgtagggaggttgagagggagcgagcgagcgatggaggggtgggtggcgacggtcgcgtacacgggcacggcgctggcgtgcgccgcggcggcgacggtggtggcgctgcgcctcgtctaccgccacctcctccactacgccgagcccacccaccagcgcttcatcgtccgcatcatcctcatggtcccggtaggcactcgcctccgcccgatcccctcctccccctctcgttcccccatgcgtcggctacgtccccagcttcgcgttcctaggcgggtttagtttgtggtagctccgatttgagagaggtgcgcgtgtcgattccttgagcaattttggtatcggcggtgacgtgagaggcgcggatactgctgctgcgttgtgagttgattttactacaagtcgatagttaatctgggtcgttggatactgggatgcgaggccccaagcctctacctgtttctcacttctgaacgaacaggtttctattggcgaattgttcaggaagtgattgtgaatctataagttggatgggagtgtatttttttttagtaatgttattgcagctagctaagttattccatttggcatgcaagctgcctgtatggatttctgggattgcggacttgcggtattgtttgttcagagtctatgtgctgattccataattcagtcaaggccacatggttccagctgcgatttgagtgcaagtgatacatcatatatgttggtctgttggtcaatttgatctgtgttggtgtcttcttgatggttgtggatttgaaaggaaaatactattttgtgtttattgttcatctcaaagtgaatttaaccaacaatgtgttggctattcaatggaattataacttgttagggaatatattctgcagttataggcttatagcattgatttaatccttagttctttatgagaaatgcaagtctttctgtttcatatatgcattttaatacttgtagtgaagctacaaaagcttcttagaatgccctgtaatatgcattattttttaatggtgctactattgtaattccaatcctgaatgattctgatatttgtcccatagaatcaaagatgtatgcttgtactataaactttgcttgccaatattcacttatgaatgtaaagtttgctggttcagtttagttgtcattttatttactcatgttctcaacattttatttcattaactatggataaatacattattgtgcaggtatatgctgtgatgtcatttctttcccttgtactacctggtagcgccatctacttcaactctattcgcgaaatgtaagtttgactgctaaccaacccttattttatcctgtacattgcgccagtatacttgatataggtattgatacttacttgtttatgccttgacacttcatacactatatttagtttcacgaatctcaatatcttggtattaagaagatggcaaaaataccaataggtgtcagctttgctccctattgcaaaaagatttccctgttacaaggttgtaaaggcactatatgctagttagaggttcattgatcatgacctcgaagttttttctgaagtttcagggcacattatcgtttttcatactgcagtttctgctaagtaaatagttgcttttgattaatgaagtgcggcctggcattttgcaccaactaattctttttgtccgtaatagaagtagtcagtatgtgattccagtttgttgatcgatacttctttgggtgattcaaggtgtagcattgattcggacattcagtaacaacattttctggattaggatgctttgttgcttcagatccttgatagcctctgtgttatgcatgaaatgtaatcagcaaccacttttttcactatgtatattgttttagttaggggtgggcgttccgtttccttggtttaatcggatcggttttttcgggttgcctggaatttggttttcgtaaaatgtaaactgaaggaagttccagaaaaatatcaaccgagcaaaataaaccgaagaagatcggtttggttgttttgggttcagtttttactgagaaagatctatgccgcacactgcggttgactttccgcaagtatgcacggcctgcccagctctgcctgagggcctgtgcttgatttggagagagggaataggatttggtggatctgttagctgtcatgtattttttgggccacagtgaaagttgggcttgatgcacacgttagtgggcctcgagcattttggattggctgaacactcatctgtttcttcggtctcgtcggttcacgtgagatagaaaccgaagcaaaagccgaacaccgaactacaggaaaataaaaacaggacaatcaaccgatgacccaaaaaacggcctcttcagttcggttcggcttggtttggtgcggttttcagtcttcgggattttttttgcccatgcctagttttagtcaactttgttcctatgactgatcaatcctaaatacgtttatctggttattggtttgctttgttttcattgatgattagaggacacgttttgtgttttgtgcatgcatgcgaacagtatttaatttcatcggtatcaaaatcactaaccacttttttcactgtgtattgttagtcaactttgttcctatgactgatcaatcctaaatacgtttatctggttattggtttgctttattttcattgatgattagaggacacgttttgcgttttgtgcatgcatgcgaacagtatttaatttcatgcggatcaaaaccacagatgcattgttaaaaaaaatactaacagaatgctgtaacaaagattaaagcacctcagcatatttcacatgttctctatatatccaggagcatattacgtttgtcttttatgctacgatttcatacagcttgaacaattacttgaaggtacattatttattttgtgcagtacttttgcagaattccattggtcataatccataagaccacaaaggctttgcatattgattagatgtggtttttattgaaaaatcatggaaaaaaaggctggataaagaatttttcgtaagcttcactataatttcttgaactctcatcaaatgtgtgttggtgtacttacaggcaaatctataaatgacagaaacacgaatgcacttacactgtttagtcatgtttactttcatatgaggtgacttatctggtattgtgtttattgtgacagtaaaatggtattaaaatgttattgagcttttcttcttttctgaattgtgttttagctatgacgcatgggtcatctacaatttcttttcactctgcttggcatgggtaggaggtcctggtgccgtggtagtaagtttgactggccgatctctgaaaccgtcatggttcatgatgacttgctgtttttcagctgttcctctagatgggtgagttctgcacttccatgtttgaaattgcctatggtaactagcattatcttatgaattttgatagtgcaagtgctgatgattgatttttcaatgttcgctacaggcgttttatacggagatgcaaacagggttgtctgcagtttgtgatcctcaagccaatattggttgttataaccttcattctttatgccaaaggaaaatatgaagatggaaattttagtgtcaatcaatcctatctatacataactatcatctacacaatttcgtattcgatggcactgtttgctctagcactgttctacgtagcatgcagagatcttcttcagccatataatcctgttccaaaatttatcattatcaaatcagtggtgttcctcacctactggcaggtaaagtgaagttattaggattagttatttcctttctctatatcttatctcggagcctctggtctgatcaaagtgctgtatagagttgcatttattgaaacaaagtgatttctatcacagaaaccctctttttacttgatgaggagaagtttagtactccctctgtttcatattataagtcgttttgacttcttttctagtcaaaattctttagctttgaccaagtttataaaataatatagcaatatttcaaatatgaaacaaacatatcattaaaatacattcaatgaaactaatttggttttgtagatgatgttaaatttttctataaacttagtcaaagtgattaataatatgaaacggagggagtaacaagttgaagcttttctcacagggcgtcctggttttccttgctgcgaaatctagattcataaaaaatgctgaagaagctgcttatctccaaaattttgtgctttgtgttgagatgctcatagcagctattgggcaccaatttgccttctcgtacaaggagtatgctggttccaatgcccgtcctttcggtggattcaggggaagcctttttcatgctctgaaattcaatgacttctatcatgatactgtgcaccaggtaaacaagatatcgcaatatgacatcccccactctgcccttcatcctgatgaagagtccttcatggcacaatgactccatttgcattatgggcttcatctctgtcttaatcatgattgttcatgtttctttgcagtttgcaccaacatatcatgaatatgtgctctacagtaacgaggaagaggatgaaccgacaaaatatagctctgccagtgttgtgtcaacagtacaggacatacagctggtagaagtctctgtcgtggactcgaaagctccgttggcatcagtcatcctaacacatgaggcagataaaacaatgccctcccatggcatggaagaaactgttgccccttcagagccatacgacctctcaaacttggttgatgtagaactgtccaattactctgctgaggtccctgcaattcctgatgtggggaaacaatgatattgtgtgatatatatccgtcagatgtaaatgggtagcgctcacgagttgttcatagattacactgtaaaggtatccttgtaatcctttgtttctgccaatttttccccgttgctagggacgtgctgatatctttggttcaaattgagctaaactgacagattagctgatggtgtcaagtaaatttgtaatgtagggagaagagaatgtaacatgtttctcagttttgttgttgctgataaagcatgtctggtcaaatgcgttatgtccttatgggtatcgatgcactcctgttacataatcagagtgggtggtttgacctggcaaggagcagatcaaattacatttcataatgtattaatccctttgtcataaaatatatagcaacccaggactcaaatatctcgacagatggtatctagtaatccaatctggacatgtggtctcttgttcagatttgtaatactaggcggtgtctaattaagtactaggttggtatattactatattttacacagaaatttctcgacaggtggtatctagtactccaatctgggcaggagtctcttatctagatttgtaatactaggtgttgtctacttgagtactaggttggtatatttaacgacgaagggagtaagtagtttctttttttttcaagttcatatgcggatatgccccacggcaggattaacacagtagaacgctatgattaaacaggcagcatgcgagtaagcaactcctgcttatctggaatgcaaatgttactgtcgtctgtcgcaaggccaaacggaggtctatatgcacatgcactcatacagtgacaatcatggattcaggatcaaaatggttaccaagcggcactcagggacctgcggttgtggattcttcaggggacatgaggctgcttcatgacagcttgcaggttcatcagttcatcactgcagaagaaattgtctcaaacaggcagataattcatttttggagacggaccatttcatctttggagatgatccttactttttcctaaacaagtttggaagcgctatattgtagctatccagcacaatctataaaagagtacatatttggagacattgttaggcgaaaaagaacacctccagatgctacattatattctcacactaacactccaagctgactaagtgaagtagaagggcacttctggataccattactggctgttaacatcttctaaaaagatctgggcacaactctaagtctctaaattacttcctttctacacagatcatacagtacaaaaacaaggaaatcattcttcagtatctcatctgaagcaggccagcttaacctcattcatcgtcagtttcgaaggattcattccagcagctttcatctgatacaccaccctggtggcctctctgtacattccaccgcgagcatatgccatggccatggcgttccagcacactgcgtcgggtttgccatcaatagcctcaaatgccctggctgcatctgcaagctgcccttccttcgcgtacatatgaagcaaccctgacccgacgaactggttcatgtccaggccacgcttgatggcatcagcatgcacctgctggccatagcatcctttgttcttcgcctctgcacagaccgcaaggatgcttgacagagagaagctgctcctggcaatgcccgaggaagccatgcccctgaagacatcaatggcatcgtcaagaatgccgtcacgatggtatgcggtgatcaagctggtccaggccgcctcaggaactggttcttggcatgagaacctcatcatctcaagcacatgccgtgcgctgctgagctgcccactgtcgcagtacagctgtaatagcgagctaccaacatcgccacagactccatttttcttgacaacaaaagcatgtacctgctcaccgaactgaagctcgttcacccgagcacacgaacgcagcaccgccacaatggcatgggtgtagtgatcaccggtgatcccccgcacttggtgacacatctgcacgaatagctgtaacgcgtcatgatggaagcaaccatcggagtaggccgagaccatggtcgcccaggtgatgccattcttgactggcatttcatcgaacacctggcgcgcagccccgatgtccccgcacgccgcgtatgcaagcaccagccggttggcgaggggcaaagggaggccagagacggcgaattttccggcgatgtgcgcgtggacggaggcgacctcggcggcgtcggcgcagtctctgaggagggagacgtagacgtcctcgtcgggcgggaggcggagcgcgtccagcaggcggagcacgtcgccggcgccggacgagcacagagaagccgtcgcgcccgtcgccggcttcctccttatgtccccatcgtcgtcgctggaggtggtgggtacggggagactgggacgcgggtgcaggggcggcggcggtggtggtttggtgggtttccgcagggccggcagcggcagcgctcccctggcggtggtggcgttagcggcgagaagacggcggcggcggcggcggggagagaggcgcggagcagccgcggtggcggtggcggcgaacggcttggcgacggagaaacgcgccatggatggtgtcgcgaacgggggcaggaatggtgatgggcgcacgcccgctgcaaaacaaacgggctgtttttctcacagcgccagtggctgtttttgcttatcccctgcgcgtgcgctgccagcgcctgctgtagtgctgtctgttgagctgtacgagtggatgagattaagattttcgtgttaagctttttaaactactgaacggtatgtttcgtgcgaaaactttctatacgaaagttgttctaaaatatcatattaatttattttttaagtttgtaataattaaactcaatcaatcatatgttaatatcacctcgttttgcgtaaaaaacttaattttcatctccatctttatttttaggagaaaagaacaccacctatgatagagagtatattattatctcggttccagaatgttccagaatgcaagaatatttagggttggacacggttattaaaaatgttggtagaattaaatggaagaatgttgtgattggataataagtgaaagtaggtgggaaaattgaatggtggagggttgtgatttgttgggaagagaatgttgatgaagaagttgatatattttgggacaaatccctagaggctaaatattgttatattttgggacggaaagactagataagctattgataaaccatgaggtccacttgatacgctcacaactttggtcggcacgatctttcggtgagttgatcatagctacaatttggcgacctcctcccccacccgccggccggcttgtccaatgaggagaaaagtgagagagagagagagagagagagaggtggaagggagaggaggggaaagagatcagatgatgacatggcatcctgacaggtggggcccacgtgggtcccacgctgattcagccgtcacgtcggataaaaccgaggttaaaaccgccgaaggacctaaagtgaacggttttgtaagttgagggatgtcatatctggttttgcggttgggggacgattttataactcgatgacaagttgacggaccttcgatgtactttttcctataggtaacataacaccttgtttctgtgactgtggccaacatggatggaatttggggatgaggatggatccattggaaagaggatcccaagagtttccatcaaatacttacgagtcaaaaacggagctcgtatgcttggcagccgtttgaagtcaatgttgttgcaggtggccgaattagattcagaacttctacaacttgatctttgatatcttctagttgcctatgatgtgaaaaatggttgaatctatcgtagccatgattacatcagctataaggttatctctgtttttcttctcatctctctatctcttacctatacatttaatttattcatctaggaatatgtaaatagctagcttttgtatgagagacaatcctcttcaattttcaaatcctctctcctccacataagtcagttgacttatagcctactattaaactttctctaataacggcctataaaccaattactataaatttatgtgcaggagagaaaaaaaataaaaggtgttggttcttatataagagctagttctacatatgttttaaggtaaatacattaaatgcataagtaagaggaagagaggggagaaaaaaaaagtaaagcttaccttataagggcaatctcaatccaaacactgcaaaacagtttccatacttgccatgtcataaatacactaggtatagttactgtatgccgaatgggtggtgtcatcaaactaaattctcatccaatcacctctcttctctaatttaatccacctattctttattttcgttcttgattcttgtgtagagctggattcttgtatgagaaattgtttcttcatctttttccctcttctcattaactctcttgctatttcaactttttgcttatgtgatagtatatttaatgcttcgacaccagctgaggtggagggttgtgactgctctaagagcatcaccaacagtctacctatatgattccaaaaattgattttgagggattttagtaaaagaacagctccaacagatgccctactctcctacccgagttttgcagttcccttctcccgattcctcgctgcatttatatacgggcgcgaaactcgctcccaatcttgcactccccgcctttctcctcccgttcccgcgcgtgggagatagcgatctttctgcgtatgaaagaaacaaaaacggaattttctgttagtagtttaacataagggcacacttttaattttcgaggattgaatttaggctatctgttggagggaggagttttttcactttctattttcagtttaggaaaaccaaaaaaataattttggggaaagattataggtaatttgttggtgatgttctaactaatctatatatattggctctaacataggttaatagttaggagttagctcgatctgctattaagcttgctctaatacatttattcctccactttatcaaatctcaatgctaattgtttcccactttatctactcccaatacatttattctctacttttataaattgcaatgcaatgattacgggatagagggagtactccctccgtactcgtaaaggaagtcgttttggacagcgacacagtcttcaaaacacaactttgacttcttttttctataaaaatatttattggaaagtgatatatgtatacctttatgaaagtactttttaagacaaatctattcatataatttttacattttcaaactcaataacttgagagttattcatgatttatattcccaaggtttaacttaaatattgtcctaaacgacttcctttataagtatagagggagtacatattaagtaaccgtctgttgagtgatacgagatatttttagagaggtacaatagcaggctataaattagctgtaaacatattttaaggagataaataaggagagagaatggcatcgggctacagatttgtagccagctgcagcacggactccaagacgcagggtgtgtatgacaggtgagaccaggtattaatagtgtactatgtaactattgtatgaatgagctattagattggctatagataaattagagctagtagttggctatactattaaacttgctcttaggtatttacatgttaagtgatttagaatatatttgaaatttttactattgtaaaaatgttattggctggtaacctggtcggtgtatgcaatacattgagggtaggcacattaaaagggaatcgttaaaaaaccgacgcaacctttttaaaaaacttctagatataactatattatatggtagtgtaaatttattgtaatttttatataagagtgaaatacatggccggtccttaaacttgtggtgtggtgtcacttaggtccgtgaacttaaaaattgcacgttttggtctatgaacttggtttaatgtaccacccccggtccaatcgtcctttgactatgtttgaccgccaacgtgatatgccacgtaggcaacacttttgtgctcagccccctccatatatatgttcgcacataacttgccctgaccagtgcattcaacccaaatcccccaaaatatccctaaatcggctagggtttcgatggtgaggttagcggaagaaggccgagaggtagcggttgtggcggcctcgacggtgagattagcggcaaaaggcagcacggtgcaacggggttagcagtgacacagtgcagccggattagcggcgggaagcagcgcagtgcgtcttgcacgctaggcatctacatggattctccaagctcgtccctgtcttgaagtcaccgaaagaaggtgttgttgatcaagtgtccgttgtgcaaggataaagtcattttggagcgcagagcaatgtcaattgctaatcgggacatcattttctatacatgtaaggagaagaatgagagggaagaacaatttgaggatttttttgggattctggtgtcactatataaccacgaggagatatatgtgacgtgttgtaatatggagggggctaagagcaaaagtgttgcctacgtggcatgtcacgttggcggtcaaacacagtcgaaggacgtttggaccggggtggtacattaaaccaagttcatggacctaaacgtgcaattttcaagttcacggacctaagtgacaccaccacataagtttagggaccggccatgtattttactctttatataatttatgtgcaagttatatgcaatgtttttaatactcatatacatattatataaaaagttccattataactcattatattgccgtataattacatatttaaatgttttcaaccaaagattttttagacagtcctgcgtgaaagatggcatgcagaaagtcttttttaagtggcggtcgccttgggccatatcctctggaaatgcacacatttctatatttctatagaagcggtcgcctttggaccaccgcctctaaaaatacacacattttcatctgcttacgatgaccacatgtggaaatgatgatatttatacaggcgggtggtttttggaaaattgtttcctcttggacctcgaaagtaaagaacatatgatgctccctccatccaaaaaactctagaacaaaaattgttaaagtttagatgggaatagtattttcttgagtacctatatatttatgatgttacatttctcatcaaatcaatatttttattttaaagtacatatattttgcactataaattttaaaacttactacttacgctataattttactactgctatatatgagaatttagacaaaaaatggaatgcctcttttaaaaagaacaacatccatcccagtcatgaaatgcatcataggcaagatggtgaggagactacacgctgagtgaatgtgagagttccaggcatggtttacatagttatcgcggttatcacctgcgataaccttatcagtttttaaaatcatggtatgtctcacggtaaccgcacggttttcgtgataaccgtgcggtaaccaccaaaccgtgggatggcagtaaccacccaaaaaacggtttggggaaccctggttccaagttcaactcctatatactagacgcgcatatattcatgcgtaaaaaaaaatcagaagctggaaattcattttcacaagcggctattaagaaccgcacatgaaattgtttcttcatgggcgaatgactttgtaccatgtaaatatgcgattttcacaagcctttgtagatgacttatggggacaacttgtttttttaagtagtgatagattatcagtgttatacataaggcatacccaatagtttttggttgggcttggcagggtccaccatattacaagtcttatacataatcatgacacatatacaaaaggtgttccagagataaggaaagagagacaaaattcggtcggacccggagttcggccaaacttctgggccacctcccgggcctcccctttggtggggagacttcttaatgggccctcaacatcatatactatggttgggctcaatcctaaatggtttttactgacttatgggacctccaatccgtataaacgcatcttgattgttcggaggtgtattttatcacatgacgggtgtgttttcttcataaaatacctacatacacatatttacgaacactagtggaaatgattagtaatagtccctaccactaagttggataccatattttatatcattatatgcaggcattgacggtcggatattataatttaaggaccgtcaacagagatcgaagttgattatcatggaaaagttttccaagtgtatagtacatttaattttcttgtgtcgccaatcatggtgatgcaaccagtattaacctgaaaatggatacaataaaatgcaactctcaatcggagcatttagctgaaatcccattttcgtcatttctcccaactcaaaatgtgtttgccactttttagaggcatcatgaccaaagtgccccatattgggattgattcagtccaaacgggaatttttttttggcagaaacgatcgattcagcacacattaggatcaattcaaaattgtctaaacaagatatcaaagtcatcaaattggatgctttgtgagcaacaattctggatgcaattcagtgatgcaattgattgtgtgagaggcacacactgagctccccccagcgtagtgttgggccttggtagccaagaaagcaaccacaattcatggatgctgaaccagcccaataggatctgaaggtagcagccacaatccaacacaatgctttgtttccgcacttcaaatcttcagatgcaactttccttgaacattctttcaccaactgatgaaaactaagggcaacggagattcgatggttggagcaactgaggaggaaggagcccatgaggtatagcacagtgagcccatgcctcctggtgcctgaccacatccctttccctcttggcgtggcctggttccggtaaaaactgaagaagagaaagagagagacactgatggaatatgatgcagcatgctcgacctgacctgactgaagcagtacaatcagggacattttagatggcaaatattggaaaaaaaatgggaaagccattttaattttggaaaatggcagaaatggagtttcagcatacactcgatgatgagagtggctttttatcgaaacccattagcgggatgtcattccagtgatacccacttttgatgacatcgtatatccaaaattctctgactgaggaggtgtaggggatgagtatctaataggttcctgatcaatgtgcacaaaacttataggactcatttatatgcaatctctaggtgtgcctcccagactagttggagaaagccataaaaaaccatcaaaatgtgaccaagcggaacctaaactaaaattgctagaagatgatgatggaaaacaagagcagatgatgccagacaactctacatgttcaaagggtacatccacgtataacactcgctggtcatcgagatttggccaccaccaccactacattgtttgtgcaacgtcattgagtacaacactggactattaagtttaagtccaacaaacgtcgtacaaggcctgagctgctcaaacccactaggaattaggatgtacctcaaaattgttgtaccgctctgtagctagggacgatgaacctgaacttgccaccagttctggatactaggtgtggacacatgggaaagctatgtaacaacatggacactttagtacgtgctttcattaatattacaaataatctttatcatgtgccaagattaaaatgcctaatctctgactgataaactatgacaccccggagtaactgaagaaaaaaaagaaagagataaagagaagtgctagtgggctgctttggtggtttttgggccaagctagctagagtgcagtgtgtgcagaagttgaaatgcgcagtaccacatgtagtgttggactttagtcccacatcgctacttagttgagatggacatgtttataagttggatagcacccaatgacaagtaacacatgtttgaacctttttgcgtgaagtgaggactgaggacgaaagcacagagtgtaggtatggtccaaaagtgagttaggcttaatcattttttggagttaggtttgaatcatttttgggcctgggcaatacataaatatgttaatttagttcatacgttatattatcttgtaggttagttaatgttcaccatttttgtactactttttccttgattcttctaaagataaagaattccatatatataagccatggcaatgacattaaccctcttcttcttaatgataagaatgaactcttgaatccagttgatgcgatgacaacactatttatgatttctatcgtgatcaacaactaatgatgaatagtaacagcttgttcaggatcgattgaactaccactgataagccgttgaaaaataaatgaagcaaccaaaaataatttatgtgtacaacttttatatatgtattgttcgcggcttagaagccaaggttggaaaatagacataactgaaaaaaaaacaaaaaaccaactcaaaattgttctagctaataagccaacaagcagacaatgagatgcacacactgagctacacgcaacattctaaatcatagctggtatgggatgaacacatgtaagtgttttgcacggttgtagatacaaacatatacccacgacaaattgagcattttaggcttgcatttctagccattatagcataaccttatcactttgatcaatgtttatcctattggcagctcataactactagaccatttagtgtgatagctaacctttttgagatgttgatgcactcggcatacatggaacgccatactctagctttctttgtggccgttggattgacctagatatgaacggccgatgtatccctgcgtcccctatattatgagggaagtcaagtccccatcttcgcactgaccaatccccttgttgatttgctccatattgaggttgatttgccttccctaatatcctcccccatcgacaattctggcccttgcttccttccttgggaggtgaattatagtggctacgattgactccttcctcaaccaggagttggtgatggcaaccgacaggatgccggatagtcactttatggcctctagcaatggtggggcctgctaccaaaacactcatggtactccaatcactatgggggtccccaacttaggttgtcttgttgctagcataggcattgctccgtcaagctctcttatgccggagaggggtctggcaaccgctaattacaacttggttgctaactttccagaagatgctgccgtggtgcctcaacaacagcagttgcaagctgcatctagtaacagcaactcagggttgatcaaaggagggtggacaagagaagaggatgagtaagtgacggatcatccggcttcgactcagatttttactcttgtttctcggcatctcttccttctcatgaagagatcgtgtactatcattgtgttttcttgattgtagagttcttagacagatggtgcgacaccatggagatcgcaagtgggcagagattgcaaagagcctccccggtcggatagggaagcagtgccgcgagagatggaccaaccatctgcacccggacattaaggtatggatcttgtgacattcctttggttacatgtgtagatctaagggatctagttttttttctcaatgcaatttttgaggtggaattccttttcggatttacgtaaaaatcctagaaatttcatccctccattccaaggtgaccggttattaactgctgagtacggtagtcatattgcataacttttgttctagataataaatatgggaatttcttcattatggccattaatgtgtcccatacttagtcctagggaactcgtctggacagtactccaccaagtttatttatgttcttagtcgttgttgtctatgctaattaagcataatgttttggacacttatagttaaaaatgtcttagacacttattagtccaatgcctatgtttttatatgctgctttatcactataagcaagcaatatgacattctactaggtttaatatattctttatttgtcgccagagtaatcaataacattatttggcagtaccctgcattatcatgtatatgtatatatgctttttatctctcaataaatgtgctcaaattaagaaaatcattaaataagaatccgtaaagttccggatacattaacctttaattgccttatgctgttaatcatatagatgcatccaatattaataagtagcaaatataaattacactgcagaaaggcatctggacagaggaagaggacaggaagctgatcaaagctcatcaaacttatgggaaccgttggtcagcgattgccaggtcgctccccggccggtcggagaacaccgtcaagaaccgctggaacgcgaccaagcgaagcctaaactcaaagcgccgactgaggaagaaaaacaatgagcaagcagtgccaaggcagccttccctcctcgaagagtacatccgtagctgccagcacccactgcccaatgagacagcaccacccgcatcattcgatatcggtgggtacggtaccggtgggacgatcggtgcaagtccaaccccacccacagtgcatgcgttgggtggatctactccactagggttggtgatgttccttgacctacttaaccaggctacaccgcacccaccacagccagacttgaacttgttgaacataacaccggtggtgccacatctcaacactagtgaatactgcctacagctcgatgcgaggggcaactgtagtatggccagctgccggtgcaaccccacgggatcagcgcccaggtaggcccaagcaacgtcggcaccagtggcagaaccggcggcatggacaacaatggcgtcatccagatggcgtctaaccagttcgtgatgccatctgagggtggtggcattcctgacatggccaggtggatcaactgaggcttgcttgcagtattgccggatcatcactcgtttaataattattattattattattatcatctctgagttttttttctttttggaatttctccaattaagttgaactctcacctacaattgcagtttgtatggctatatgcctatactttgatttgtttggaacatctgagtcttgagtcgtccctgtggtgtgggagcctttattaatttcttgttctttttaagatattgtttaatgtatgaacctttattgtgttgtgcttattatatttaaggtgtcaatcaatgtatgagttacattgttctagaatttttacttttctttctcaagaaaagtagcatatttaagttttatattgttgagtgggagagtggtagtatctggtacccgtcccataatacaaatgattttatgggaacacgcgtggggagggggatgtttttttaatgttagaaaagctcaaatatgtaaactagacattagagataactagataatacgagagtcctccatttggctgtagggttaaataataaggtagctctgctcgttaacttaaatgagttaaaagtgtagcttggcaagctgagtataaactgctattttaagctcgctgacactgtctaatttatttattgcacctaaaaaattttagcatttgaatttaatatatattaacaagataatataactaaatggtgaagtagtgattaagtagtgatgtactaatcttggaagtaacttaaatcattaagtactaaataagaatcactaagtataaaatgataaagtttactttttgcctactatgctcaaagtccccttttttaccctgaagtccaaaactggttgtgtttttaaccctacttcaacgggaaactgtcttaacctatcaatcccacattggtcaaaaaccattcaaatagttatgaatcttttttttttaaattacaaattcatatgacacacacacacgcccacacacacacacacacacacacgcacgcacacatatatatatacactactttacaaaaaaaaatttagttcctaactcaactcacaaattgagatataaaaaaagataaatttagcagcatatgaataatagtggtactatttatacatgaatttatcttattttcaatgtgtaggtcatatttgaacttgatttttactggagtgtttaggtatcactatactctacattatcattcttttcttaaaaaaattttataactctttacattgaatttggaagaaaagtctaccttggccagctaagtgtaaactggcttgtcaagctcgctcacatggtctaacttatttatttcaccttaaaaatgagcattttaatttagtatatattaacaagacaacataactaaatactaaagcagtgattaagtagtaatatactaatattggaagtaatttaaagcattaagcacttaataagaagcacaaagtacaaaatgacaaaattaattatttttagccagctctcatgtggtgtagtattttttttgtcactattggtatttcttaacgacattgttgacggtcgttatagaccaatttcaaccgtcaatataactaaaataaaggagaactaactatgcttgcaatggatatttattttagaataacatagttacacctgtacttggagtattatttgtttgcagagattaatacataaatggagaagaaatgagaaaacttcacttctaagcaagcttaaggataagatgggctcacttgtcaggtgcaaccgtcccggaaaccgccataattgccacaaccgtcatagggacccacctgtcagtgaccctgggaagtgtggaggcctgctgggccggcccaggttcgaccgaaccctggtgacgccagctccagttggccttacatgtggacgtccaggattgcttgctgatggtggatgtggggcatttcatacaattcgcatcaattacaaccgtcatacttgcctatttcaggaggagctcattttactttcaccacgcactccagcaagacttgatctcgatctctctctctaaagtttagtttagtgctctagtgctaagtgtagtagtgttccatctgatgcccaaatgttcccagcaacttttactgtaagggcaagagaaaaagagatgaatcaatgtttccctggggcctccacagataccacaatttaaaacaacatcatccggtgcacaatgtctcttatcaagcatgtcccttgtgtttaatctatcccacaacagatcaagccacatgaaaatcttgatcattttcacacatttggttttccagatccactagaaaggtcttggaacagagattctcatgaaattaggcctatagaacttatgagcgtaaaaggttagggaattccaaaaaaaaaaaaaaaccaagagtcacctctctatgtgctaggtcctaaaccatctaactctgattctagctacaaatattgtatataaacatgtggttcaagtggaaggttgaaacaatcttcaagatgcacattattataaaaacacaccaactcccatctgacagttgtatgatagaaaagacctggaaacttatactttctgatttttcccattccaaagatcatcccagaacaaaacagtagtcctagactagattgtgcattgtgatatggctctgtatatgtcagataggtggaaaattaaatagggaacttttgtcatgtaatatgaatcccaaataagtcttacccagcgcaaatcaacagtagtgtacaatttgtgaagatgttttaggagcagagccacattctgaatgtatagatttataacacctaaacctcttttgtctttcggtctataaactttgtcccaggcatatttttcaatcaaatgggcttgcttgtcattgacttaattttgtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37687 - DNA, 718 bp, Oryza sativa
  unsure (1)..(718): unsure at all n locations
gaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgcagg

SEQ ID NO: 37688 - DNA, 9079 bp, Oryza sativa
tccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaacctggtgaccttgtttctggttctcctttcgctggtgtcaagtatgcgaaccggcttctccacataggtcaggtcctcctggatatcgatgtgttccgaatcagcctgttcctcaggtacccttaagcacttctttagttgggaaacgtggaacacgtcatggatgccgatcatgttggatggaagttctagctgataagcaacttctccccttcgttccaaaattttgtatggtcccacgaagcgtggtgccagcttgcctttcgtctgaaaacggtgtactcctcggagcggagtgacacgaaggtacacataatcccctgcttcgaaagtaagctctcttcggcggttatcagcataactcttctgccgagactgggcaattcttagcctttctctgatggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggcagacttttatcccatgctccaccaaaatcgagcgcacacgctcgcagcatatcttccaagatctgattgaccctttcggtctgaccatcagtttgcggatgataagccgtgctgaaattcaaacgagtccccaattcttcttgcagtttctgccaaaattttgaagtgaactgactcccccgatcagatactatcttcttaggtaccccatgcagacacatgatccttgctaagtacagctctgccaaccttttccccgtataggtagtgtgtactggaatgaaatgagcaactttggtgagtcgatccacgaccacccagattgaatcgtgccccgacgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgttagtatgagatccttcagttctttgtcgtcaggcacacacaatctctctcccaaccagattgtgccatgctcatcctcatggaaatctcgagcttttccaaccctcatattctttttcagctcagctatttcaggatcatttacttgagctgctctgacttgatccacgagtgtaggccgtgcctctagggcagctacgaacccgtgttccacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcatgtggacgcaactgtcgcgaagcatatgcgaccactctgccttcttgcatcaacacacatcccaatccttggcgagatgcatcacagtatacctggaagtcttttgtctgatctggcagaattagaactggtgcagagactaacttcttcttgagttcttcaaaactttggttgcactcagccgaccacttgaatttttcatctttctttagcaactgtgtcatgggcctggcaatcttggagaaattttcgatgaaccgacggtaatagcccgcaagtccaagaaaactccggatttgagaaactgtctttggtggggtccacttggtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgttgctcatgttgtttttcagacttggaatagataagtatgtcgtcaatgaacaccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactggtgatagcctgatcgcaggtctatcttggagaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacactggagaacggaaggtgatcttctcccctttgtcgttggttagggtgatggtgcggcttgcgcagtcaatcactcccttgtttctggtcaaccaatccattccgagaatgacatctaggtctttagattcgagaaggatgaggttggatagaaacggggatcttttgatctctatagtcaccgaggggcagtagtgtgctgtcctcatatcatttccaggggtatgaacctgcatcggtattttaagttccactaccgataatccatgcatcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttaccagcaaagtggccgtgcttgccacagttgaagcagggtcctggctttcctacagcccccttcttgggttgttctgactgaactgacacagctggcggatctgactgagctggtgccattagtgggggtggagtcgagttgtggttgtgctgcttactgttgttgtgactgccaccgttgtagtcgttgttgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgcacgtcctcaggagcgtagcgcgcgaggcggttgaactcgtgcaggtactctgtaaccgttctggttccttgttgcaatgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctctcggtcgttgcattgcaataggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactggtgggttttcgggcggggagatgatctgctgccagatgcaccactgacatgagctccatcggtctgctcttcgctgccactggcgtcgttggagtcacggggatcgttccgtgtcttcatcatctggacgaggataggtagaaataagagaaaggaagaaaacagatggcttggaagctaatctttcttataaaattaagtgccattatcttaatcttgattaaaacactgaaaaaagaggcacgcaactcctaataaaagcagccataccactgacacatgatatcgaccgccgactaacccacaagcaacaaacctaagcacagaaactagcaagcaaacaaaactaagaagacgataaagctatgggtggcgactctgaagcttggagcggcgcttgcgatcgaacaacaggtctgacatctaaggtaggcaagggataggaatcaacgcatgctcaaaaccaaattaaatgaagccacaaatgactcaaacaactagccaagcatgatgatttttatgcatagaacattttttttttatgaacccggataaagatacccatgcaacaaactaatcaatgaatcaatgcacaaaatagatgcatagctataatgatacgcataaaatctccccatcgtacctagacacgacttagcgcatatcacctaataaattcccgactcactatcaaataaattccggataaaatttttctaaaaccctagaccgagcaaattttaaggatccgacccgaatgaacgaccaagatttttcccacaaaccaaagaggcaaaaccccaaatttttcccgaaacaaatccaagtgcaaaaagcatatgcagatgaaaaggtttaagagagctcttaggttttccagttggcttgtcctacggtcaaggtcggctctgataccaacttgtcacgcccagaaattcacgaaccagaatttttaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaagcagcagttgaaagcagtaaaacagttgtagtaattaagcaatattaaccaatctctgtccaacgttacaccacgttgcaacaggcccaaaccaccacctgaactacaccagttcattaagcttaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtaatgtactttaattaaccaacaccattacggtggcactaaatcaaagctattgccaataatcaaagtctatgctttaatgtgatccccttttgtgcactagttgaactaagcatggctaagcatctcctaaaccaacatctagtcattttaatacccaagttatcaatggcgtaagggaaacaacataaagctgagtaataggacccgtcccacatgatattgtaaaacaatgcaatatttaatagaaatgcgggacatttgtaaattgggtacaatatgatcaattgcaatgtatgacttgccttgctctcgcactgatgaggccacagcaacgtcttcgagaaactacggatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactattaaagaaaaagccttaatcgatttattgcgcaatattgccccagggctgacgtcagcaaggggtggggcggcgccgacatgcgggacccacgggtcagtgactcaaagagagagagaggcggctggcaagcggggcccaccgggcagtgacacaagggggagaaggatggggcggcggcgccacgtggcggccggatcgacggccccgatctacccaagggtagatcggacggcggcggcggcggcagcccccgggctcggatcggcatcaaagccgatcggccgacccgggctagcggcggcggcgcgtgcgcgtcacgtcgccggcgacggcatccggcggcggaggcgacgcgaaagcggcggcagcggacggcggcaacgacccaaagcgacggcgagcgcgggcggcggcgacgcacggggaagcggggaaggaggggagaggaggtgcctcaccgagggtggccggcgcggaggaagatgatggcgaacggcgacggcaagccacgggaggcgacggcgaccggcggacgagctccggcgtgccctaaggaaggagaagagaggggttagagagagggagatagaccacggcgaccggaatccatggccgaaggcggcggtagaggttaaacccaccggagcgcgaggagacgggtgttccggcggcgaacctcgacggggaaggggcggccgaggtagatcttgaccccgcgaacccgacggcgacgacggcgcggcgcggcggcgaccctagcggcggctagcggcggccgaagtagcaaaaacggcggcggcgggtggttgcacggcgcgggagcgatggggagcacgggagagtgcggcgaaatggggaaaaagcgagagaggacgacggcgatgcttaaaaagggggagagagagccggacgtggccgggaacggcgggattcgccggccgacgcgggggagtggggaggagagagaggcgggattcgaatttcgaatcccggccatctcgggcgcgggcgcaagtgggagagagaggggaaagggcgcgggagacacggcgcacgcacgggcgtggacgacgtgggccgaggaaggcggagacgtgggcgtggcgtcagttgcggtggcggctgctcgagcgggatctgcgggaggagggagactggaccgacacgtgggccccacctttctgcgacccctggatgagggaggcgggcggccggctgtctggctgggcctcgggcttgcgcccgcccatcaaggaggagggggaggaaacataggggaaatgggccgacggcccattttaaccaaaatgaggaaaaagagggaaaaagaaaaagaaaaaggaaaaaggattttccctggaataaaaattgcacttgctcaattttaattggttaaaattatttctagagctctgaaaattccactaaaaatcctgttaatgaatttcgacatgtagaattcaagaaaaattccacatgtcaattccgattattatttgcattattttcttagggttttctcctgatttcacctgcattttcttggggtcatatgcaaattacaatttggcttgggaggaaaacttcggggtgtgacaaggaccagccagggtacacaaacgataattgttgacatacagatccacgtcttacaaaaatataaaagattacaaatgcagcggaaaagataaaacgaactaaacttggattcttgacttctgcagcgggcgactccactccacaggcaatccttgacggcatcgacgaaaccaacttcaacagaacagctcccactaggaagatcttcagctctggtgtgggggaaaagaaagcaagactgagtactacccactgtactcagcaagtcataccggatgagaatgtatgatgcaggatataaccaaaggaggctatgggttcatttgcacaaagctagcatttaaaagcagcagttgaaagcagta

SEQ ID NO: 37689 - DNA, 14592 bp, Oryza sativa
gtcttcgagaaaccgcgggtcgacgaaacgaccgaaatctacgcgacaaacaaagcacacaagcaaaacatgctataagactactgaaacatgaaacaaaaccatttttaatggattctagggatttgtatgaatttactgagacttgaatggacttaaacggagctcggatgaattacttatgaattttagaagataaactgtgtttttactaataaagaaaagtccttattcgatttattgcgcaataaatccccagggcggacgtcacccaaggggggggttgcagcgccgacatgtgggacccacgggcagtggctcaaggggaggggagaggcaccggtccactgtggaccgggaccacgcgggtggtccaccgctggtccacgggaccaactgtccggatcggccgggaggccgatcggatggcgcgggcggcggcgcgcgcatgcgcagtcaccggcggtgaccggcggcgcggggagacagcggcgaccggcgcgaaggcggcggctgcggccgaagacgacggcgcacgcgcggagggcggcggcgctcgcgagagagaggaaaggaaggaggagaggggtttcctcaccgaggcgatgacgacgaccggcgcgggaagagacgagcggcggcggcgcttccaacaacggcggacggggtcgggcacaacctgggaaaggcgatgaccaggttaggaggaggggaggatgaccacggcgactagagcggccggccggagttgggcggaaatggagagctcaccggcgtgcgatggaaacggcgcttcggcgacgtttggcggcaagcgagcggcggccgaggtagctctagctgcggcggcggttgcgcggcgcggcggcgagcctagcagcgacggcgtgcggccgaaggtcggcagcgggcggcggaggtcggtgtgacggcgcgggcgtggtagggggcgcgggagaggacggcgaatgggggaaacgagagagagagctcggggaagtgattttatgggctcgggaggggcggaaacggctggggtggccccctatttggccagcaacgtgggggtggagagagagagagaggagggggattcaaattcgaatcccggcctctaaacgggcgcgcgcgagagcgggagaggtggaggaggtgggcggcgacgtgggctcaaggcacgggagagacgcgggaggcggggaaggtgggcggcgtggggagcggcggttggcgccggggcatgggcggctggaggtaggggacgacctgataggtgggccccacctatcagcatcccagagaggagagaaggcggcttgggctggcccagcaagagggagggcgcgggagagagataggtcgtcaagagaaaaaggaagggaaagaaagaagaaaaaggaaaaggatttcctgggattaaatattgcggttaatgaattttaattggttaaaattatttatagggctctgaaaattccactaaaaatcctgttaatgcattagggcatggggaactcaagaaaaattccaccacactatttccgattattaattgcatttattaattagggattcaactctaggttaattaaactatttcttcgggcaatttatttaaccattttttttgaaggcaagaaaaaggggaaacttcagggcgtgacaagaagccttccatgaggtgagcttgagcgcttgaggcatccggctggcgacggggacaaaagcggcaggtcgccggcattcggtgggcggtggccaatgctgagggtaactcaaggtttccatagcccaccaccctcttgcctcaccttcctcggctccggcctactccgactcagctccctcttcctcaccgcgcgccatctccttgccgccaacagctacgccagtcacctcgtctgcgtcgatgatcctgtcctcgttgcccaccgaatgaggatggcttggcacacgtggctcgtgggctagctgctagcgtgtcacgtcctgataaattcatcccgaaaataaaaatcatcttctaaaaggaataatagaattaattaaaattcgaaaagaaattggcaaacactaaaatacgtacaagaaaaattcgaatgtggcccggagaatttttgttaaattctccttggtctaaaatgagccctcaaattttacttgaattttcagagcaccggaaatatttattaagccacaacaacaattatcgaagtttattaaaaaagaaaatctaaaaataagtctccctctcctccctctctttctctccctctccttctctccctcctcttgggcctcctcccctctcggcccagctccatttccccccctctctctcccgggctttttttccccccccccctccttcctcccggcctccctcggcccaagccgcttcccctcctctcctcatgggccggtcgcccggcccaaccctagccgcgcccccgccccgtgccgcgcacgtgcgcgcgcgtgcgcgcgctgacgccgccgcccgaccgcgtggggcccacgcgccagcgtcgtcttcctcctcccgcgccggccgtcctcctctctccctcccgagcgagccctagcgccattcctcctctaaatccgctctattcaagccggctcttaccaaattgattgggggcaattaatccccattgattcctcttcgatttcccccgtttttccccttgaatggtgctttcaatcctcgggaacggacgcgccaagtccggccaccaaccattgccgccggccgtggttcccgccgccgttcccgctcctcccgtggccggctccctcccccatcatataaaatgcaaccccctccgtgcgttctctcgttttagccccttcccgagctcccccacggccgcagcacctctccccgccgtcctcctctctctcccgtgccgccggccgcctccagccgcctctcccgcctcgcccgagcgccgtccggtcgcgtcgtcgcctcctacagcatcgccgccacctcctccacgccggcctgccctccgtttcgcgaggagacccccggaactacgttcccgccgtcgccctcccctttccctcgcgccggccacctccagccgccttcctctcctcgcccgaacgccgcccggccgcgccgtcttctccctcggcctcgcagctgccccctctccctcggtcagccctccgtttcgcggggaaatcaccggagacgcgccctcgccggcgtccagtggcgtcgccaccacttctccgcctccggccgcctctgccacgtccccggagcgccggccgacgtcgccaccaccttcctcggctccacgacgccgctctcatccccggcatcacctccgcctcgcccgaacttcgccggaacaccgtcgcccgcgccggtttctccttcctcctcggcggcatctcctccggctgccccggtcgccgcgccagagcgtcggccgacgtcgccgtctcctccctcggcgtcgccgcatcgccctccaccccggcctgccctcggtttcgccggaacgtcgccgcgaacctctccgtccgcctcaccggagttgttcggccgcccgtccctcctcgccgtgcatcggtcggccacctccaccaccatcttcggcatcgcagcggcaaggtcgtcctcggcatcgtttcccctccatccaaacccctccgcggtccatcatcgtcgtctccgatcgttctcgtcgtcgacgtcccgttcatcctcgctcggctcgtcgtctcgcggcgccgcctccgtcatcgtcatcgctgcggcgtgttccgcgtcgtccccgtctctgtgcagccactgccggctgccctcgtcgccccctcgccggtcccggtcgtcgtcgtcgtcgtcgtcctctcgtcgttcccggtcgtcgtggcgttcgcccctccgtcaagccgttcccgttcgtcgtcctcgcttcgtcaaggtcgctgcagcccccgtcatcgtcttcgtcctcgcctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatacgaactctgaatcgacccgttcaaagtctcctaatgtttgctataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccaagcctatttacctttgttatgacattattattgctattgttattattattaccttgttcaccctagattaaacaaaacctcaactagtgggtactctattcatggttccactagtataaatttaggtagatgcttcgctgaataattaggcaacattaggtggttttataactttagactttgggagttctcatatcatttggacactatggaattgttgaattatggtggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccaggacaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaacttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttaccgcaaaacttaatccctatattattattcccttgtacctcccttgcattaatcatgcatctgccggtgtggcttgctgagtactgtggttgtactcattcttgctctatcttttcccccttcagtaagagaagctttggagaagatgtcttaggtgaagtcctggcttataccccagttgagcgcctgtgaagatggagccgtaggccgctagtccgctgctgtttatttttgattgtcaggccttaagtgcctttgtaataatgtaaatattatcgatataataaagatgtgccttttatatcatgtttgtatggtgtaccccggcttttcctgggacggggattaatacactagcgttcgggaaaaggcaattttcccggtcgcgacatagcgccactgttgagagggcagatggagagagaaggggagaaggagaggagttggctgctaacatgtagggccccgtgtagctactatgctgattcaacatagctgaccggagtgaaaatgccacgttggatgaaactgggagccatactgccttaggacgaaagttgaaacggttttgcgagttcgggacaagctatacgtggtattgtagtcagggaagaattttagactcggtaacatattgaggcatctaaagtgaacttattcctaccattggtaacatgccaacagttcggtgcaggctgagcccatccaactctgttcccatcctggcccctgccctgccagactggcctctggccctatgagccacgcctagccacaagcccacagtgcacgatcggcaaagagccgggagccacgcccatgatggcggccagctccgtaacaactaacaaggacattggccaagcaataaggacagaatcgtttgtgatagctcgaataacgacgatggtgataaattaccaccacaagctgtagtttaattacatttcaaaactaatttgagctgtgtaacttgtatttgaaattgtaacacatggcccatgaaaatttgaacaccaatcatcagatatagtactgtattttagtgtgacgtcgtcccactgtatttttaggtttacttttccaaattatttaccaaatcgttcaaacaggatacttgcctgaagaataaattttatgtaaaaatcctctacccgtactgcttacctacttaagatacatgttaactttatttctcataatatttaatttatcaatataataaagtagataacccgcatcaacaatccgttcaatgatgttttaaatcaagcctaagtagtattatgaagattatgcaacacttttgatgactttttgctgattagttttttcgtcagcagggaccggaatatctttggaagagcatatgtgtgagcaggattatctctaacctatcttgttcacctgaacaataacaacatctcttttctatttctttctgctttgagacgagctgtgatcagagctgctttaattttatcctagttttgtcagcacgtgaactgtgaagaggtcaaaacgtcatgcgtttatgaacagctggaggcctctgccataatcaccgtgcacggaagaaaaaacacagagcaagacgcaagtattgtgctttctaccgaaagtattatactaccagtagaactaatctgaaccatttattcttgagggtacaatagtaaagtagtaagacagattaggggtaaatattatatgacatcccggacgacgtcggttacgtcgttgtgttcgtcagtggcggtgggggtggagaccatctcgagggtggagccgcctgtggtgaaggccttcttgcggacggccttgtactccggccacgtgacggcgcggtaggcggcgctccagccgggcggcacacggcctccggcaaccttgacgttcggctggtaggccgaggaagtatccgagcgatatcctatcgcggttgcggttgacaacggcgcggtggtagacgctgtggaagcggccgttggtgagcatgcatatggatgaggtcgccgacgttgaggacgaaggcgccaggaacgaccgccggcactgccacccaccggtctggtccccgccggaacagctgcagccctggcacgatgctctagagcagaagccggagtcgctgtgtgcactgagtcccagcgctcgccgcaggtccgggcacctcgggtaccagtgcatcgtcgccgtcatcttcttccacctcgactccggtgagacccagtgcccgccctgaggaacaactccagcagctcgtcggcaccgtcggatctccttgtggaactcctccatcacgtcactgcgtatattatacgtgtatcagtacacttatacgtacaactataaatgtacacgcagctcgagagtgtgtgtgcatggcggcgacgggtgtatgtgagaatatcagaagaggaggtagtcgtcgccggactatctatatcatattttatcttaactaattagaaaagaaaaatctgtaaccttccgttcgtcacttttttttctgcatttttgtccgtcaacgtgctaatttggttgaatcagacttgacttcgccggagagataaaaactagggttcactggagagataaactcgagtctgagctcgatacggaagcaattttcatgggattgacttcaatttcctgagagaaaagatagatcaaaagccctcgactaatttgagattaactccacgggtttggttgaatcggacgcgggattagggtggcgtcaggtgtaggccggcgaatttcctaattagcgcagacgcgctaactagccatctagcgcgcgttttaggcccatgtcctcgtacgtgatttctcttccggtccacttttgtttctgtttttttgcgcgagggatcgctgggaagcgtgcgcaagtgcgccagattcggagaaaataatcaagattagattagttgacggaattagtttccgataattatgtttctttaattaatctttcctttttttcatgaggtcctatttttttaactaaagatttaaaaatctatacgtgaaatttgaaactttctatagatgaaaaattaaaagtcacaactcaaaatttaaactttcaatttaaaatttaaaaactttcaactcaaaatttaaacttttaaatcaattttgaaaactttcatctcgagttttgaaaactttcgacccgaatttgaagactttcgactcaaaatttgaaaagtttcaagtcaaatttaaaaactttcaacccaaatttgaaaactttcaacctaagtttgaaaacttccaactcgagtttgaaagcttccaactcaaatttaaaaactgtcaactcgaaattgaaactctcaagatttttttttgaaactttcaactcagattttgaaatttttcatcatattttcgaaactttcaacttaactatttatgtattattttgataataaaaactataactagattaatccatatggctagcgctgttattagcgctaatgacgcgtggccgtagtggacccacgcgcttaacctccccggacgcggtgcggaacaggaaaaatatacaaaacgatgaaacaggaggaagttatggaagtgcgcgctacaaaattatctagcgcgtctgttctaaccaggagcccccgtaggccgggctcgactggaacttgaagaaactactgtagcaatagggacataaattagacttctgttaggacttattttactagacccaattgaggaggacgcaagcaagatttaccgaagaaaggaaacatgccagaaacagagaagagacaaaacaaaaggagggaatctggattttttcatatttggcccaaacctgaaagcgcggattttgattcatttttctaattaaataattgctgaaatgatctttcatttattttgcgttcatgtttccggggcccagctgtatggcagaaagaaaatagttcggtttgctggccggtataagatcatgatttggattaaatctaattataaaaatatagcttatatttgataaatctacatcattatatctaaacattcataaaatttttttagatccactatgatcaacggtgtatatttttgtttcaattaatgtgttgatttctaagccacagatgtgaataaatatttctttatttttcgttgcaacgcatggcacttttttttctatatctaactaaaaattaagtaagacttttttcatccgttattaaagcatcggtaaaaattaagtaagacttcggttaattttttcatccgttattaaagcatcggtccactcgatattatgcagctgatccgcgaagcggaagcgtgaccgcgatctctaatgccccgcaaataaaagagaagaaaacaaaagaaagcgaatttttttgagaattaatattatttttatggaaaatcgcaaaagtagtggtcaaccggggaaaatcgcgaaagtaggtccctgtcgaacgggtgcagttcgatagggcgcctatcgaacggccagagcgcgactggtgaggagatcggaaggctgccgttcgataggacctgtcgaacagccccaggcagggctgtcgaactgcccctgttcgacagggggctgtcgaactgcccctgttcgacaggatatccgtcgaactggcgcgttcgacagggtcgcgttctccatttatttgtaataagttatttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaatagaaatgactaaaagtttaatacaaatagataagtcaaggacgattagtgcccttcgcacgcttgctaggtcctcccttcttcctacgcctaatctgctcagtgggatatgtcaaattatcagggggggtgcctatctctagctgcctgctgtggtgtcacgtctggcccctgaccgacctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgtggacgtggtggtgccgtgctcgacgtgggtacccctgatccggctgaccccctaatgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgctgcgctccgacaggagacacgacgtagtagtgcggcagcacgtgcacggaagttgcgaaggatgctcgccacgtcgtcaggcctgacgaccggaggtctcgcctctagtctttgcagcatggtgtcggactccacgtgaacgtgctcaacaaattccgcctgttccacaaataatcaaggtaattaaaattatttaaccagttgcacatttattaagagtatttaacaagatgcacatttgttagaaataatgaaccagttgcacatcatttataaatgctgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattagacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtaacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattactcatataaggaaagtttgtgaactagtattcataatgataacataaacgaatttaacaaaaaatacctcacggtgtgtccacaaggattccatagtgggacgatcgttgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtactgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccatgcccatctgtgagatcctccagtgcaacaggcagcacaccaccaaaactggccagaaggtcatccgcccatccagcattcaccattgttgggccaactactggcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacataccttggaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagccaggacacatatattatgatattacaagtgcagtgcagttcgaaatttaaattacaattccaatacaaatacatgacgatattaaaagtgcagtgcagttcaaaatgaaaattacaaggctattacaaatagattcgggtaataaaagtgcaagaaagttcaaattaaaattacagacgcactaaacataaattgaacgataacgatcttcaaagtagggagtccaccaaggataatagcgaactaaggattatttttcttcttcgacttcccctttgaaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgcgactggcgacgacccttagtatcaactaataaatttgagtcaggcacccaattggcttgccgtggaggaggacgagtgaaatcg

SEQ ID NO: 37690 - DNA, 5657 bp, Oryza sativa
gtattcttcataacccagttatacacttcagcaagatttgttgtcatcacaccatacctcgatccgtctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatcttttactcctgaattgtctataaaaattagccccaaaatgtcgcatgcaccatctgctatgtaaatctggccatggcacggactgtgtgacatcttcttgaagcttctgtatcgctgatagcaaacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaaacccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatacgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcatgtaagtgacctttgtcatgaaacatctgtccaactttcacctgcttactatcataacaccaatgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctttccttgtgtattaccctctactacttcttcccctcgatcttgctcagtccgccaaacattttcagcttgtccaccttccaacggagtttcttccaccacgacatgacttgactcccccgatcgatcgacacatgttgtcttctgcaccactattgccaggctatagcctttctcccttactttactaacaaacttcctccaactcccagttgacgcaacctccactactctccactgccatccatgttgacccctcactggccacacggtatttatgacaaatttatcgtgcactggatctaccccaaacatattatacaaccaccctaacacgtcgttcaaacccatatgctccggtgcattcagactagtatcatggaaggcatatacagtcaaatctaccccgctatcacatatttgtataggagcatcgccataatacagacgaatgggcatatcacctgacatcctaataaaacatgacaaatagtctgacgtttaatcatttaatcattcgataattaccctattacaacttatactatattgccgtgtactaatttacaactattagtaacaaacaactagttttgataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaagtcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccatccggcgctcacggcgatgatctggcgactctcggcggcagctggcgatgtggtcctcaaaacaaatcgaactcgcggcctgggtggacggggctttaaaccggcctgtcgaacgcccattgttcgacagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgatagggacctagtttcgcgattttccccggttggccactacttttgcgattttccataaaaataatattaattctcaaaaaatttcaaagaaagctagcaagcggcccaaacaaagcagcagcaggctggcccaacagccagcccatagagttgagaagcaacggcccagcacagtaccgcgtaacactgtatcggtactccctctatccaaaaaaactcaacctaataagggatgtatgtgacccttcctaggactataaatctgaactactcttttgtccaaattcgttatcgtaggaggagtcacgtcttctcttagattgagttaacctagtttttttggacggaggaagtaggaatgcctaagactgataacacgaaataaggtttgtgtttacccgaaacgcgaagcagggatagaaaagaagatgcaattttattatgtaaaaaaataaaaaagaatcgtatatttatagtcctaggactataaatctgaactactcttttgtccagattcgttgtcgtaggaggagtcacgtctcctcctagattgagttaacctagttttttttttacggaggaagtaggaatgcctaagactgataacacgaaataaggtttgtgcttacgcgaaacgcgaagcagggatagaaaagaatatgcaattttattatgtaaaaaaataaaaaacaatcacatgtctttcttttttttcataaaacaagtaatcacaaaaaaatgaattattcttgttgaaaaaaaatcacataccttttttaaaaaaaacatgtaatcagtaacaaaatgaattattttagaaaaaaataaaaaagaatcgcatacttttttttaaaaaaaacacgtaatcaccaacaaaatgaattgtgtttacatcaagaattttttcctcatcacatcacttttttctcattcatggtacgatttccttatgatttttcttagagtgaaagtattctttttttttttcattcattgcatgatttccttccgactgttttttagttaaagccattctgcgattggagtgtagtgagtgtgatcagatagctagccaaaatcatttcttctactgtgagtactctttacagtatgacaaactagtgtttatcaatatcaagtaaaaaaaatcatgcattgcaaccgactcataatttctttctaaggtttcgaagtttagtctgtaatacataatttcattttaaagtgggaataatagttttcttataatcatccgcgctagtggatttagagcaattaataattatgtcatgttagcgtttttgttgcaccggtggctttataataacttcaattaatctggtggcttcatgctctcacactcactactacttattttggcttcacccagtgcaacgcatgaacattttactagttgtttttataattttttgaaattgaaaactctggatacggaaatggtatcgaatttcatcgaatacggatatgaaacaaatacggtaacttaccagaatataaaaccctgagtaaattgcacgttaggtcatctgttttaaccaaatgttttaatttagactacatagggataagacaacaccttcacttagaataaatttcacgaaaacaatccgtaaccgattctttcctggagtctgcctgtctaaccgtcatgcaatcgaatactgtcgcgtacaaagacggagcaaatacaaaatggaatgaatatggtaacaaatatttatcggaatataaaaactcaaactgagatacctgaatcaacaaaaagatatgacttgttatttttctaaaataaaaggtcaatatttctaaattttatatcatcaatttccctaggcggttacatgactttttgtgaattgatttccatagtccatcccttgaaaaatctgcatgtgaaaatgagttttcacttcctggtgccttaatgggatccaagatatcttcctccactccacgtgtagcttactaattaataatctcatatatcaaggtctcgctgtgtagattgatgatgctattcattttattttacctctccgaagcatgtaatgttttatgcactcctaatatttttagataaaatggtcatagactagaaagtagtaaatcccatcgagctatacaactttggtatagagcatgtccccatcagagattgtttgaatcatagatttatgattttacaatgaatattttgtctcctaaatgatctcaaatgataaaggtgtcagcaataaagttgtagatctcatcaatctctacaattctgatataaagtttatcttcatccgactttatatgataaagttacgtacacatacgtgttttgtttttttgaaaagttgatcctccatctgaccgtttccgatatccatcatatactagtcccaccgttttcgtttccatttctgaaaataaaactatccatattcgtttaccatctaaaaattatctatccaagactattcgtttacgaaaatgcgtctgaaaatcgaaactatccgaacagatttcattcctagtctgggcaacacaatgatttgtgctgcaatcctgcgagatccaaaagcaacgaatgtatgaaaaccaaacaaaacctacatagcacaaaacctatatgttcctcttatttaataatatttaaaaattggaatgtcagttcttcaattcttctgatgcatgcaacttcaccaagttgctagtatatactgtacacctcttcttatttaattatttgaaaattaattggagtgccaattcttcattcttctcatccaacttcaccaagttgctagttctgtaacctcttgtggagagtctaagatgtccctctcgatggtcatcatctcatttcaggctattccttgcgctgagtc

SEQ ID NO: 37691 - DNA, 28959 bp, Oryza sativa
ttaattttcttcgacgtatatgccttgatataatggactaatcaaattggtttgcccattatagactcaattatgtataggtccagcaaacaaatgaccaatgccatgtaccatgcatcgatcgaagcctcatgtgccccaacataattattcagtaaattccacttgtaaaaaaatacacttttgtaggtgcttgataacccatttaccactataaaaaataaatttcgcatatgaatcccatatcactgtgcaaacgggtcaaatttttagctacacatgatagcacaagtgacagcctaaagtcctgggtgggggtgcgatgggcgtcctcctacgaaccgcttaattaaggtccgtcccgctccgcctgtgtatacatatgtgttttttttaaaactaattgcctgcagaaatcaaggatttgcgcagggaaatagagcctcaaatcaaggattcatgaaaatgaatgtccagaacaaaagcgttttacgatcttcatgcaactgacaacctacagaaatcatggatttatgcacatggatttcacaaccgcacctgaaaattattttattttttcaaaaatagatttcttcttttttattttttaggcacaaccaccaccctccccctctccccccaaaaataaaaattttagtagttatctatatagggtagcaggtagtgtaaagtcaaaaatcacacgattttacactcgtgtgtggtatatatataggattcaaacctagcacctcttactccacactccacgcgtaacggttttacaatctcactctagtttgtgagcatggtatgaatgcccactttacctctctagaatttgtactctctagcttgttttcaattgtaagacgtttagtgtctttatcccttatctatattcactagcatttccctcatctatattcactaacattcatataaatttagacacatatacgaacttattttacatgaatctattcaaaacatatcaagtaacatatagatcatgttgaggtctacaactttgatatacaacatatctctatctgaggttataattttcttcatggctcttaaaatcatgatttgaagatgcagttttcttaaaaaagatatccttgaaaatgaacctattttacataggtagttttcttaagacccaaatgtaaaaaatggatttttaacagacagtttatgacattgaagtggcatgaaccatcctctcagccggttttcttttgaggccatctataaaaacgaaagcctagagtctgcgcaaataattttttgtagtgttcaaatcaaccttttcccccttaaatttttcttgtttattgtggatattttcttttttattcttttcattttttgattttaacttttatttcctttgttattattatcatatgccagatatcaatgtacattactaggtaaatagaatttaggaaaccaaatgctaaattgaaagcaagatatacagggactaataaggctgcgttcattcggacgagaatgaagaaatctctcgttttccacgcacacgctatccaaacagttaaacaatgtattttttaaaatattatataggaaaatttctttgtaaaatcataataattcatttttattttttttaaaaaataatactcaattaatcatatgctaaagtctcaccttattattttaaaaatcttatcgttcttctcttttaccctcctatagaacggagcctaaaacagaaaattaattaaaaatcagttgaactggactgccaagttgaatatggagtgcaaataatagaataagacgtaagtagagatggaacacattgtggatagtcttgccacgtatgcagctttcctcggagagtctgttatccgccctatcgggaaaacaactaaggaaaatgagaggtcggtagaaaattcaggcagaggatgctgttcatgcatgactatggataaaaacaataaactcccttcacgtgggccattcggacacttggataaaatggggggtttgaacatgtcatggtcagcttatactccctgaaatttgtttttgggtcaatcattttagcaagccaaatggaccaactaggcttgcaaatggtttcacacacccaaaccggtgaaagaaaaatcattgcagatagctagaatgttctatactttctgcaatttgtaaaaggaaaaagtctaaattactactttgaactatatagcgattgtacgaattacccctgaatcacgaaaccaaacattttaaaccccaaactctttataccgaataaattacactctatctcgaaccaaattagttatagtcttgattgagaattaggggtaccactactagaaaaagcatttttacatgaggacaaaactaattttccgaggcgggagggaggtccgcctgcaccacagcgactgcgaaaatcatcggggcaacgtggcccgtctgcgaaaatggaatgaacaaacaaaaaaaaaaatcaccggcccgctccgtcatcgccgccgccaccgctccacgctgttgtcgctgccgccggcctcccccctccctcctccggccagatctgtaagggaggggggaggggagccgccgccgccctcctccctcctacctccggccagatctgggagtgaggggggaggggagccgccgccgttgtcaccgccgctccacgctgtcgccgcccccgccggcctcccccctccctcctctggccagatctgggagtgagggggggggagccgccgccgccgtcctcaccgccgtggccggaagccgcgccaccttgcctcctcgccgatgtcgccctccgccgccaccgcctgccgccgccgctgcgctccccgcagccccctccggccagatctgggagggacgggctgggagccgccggccgccgcgctccccccgcccccctccggccagatctgggagggaggggccgggccgcgctgccctcctccgtcgccctcctcggctgcgccgcctcgcctcgccgctgcagccctccgccatcaccgcccgccgccaccgccgcctccggccggcggccgggtagagtagaggtgaggggaggggagaggccggtgaagagaggtaaggggaggggagaggaggagaggtgtggaggggaggagaggtgtggacttagaaaaaaattagcatccgcaagtctatttatattcaagtctattttcgtaggtggaccacttaagcggcgcctgcaaaaatgagcccccccacgtcgggaaaaatgctttttctagtagtataattcatctagttttaagagtttaaggtttaaaatgtgtagttttgttgtttaagatatttgtgaactatcgctatagataggggagtaatttggatttttttttcttcgtaaaccatcatgttaccaatctatagcattgacatacgtatggtagcacgactcaactaccgcagcagagatcgatcgttgttccttccgcaatttggtcgacggcaggtttttccttcgcacggctgtcaaaacaacagtgcggttgcagctagcgacgatgacaactctaggttgacaatgagggccacttgaaactattaagactatatatatgtatatatatgattggagtataaaacaaaaaatgaagtacaagatgattatgagagggaagaaaatcgaaggatatgtatataaaaaagatgattaaaacgacacaatatttgtaattaagaaaacaaatttttacactttgttttatattttaagacaatttaattttttcaagtcaaacttatttaagtttgaccatatggtaacatgtacaacaccaaactagtttcattaaatatagcataaaatgtattttaataatgtttttgttttgggttgaaaatgctaatatgattcatataatgtattaaaaagtcataagcaaacatctacatactcctccgttaaataatatatctcacgctatagtaccgtgtttttttctttttttttttgcctgcgatgttgacacgttcgtccggtgcatatattctagtgctgtaccttttttttctaattatatttttgctgacagatctactaatgtttattttgacaaacgaaatcttattatattttatgcatgtacttactcccatttttttctattgtttgaagcgacatctatgatctatctctatatttattaacaagccaagcaactacccaacgtcgttgtttccacagtgcgtatgagcgagcgagcgagcgatgagagagatgcggcgttggtgcagcaggatgagcggtctcgtgtgggtggtgcttgtgtgctcatggacatggaggatcgcagctgctcaggctccgcaaccaccaaaaactgatccactcgagggtaagttgtactactacatcgatcttaccagattttttgatgtatcattttttttttgttttgtaataaagactctgtaagtttgtttggctcaatttctacatatataccaaaggctgagtcaatatggatctgatttgtccgaaagatcatctcataccatgtgcaaatcgtcgtcttgatcttggttttcctccatcgattgcaggcctctagcttgcctcagaaaaagaactagagggaacttgattcattttatagttctgcatggacatatatacatgaacactaattaaacagtaacgctgagtttaaccatgccagcggcggccctgaacacgatactgggaagatggggcaagaaggcgtcgtcggagtggaacataagcggcgagccctgcagcggtctcgcctctgacaaaagcgactgggataactaccccaacatcaatccattcatcaagtgcgactgcactttcagcaacaacaccctctgccacattaccagactgtaagtatacgcttccacgtcttctctctttggtcaggtgtgctgtgcactatgagttcaatgaagtgccctttgtaaagagttcgtttaaatatttgatctatatatttgatggttcaaatatatgtggtcaagtgtcagactgttagtgactgcttgttttttgatctagtgtcatctagttcagctaattaactctacatgtgttgcttgcaactgcttcctaccataaaatatggtccattccaaccactgcttttgatccaatttgtttatattgtactactgtgtttcctctatttcttttttctttaaacaaccccgcacaagatagcacgacgtttctattgatacagcagaaaaaaaaaatcacaagtccatagtcctgcgagacaatagttaggaaaaagaaaaagacaaccacaccacatatctacatctcctaatgctaaaatcgaaacaagcacacaacaaccctaaggaatgtgtcttctaaatgacgcctccaaggagaaaacgacgctaagagcgccgccaccgcccattctaaagaatcaggacttagttttcaccaaaataacccattgggagagaagaggaaacatagcaatgccccaagggaaaagcggggtccgtaggcgtcgccgttgccggcccgaaggctaggccttcgcccatagttcctactctcccgcactaaagagtgcatatcagattcagcagaaccaccaaccaatccccttcgacacatagcaactacgccggcacctcgctgctggccggtcatcaaagagagtctcaaactccggcgcacttcaactgcatccacgtggttgggttggaggagagaatgagagtgaagaatggatcatctcttccccgtactagcttgtccagcatggccatcttatggcagcaagccaccgcagcaaaagcacaaacgcctggaaagatgcttgccgcaggcttcaacgttcttctcatagcactaccattgtcaccacctccaccaagctaccattgttttcgcaatgggccgctaggtatcatcatcattgcttccatcctctcaccacggcagccacaccgccactgcacaccagccatgccatgctcgcaccatgacgccgtttgcaccgaccttccatagcccttggtggcctttcactgcctctgctctcgccacgttagactcccacagccccacctcatcgggtgcatctcctagcgccaccatgcctactaactgccaccaccggacgctcccagtagggttctcctatccccgccgccatctccgccttcctcccaccgacggtgttgcacgggtgagcccaccatcgatggtgcagcatcgcgcctttccgcctccaaatgtctgccccaccacctccgatgtccaccacctccacactgccgcgccccaccgcctccccgccgccactagctcgaggatcggctccctgcgcctgggaggctggatccgggctgaggggctggatctagtagcctccttgccgcctccacgtccacgctgccaccgacatctacactgctgcctccacgcagccgtgccttggcgcctcgccgccaccaccgccggatctagacaggaggatgccagatctggccagcggcatcgtgcctcgccgtcgtcacattgccctggatctggtcggggtcgtgggcttcgatgccgcgacctcggggggaagggatggccccgccgccgccatcctggcggccacgtagtttctggtagcctgctcgaggggcggtgaggtcgaggagggagataggcagggatggtggcgcaccggctgggggcgcctcccgtgtcgcccctgccctaggagtgacgtgggggcttgcctctatttcaaattacttgtgcttcaaatgcactaagaatcctctcttcacgactgtcgatacctaaacttgtcgtccgtgtcattttccgatctctcaaaatatattttcaggacttcaaacttgtcaaagtgtgccgttgcggtcccacattatcaatagacgctcatgtgaaatgccacatgggagttgactcattttctttatcttttttctcccctttttctttttcttctgttcttccttccttttggtgtggaaaaaaggagaagggaaacacaaagggaaggaaatagaagaagaaaaaattttgggaccggaatattaatgtgttatgtcacattagtgtccatgtgacatgccacataagcgccatgtaggatctcggagggtcgtggtaatttgagaccataatgacacattttaataagttcgaggacctaaaaatgaattttgacagtttagggacctagatgacatagacgaacaagtttaaggacgggcaatacactttactctaaaagttatatctgacattgattagtggacattatagtcggagtgaagtatgccgacagtccctaaattagtgcgggtgtatcatctaggtctataaactatcaaaatgcattctcggatccctgaacgtgtcgtgggtgtcatataggtccaagcgggctccaagtcgctccgtgcgttgacgtggaatgccacggtgacatatacgtgttagtgtgacccacatattagtcacatagaaaagtatattttctcctccctttctccttctggatcttacatgaaattagaggaagataggggggagagagaagaaaaatatgtttttttaattttaatatcttctatgtgaatgacatgtgggtcctgttgacatgtaggtgccaccttggcatgtcacatccacgcatgaagtggattggagcccatttagaccttgataacacccattagaagttcgagacccaaaaataaattttggatgttcagggacctagatggcgcacttacactagtttagagatcacctgtgtacttcactcaattttaaatcgcaaaaattgttttttttttgttggaccgagggagtagtactttctatgtatatacaacagtgaaatgatcatctctccatagtaatggccgcagtatcgttttttcgcatcactgtcctctctcatctaaaccctagccacttgctaccccccgcctccacctcgctgctgcctgagcaggccaccggagggcgagcgatagctaggatggctgcggtgaggtcttcctcgcctcttttggcggtctgagccagagatgagggacagtgagcaacaccagagttttttttttttgactgaaagtgagcaacaccagagttgagggacaatgagcatggcttgagcggcatgaagggtgatgagctgatgatgctgtcgtggccacacgcaggagtgctaaaggaacccatgtgttggatgtagtgcaacggtcggctcataatagggatagtgaatcccatgggctagatttggccgaatggcaatgatggatggcaaccacataatgcctatcagtggccaaggtggcacatgggcattgggagccgtgcagtggtgccgttggcaggtgcggcctaggtgggcattggtattctcgagcctacaagccacgcctaagtttcagttgtgccggtgtcgcgagtggtggtgtcagcggtggtttaaagcaaggacatattttttaagatttgaagcttagtattctagctttcttttcagtcctctagcatttttcttgttttttctatactagaaaaggtacctgtgcgttgcaacgggtagagccaatttaatttgtacatatgtgtcagatagagaggggaagacatataggtcccactattattttgaaaagttttttctgccgacttagcataaaccattgtctaaaccactaatggagctaatttgcaccggttttttaagttgagggaagcattatacccggttctgggttgagagatgccatttgatcataggcaaaacaggagataggtaaaatagacttattccttcccctcaagtttacagcccatatatgttagttcagccagctttctacaacccaattaaatttgagaggatccattatatgccactgactttgtcacatgtttacgatttgtctctgactttgtcatgttctataatatgccatcgatttttgcttaacttctacaatttaccatcaccgtctggttagcctctgttagcactgtacattttttttccaaatgaccaaaatacccctaggacaaaaacttccaaaatttggataaaattatcaaaatatcatattataaacataagattgtaaacatccaaattttggccaaaaacataaaatatgatatttcagaatttttatccaaattttgaaagttttgccacagggatattttggtcattttgacaaatttgtacagtactaatagagactaaccggacgacgatggtaaatcgtagaagttaagaaaaagtcgatggcatattgtagaacgtgataaagtcagtggcaaatcatagatgtgcgacaaaatcaatggcatataatggattctctcattaaatttgcactaataaagcatgaaaataatccttttctttacagctcgattcaatcttcattgtcagtccgagcgagtgaacttcggctgaattgtgccgaactgagctgatacgacaatggaaacaaatcggacaacgcacaaaattttcaggcaaaaacaccttaaacttttataattgtagagatagagatagagatagagattgtgaggcgtggggtttaaatactcccgattgtaactttggctgcatacatccaactatggacaagcccatccaaatttcacttcttttgttttcctctgaaaccacaccagtccgtcccaaatttggtatgccggatgaaaaccgggtattctatttttttttgggtgaatcggcctgattttgtacgttctttgggcaaaccaaatgatttgggagttagggtaaaaagtgaatagttctcaacaatccaagggaaaaaatagaattatttcatttacttatcaacattgattactttcttgtttttgtaggagggtaacaaatttgagcgttgttggcgaaatacctttggagctgcagaatttcacctatatgctggacctgtatggtatctatgccttatcatcttaatcctgataatcaatgttaattttgcaggaaatataaattcaactccttgttttgaatactcaactgtcgacatcctggtgaaaaccagcaaatagtagtcgggaatgcaagatttttgtgttagctaactgacatgatgtttcttggtgttgttgcaggaacctgggctataattacttgactggtgccgtgccatcattctttggaaagtttactttcatgaaatatttgtaggagctatacgtcaatttctcaaattcatgtagcatctatagattggtgttttgtgttaactatttttcatcatttaaagggcttttcctttcaatgcactgtctggaccgcttccaaaggaacttggaaacctcaccaatctcctctcgctgtaaggacttgtttttcatggcagatcaatcttcaaatataattttgcgactgcctgaactaaaataattatactagaaacgattaatcacattttttctcgacaataaatttactgtaaattcagaagtctatatgttagtcctgtcggcatatcttagcctgtaagtttcaagttgtacttcacatgttcaaggaaaattgacctgaggaaggcttgaaaatttattatgtaggtcagatggctcatcaggttaaactgagcccctttccagctattagaggaatatagctaatttattgtcatgaaatattcgttttgattcaggggcattagctttaacaattttagcggtcaacttcctaaagaactgggcaatatgaccaatcttcagcagatgtaagatgcaccatttctaatatccaattgctatttatgaataactaaattttgttatgggcagatatattgttgtacaggataacacttcaatctttcaataacaggtacatcgatagttgtggattcagtggtccgttcccttcaacattctcaaaacttcagaacctgaagatcttgtacggtcaataccatagccttagacattatatatgttcgtcatgttttcatgctaaatgtctaacatttggatgcggatgcaggaggtcatcagataacgattttacagggaaaatacctgattatttggggatcatgcctaagttggaagatatgtaagattaattatataaacttgttgacataccactcagtgtatcttattcagagacaaatggaattgttcaacataaagtttctgcatgtgtttttccatctgaactcaaacaatagaatttttcaccttccagtctgcatggaattagagtaatctgcatgccatgttgatacaaacaactttgacttaaaaatgctcatacatggagcttacttttctctattagaatgagcttcgcatgtctgtacttttctgaaagtgtgagcttgtagggctttccaaggaaattcttttgaaggaccgatcccaccaagtttagctaatctaaccaagttaaccaacttgtaagtacattgttttgggtatcattgattcgatgatggctgagagcctgacaaggtcaagctagataactgatttgtaaaatatacaaatgagcagacggattggtgatattgtaaatgggagctcttcattggcctttatcagtaacctcacatctttgagcaacctgtatgtgatgcttttacacatagagcttatagtattcacaaagtttcaagttactgaaatttgatctttttgtcacagaatattaaggaactgcaagatatctggcaatcttgcaccagtagatttttcgaagtttggagttttaaccctgctgtgagttttcactcttagcattgctacatgatttattgtgcttttaatcatttcttcagattgtgaagcatctcttgatgtaaaaaatctgtcatgaatcacagggacttgagttttaacaatatcacaggccaaattcctcaaaccattctgaatatgacaaatcttgaatttctgtaagaatgttttcattgccttaattaagtttacacaaataaaagctgagctcatcattatgttccatcatcttgtaccatatcaggtttcttgggaacaacagctttacaggaagtcttccagatgctataagcccatccttgaaagcgatgtatgtcaaaaagaccaaaatagcaccataggtcaaattattttcataatacaatgtactaatttcatatgtactgaccgtggactgtttgtagcgatttttcctacaaccaactcaccggaggcttgccttcttgggctacccagaacaacttccaattgtgagtatgaaattctgaagtttggattgaagaatagtagaattagatattctaatcttttattttgtactagaaatttggtggcaaacaactttgaacttggtaccataggccacaggtacttatgacatttagttataattctgcaagaggttaaccatcaaaagaatgttactcacaacttttatttttttaattaaaattgtccacagcactttaccttcaggactaaactgcctccagcaagacaccccttgtttccgtggatctgcagaatgtatatttctttctcttcatctacagtagtagttaccatgagcatggaaatttgaatgattgattttacaaatcttaattccagactattcctttgcggttgactgcggcaataatagaacgactagaggcttagatggaactatttacgaaccagatgctgcaaaccttggggctgcatcatattatgttactagtgacacaagatggggtgtaagcaatgtcgggaactactttctggctacagatggagtgaacataataaatagtccacagaaaattcagaatgtccttgattcaagattatttgaaactgcaaggatgtcggcgtcgtcggtgaggtattatggccttggactcgagaatggaaattacactgttctgcttcaatttgccgagtttgcttatccagactcgcagacgtggctaagcttaggaaggagagtttttgacatatatgtccaggtaaaaattgactggcttgtttactgaatttttttattctttatctgaaccagttgcaatttgcctagggtgatctaaaagaaaagaattttgatataaggaagatggcgggtggaaaatcttttactgcagtcaacagaagttatactgcaagagtgtccaaaaatttccttgagattcatctcttttgggctggtaagggaacttgttgtgtacctactcaaggttactatgggccgatgatctcagcattaagtgtcacaccaagtaagcgcaaccattatgttatcttcaacaaggattatatggaatctaataagatcatttttttatacagattttactccaacagttcgaaatggtgtaccaaaaaggagaagtaaagcaggtgcaattgctggaataacaattggtgcattagtgttaggagtagtatccttatttggaatatttttgttggtaaagaagagaagaacaatagcagaacagcaagaaggtattaattatttttatagtaattcagtctaaaactatttagatgatttactctttctcatctgaccatgaaaaacaagcagaactgtacaaccttgctggacaacccgatgtcttcagtaacactgaactcaagctagctaccgacaatttcagttatcaaaacatcattggggaaggcggatatgggccagtgtataaggttttctattatctgttactaataatgtgcaaaaagagacgagtatttatttcattttctattaagaccagaattttggtaatctttatgtgcatgttcaaaatatacatgtaataggtttcttcatttggcagggtaaactacctgatggaagagttatagcagtgaaacaactttctgaaacatctcatcaaggcaaaagccaatttgtgacagaggtagcaacaatctctgctgtgcaacaccggaatcttgttaaattgcatgggtgctgcattgatagtaaaacacccttgttagtttatgagtaccttgaaaatggaagcctggatcgagcaatatttggtgagttcaatgatgcaaatttccagcatatgacattatgcttggttgatttcactaatacaattttgcttcactaagacaagacaatttgtttttttttgtattttgccaacaactgagttatttctgcttgcacaggacatagtatcttaaaactagattgggcaatgcgatttgatatcattttaggcatagcaagaggcctaacatatcttcatgaggagtcaagtgtccgcattgtgcatagggacatcaaagccagcaatgtcctacttgacactgacctcaccccaaagatctctgactttggacttgccaaactatatgatgagaagaaaactcatgtgagcacaagaattgcgggcacaatgtaagaacatttaaccatttctcttcttaaaaccgcaatatcaatatgattgctactattaatttatcttatctttgtcaaggggctacctagctcctgagtatgcaatgagaggtcatttgtcagagaaggccgatgtttttgcatttggagtacttatgttggagactgttgctggtcgatcgaatacaaacaactcccttgaggaaagcaagatatatctcttggagtgggtaagctgatcaatgatctttccatcccagaaaacattagttcgttcgtgtttattgtcttctgctcactgaacctatgtttgtatataggcctggggtttgtatgaaatggggcaagctctgcgcgtagtcgatccatgtcttaaggaatttgatgagaaggaagctttcagagtcatctgtattgctctcctttgtacgcagggctcaccgcaccagcggccgccaatgtcaagggttgtggcaatgctcatcggagatgttgatgtggctgaggtggtcacgaagccgagctatatcaccgagtggcagctcagggatggtgggagcagtagctacaccactagtagctatgcaggatctagtaaccctgagtttagtaggcagagggagaccaaccctctcgcacggtcatcaccaacgatcaccaaagctagtctggtgggaaggtgagaattgaaagttgaattgctgcaggtgattgacccttggtttgcagtgacaatattatacgttggtgtgaattggagaaaataacataattacttactctggtttcttgtctgaaaataaaagctttcctcctataatttttgaaaggtgaattaatgtggcgtattattagtattctgagtgaataagtgtcagcaacagttgttgggtacagaattacatcatgcttgtcaaatgaatgtttgatgaggtgtacaatgaaaggccatatggacatcaatccaacaatgagaaaatggtttatggcagaaagaaatactacttcgatccaaaaatataagaagcttttgggttgaacacaggtattaaaaagtaactaaaattaattggaggaatattgtgattggttgataagagaaagtagatggagaaattaagaggtcgacgcatgcgattgcttgagaagagaataagttacatttgggacaaattttcaattctagaagttattttatttcgggatgaaggaggtaagagatttccagtattcagaaacttcgatacgaataagttcgattcttcatggcccagcaacaatggacaggatacacaactagaacctaattcatgtaaaagaacagactcgtcatagtaacacaaacactagatcaaaacaatgacaaacgtgcaactcaaactaaaatcaagaccggaacttgacacaacaattcaacttaaaattctgctcagtagactaatggaacgatgcaacaactcaagttggcttggtaatggatataatctttttatggctattttctggttaggtagataaattactactctctctgtttaaaaatagagggaaactattttatgccattgcgaacaggctctagctgagttggttaggtggctctagtaacactcgtcaggtcctaggtttgactctcagtgggagtgaattttaggctggggttaaaaaaaatcccctgtcccatgccaaagcacaggtctaaggcccagtacatgtcgttggtcattctcacacaagttacggtgtcactgtatgggtggggttggggttcggggattttttcgacttgcatgaaaaggtcttcttctatacaaaatgcttgtgggtgttggcaactatttgtgacaagttgacaatgacgatcgcagcaccttaagccttgcggtgatcctagagtcgccaaccataactaaaccggctagcggagccgatttctagataattacccgtctcgtgggtaaaacgttaggttttcaggacaaacctacaaagagatgtcgcactcttgcagcggcggcgaacggtttacggcacaaaccgacaaagatggacaaactaagagaaaactaaaagcaatatgaaaaacgattcgattgattgattgtagattggtttttttcaatgaaccagccatgtcccttatataggggttggtcttgccctctacaggccctcctccacgtccaactcggggtagaaactaaaggaaacccgaaacatgccttcccgagcaaggaaacctcgagacccgacgaaacacagtcgggctcggacctgccggtcagaccggccctcaactggcggtctgaccgcccaacacacggcggtcagaccagcccactcggaggaaaccggtagatttccaaattctggcaatttttcctattttaattcttggtgccaaattttggtgtaaacacatgcccccctgccttttcgatgaacaacgtgaatctaaaagcatagaacatgttttggtcttaggacgataatccaattactggccatagtatctcctaagcgtcttgccaaacgctcgggaagtaattcttcaagtatttcccgttgattgctcgctgaaaacgctccccttgaagtgtctccaaaaaatatgcgtttcctcgaacaatgccgcatactcgataaggaccctcccaactaagagaccacttaccgaactccttggatcgagtacccaaaggcaaaattgtctgtcaaaccaaatctccaacttgaaacaactttgctttcacccttatattgtacgccttggccacccttttcttctcattctctatctctttcaatgccttcaagcgcttgtcaatgacttcatcaaggttatctcccataaacgtcttgtaatcttcacttgacaaatcatcttgcttgatataatgaagagaaccaagatttacctccaccggtaaaatgacttctcgaccataaaccaactcaaaaggagtcactttagtggcaccatgtttagatatcctatgcgcccataatgcttcggaaagcacctcatgccacctctttgggtgttcctcaatcttctttttcactaacttcaacaatgtcttattactcgactcggcttgtccattagcctgagcgtagtaaggagaagaactcaacaatttaataccataagattcggtaaaactcttcacttccttagacataaaagaagcaccttggtccatagttaatgtttgcgaaataccgaatctatgaataatatgcttcaaaataaagtcaattacctccgtatgagtcatgttcttcaaaggcacagcttcggcccacttggtgaagtattccgtagcaactagcacggacctatgcccctttgatgacgaaggacaaatttgaccaatgaaatccaaagccctacatcggaacggccatggtttcattataggattcaacacggcggcgggcgccaattgaacattgccgaaccgttgacaagcttcgcatcccctataatatttgaagcaatcatcaatcatcctcggccaatagaaccccactctcctaagcaaccaattcatcttgtgggccgattgatgagttccacaaattccttcatgtacctctcccatagccactttagattgatcttcatctaagcactttaacaagacacaatctatatttcagcgatataactctccaccaaacaaagtgtatttgaacgtgtaacatcctcaaattttaaactaaaatttgactgcatcatgctggcttttgattaaatttgtttggttcaaaaatctatttgatgtttatttaaaaattggttcaagtattattagaacccttccaatttactctaacttattccctttattttaaaccctagtgaatttgagcaaaatctctcaaattcaaaccatagattatttctttagcctatcctattattagtggagttttgctatactctaaaccctagtgaaacccttccaaactcctagtttgaattcaaatcttttctagggaaatattcaaaaattctggaaattcactgttcattgcacccaaggtgctcgacagaatgcctagcccaattagagcaacccaacttcttccaatcttgcacaaagtttagatttggtcctaggggaccacaacccactcaaaaccgtggctttctttgcctcttcctccccttcgcgccgcccgggcatccgacttagccgcgcgccatgtcgccgcgcgtcggcctcggagccgcctgcgcatgcccgaccgccttggcgcgccatcacccgtccgatgccctcagctcaccgctgctgcaccaatcttgacgacgacaaagccgggatgaccgccgctgcacgaaatcgtcgctcgacgccgtgcgctcccatccaagccgccgccgagtgcgatttcgcttctacccggggtgaatcgcgccaattcttgccgcacggttggattggagatagacggtggtatcccctctcacaattcaaaccattcaccccaagtcggccgttttcaccctcgccgccgccgcgcgtcgtgctcggattggcgtcaacacgtcgccagccgattccaaccgcggtcaagtcaatccttcgccggtaagtattcgaacgtggcctcccgccactcaaatcgatcttgcccgccctctctcagcttctgccacctttgcctcatccaaaacccgagttcatccatggcgatgacggtgcccgagctcatccggtcctcctagccctataaataggaccccaatcccttccctgtccatcatcgatcatcaacaaccatagccccacaaccccaaagctctgcttcaccaatccatctaatcaaccaccctcgctcgtcggtcgaacaccttgtgcgcgatcgactcaacccctctccatccatcctccgccctaaataacccttagaacacctatatcctaccatgttctagcataataagccctaaccaaagctctacgtcgagttttacctcgccacaccaagccgagcattgccgcccccacgctgctctgttcttcgccgccgcgaagtttttccggccgcaatccgtcgtttcaaccaacctcggtgagttcttccgtttcaaccatctacatactacctagattccattttagcaatccttttgcacaaacatgccgccctctgagctgccgacgtgagcacggccgccgcctatggaggcgctcgtcggcaactatgtttcgcaccttgccaaaggttggcaagctgccccggaatccctctaaatacctcatagatgctctggaacccctcccctagccatgtctaactcttatcaccttgatcgccatctcggcctaaccgtgccaccgccgccctagccgctaagccgtccatgcatcaaattaactcctccgccgccgctcgccgtcgccggagatccctagctccctcccctcctcggccgcaaccactttctccctctattgccgccgcaatcctaaaccctagtgccgccagcctgacttggggaatggccgaaggtagaagaagagaagagagagagagagactaacaggtgggacccgcacacagtgccatttcacatttatttgattttcaaactttagaagcccatatcttttaaaatatagatccaatttcaatgaaacttggaccaatattcttctaaaatcattctctatcttttggaccctttttgctatttttacattttattttattttctctatttttcttatttttagattttatttaaaactcctttttgaatttggattttatttgtctaaccctaggtcttgaggattcctctgacactctagataatatcaatcaatctcaggacatcgagcaaggcaagtaaccatatacctgttgatcatttaagcctatattttacaaattatttatttatagccttctattcaatattctattttctatgcataaattaatcatagaaacccagataatttagtattgcttattttgcttacaatctggttaaaataccctatacttaggttggaacaatacgtaagatttggatgatttccgggtggctagtattgtctcaatcgatataagttttacaaggtacttatgtcgaacgaacgggtacgaccgcagtttctataatggggacagacctagttattaggttaattggcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacggtcagttccccttaaatatctcgggaacgccacaactcctcttgctgctgttaacattacgttcagagcatatgaggatataagttcatggaacaggtgccataattgttaatgacttaatactgggccatgactaaagtcgatgattatcagcaagtcgtggactgcaggtaaagcgtacatctgctgcagtagaatatctttgaaactattcgaatagccgtactcatggagttgagtaccgggactcatatggtaccctggttagaaacctaaagtttatatgttttataaactcttgctatgatttttccagattgtccaatactgctttttgcaaagaaccctattatatgtcaatgcacaacatatttccgtgataacttactgagtattgtgaatactcatccttgctcttataacccctttttcagatctaggtcaagaggaggacccttatgactattactacgaagaccccgataacttagaaaatccctaaaggttatacctcactagtcagaatgtatagaaacttccgctgtgtattaattagataggtgagtacctattattgtaaaacccatagtattgtaagactttaacgtatgcaacgaagaaccagttatattgtatgtatcattttttactgatccagggattgatacattaatcttagtcggatccaagttgttagttttgggtcccgatagaacgcttgccgccaaattttccaatcaaccttaagtgtaggatctttcaaatatcaaatcaaaggaattctccaatcttctttctcttcctgggtacaaatgtccaaatttacaattaattcaacctctaaattgattgaaacgtgccccccagcgctctgcccagaaccggtcagaccggccacacagggccggtcagaccgctcggggatgccggtcagaccggcggcatgtagccggtcagaccgcccctggtcaccagtcaaaccggccacgcaatgccggttagaccacccctggtccccagttttgccaatttcgcacaaaggtttaaaatcaagctccgactcttccaatactagaaatattctcttcttcacattatagccagatgcttgttgtgccaagtcatttgctctagaattatcacgcctagcaatatgtctaatagcaaaattatcaaaattggcaataatatccaaacatgaatcgaggtacctatttagtgatccgtccaagcatttataaactccagcgacttgttgcaccaccaattccgaatcaccaaaagcctccacgtacttagctccaaccatctccataacttgttagccgaataataaagcattatattcggcatgattatttgtacaataatactccaaacgaaccaatgcttcataacacatgccattaggtaaaaacaaaactacccctataccttgaccttctttgcaagaagaaccatcaaaataaatcttccaaggtataacttcaactaagaaaacctctccctcataagcgatatctacatgatgatccaccataaaatcacatacaatttggcctttcatagatttcaatggttcataagccaaatcataatctatcaaaacatatgcccacttgccaattctcccacttagaattggcctttgcaacatgtgtttaataacatcggcttgacaagcaattatgcatgtactagataacaaataatgcctcaatttggtacaagcataatataagcatagacaaagtctctctataaaaacatacatcgtttcggcatctaaaagacggcggctcaaatatgtaatgatatattccttgccatcttcctcttgcgttaaaacggcaccaatgactttgtcttcggaggcaatatataaccgaagaggcttttcggctttaggcactcacacaacgggtggagtagacaaatatctcttcaactcttcaaacgccccttgttgttttgcccccccaagtaaaatcggcttattttttcaagcgaagtataggaacaaaagcatcgattttacccgctaggttagaaataaaccttctcaaataattcaccttacttagcaacttttggacctccttcttgcatgtcggcgctttgaaatcacgaatcttttctatcttattaggatcaatctcaactcctctctcatgcaccatgaatcctaagaactttcctgccgacacatcaaaagcacatttaagtgggttcatctttaaaccataccggcgcatcctctcaaaagctaacctcaaatcagctatgtgtccttccataccatccgatttgacaacaatatcatcaatgtagatctctaagataatacctagcaaatcatgaaagatcaaattcattgccctttgatatgttgcaccggcgttcttcaacccaaaagtcatgacaacccactcaaacaaaccaacaaatcccgggcacctaaaagccgttttgtacatatcctcttccgccataaagatttgattgtagccggcattaccatctagaaagctaatcaccttatgacccgaggcatcattaatcatcatgtcggctataggcataggatactcatcttttggggtggctttatttaaatctctaaaatctatgcaaactctaatcttaccactccccttcttctccaccgggactatgctagagacccactccgcataaccaccgggatcaatcttctctttgactcggtcatatagcaaaggattaaaatgacgaggtggttgcttataaggcctagaacccggtttaattggaagccgatgctcaatgagctcacggctaagacccggcatctcatgatattcccatgcaaagcaatcaacatattctttaagtagctcgattatcttaaccttataatcggctctcatatttttgtttacaaaagtcggccttggtttcattccatcacctatgtctacttcttccaaaggattggccgatgtaaaccatttccctagcttctctacttcatcaaaatcttcaacggtttcaccaatatcgttctttgtagaccgatattcttgcaccctcttttgtaaccactctaaattagcctcgttactcattatacaaatttatatggcttagccgtgctacactagccggctttacagagataggtacaaatttgccatcggagatactaataaaatcataactagaaagatccctccccgataagcattgaatattcccatgacgccactcaaaagtagcatcggccattgcaacctcggccgatgtatccgcttgaacaatttcaacatcatcaccgtcccattgaattaaacattgatgcaaggtagaaggcacacaacaattggcatggatccaacaacgacccaaaataacattgtagttaccttgcacatcgacgatgaagaaagcggttggtagcgtcttgtttcccacggtgagctccgccgaaaagataccctttgcctccgttggttcgccattgaagccattgagaatcatgttagtcttcttcaactcatcatcctcacgccccaacttcttgaataatgaatacggcatcaagttcattgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgttggcttcaacttccacgaagagcggatcttccgaagctgcagcgtctacacgaccaacggaaaagaaacggcttttactctactaaactccatataacaagcagaaacaaagcacaacaatgggttcttgacttcttaaggagaaatcagagacttgaacggtccaattccgagttcaaatggtcaagttatggccatttgaaggttatatgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccccgggtcgacggcgacgacggaaatggcgaccggagcggaggaaggcggcggcgcggctcgggtcgacgaggacggcggcgttccggtgatcggcgggcgaagccgaaggaggcgatgccgaagcgggaggaggtccggggcgacggcggcggcgaaccggagctcggcggcgacggcggagaaagagggcgacggcgcgagctcgattccgacggggagaaagagcggcgagtggcggaaacggaggagggaggcacggggaacgtttaaatagtgttgggagggggagagagcggccggatgagggggaatcggccgcggaagatccggccgccattgatgcgccggcgaagttcgcgggggagtttccaaacgaatccgagggagagagagagggaaaagtgggggggaagagggagggaatcaaggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaaggccgatgggccgcgggggagaggagagagagggagggagctgggccgagccggcccaagagggggaagggggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggaagcgacaaacctaccccccttaaacggaatctcgaccccgagattcggaaggactggcgaagagatcgggatgggctgccttcagctcgtcttcacgctcccaagtagcttcttcttcggcgtggttgctccattggaccttgcaaaaacggattacccggttcctggtcctgcgctccatggtgtccaggatttttactggcctttccacgtaggtcaagtcttcgcgaacttcaatttgctctgagtcggcctgctcggatggcactcggagacatttcttgagttgcgacacatggaacacatcatgcacgttgcccaaggaggcgggcagctccagctggtaagcgacttctccgtgccgagcaatgatacggaaaggacccacgaaccgaggtgcgagcttcccttttgtctgaaacctgtgtacacctcgcaatggcgtgacccgaagatacacaaaatcacccactgcgaattccaggtcacggcgacggttatctgcataacttttctgccgggactgtgccacctttagattatcccgaatggttctgaccttcgcttcagcttctctcaggatatcagtcccgaacacttggctttccccaacttggtcccacaatagcggtgtccggcacttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtataagctgcttaagttctctgttatctggaacgcatacccgttttccgttccatagggttccgtgctcatcctctgtgaaaccagcggctttaccctgtttcatattcttgaggagtccatgca

SEQ ID NO: 37692 - DNA, 10336 bp, Oryza sativa
gggggggaaaaggacttttagggtttttctttttataaaaccattttaactttgtttatttcttcttaattattatttgtgctctgaaaattccactaaaatttatttacgcattttaggcttttaggaaatatacaaaaatcctccaagccttatttgacttttaaatttgcacattttaattgctggaggctttcacatggattttaattattctatgcataattttgaggatgtattttagagtcgatttgggacgcgacattcatggcggcacctccatccactagcatcctagaaaccggcttcccatcaacatggccatgttgatatccacgtcttcttttggagacgattcacctttatcaaccgattgttcctccttctcctctacaacaaccggtttttccttttctatggatttatgcctccacaccggtggtggtcgcaactctatgaaccttttatctccttgctcttcagcctttttctctcttagttcttgagcccgaagacgttgcaaccttctcttctgagtagccgtcaaatccttaggcatccacttaggaatcagctctgttccaggaggtaaataatgtcctctattggtcttgttcgaagacgatgaagccctcacatcgccctttgcaaacctcatatcaaaccggcgctggagcccggtcagaccgatcagatgcgccggtcagaccgacatgtggtccgcggtcagaccggccggaagcgtcggtcgaaccgccgtcgggtcggcagtcagaccggccgcatggctgcggtcagaccggccagaaggcctggtctgaccggccgactacgatgagttggtaccgacttcggattttttgtttgaggactccccaacttcatctccagaaggtattggcacgccatgagaccccactttgatagtgattacttccgaagtccttgcctccaccttgatgtgctttccttcccttttttcttcgttagcctgattcttaccataaaaccggccgttgtttggtgaagacaaacgcgcatgaattggcctcctcggtcctccccacccttggttgagttgtattggaggcatatgactgaacattggataagaaccacatgacatgtcttgtggatgatgatatggaggtgaatgcgaccgtcttggtgaatgaccaaatcgctccctaggaggtgatcttggtcttttacctttgttgcgaattttctcaccaccttgcttctcatatttctccaaaagcatatcaaaagtcaccttggtcttcctaggggctttagaagtcaaagctctactcttattctccttccaaacgccaacctccggcttctttggcactatcatctttggccttggttcgccaataaccaccccttttctcttactagattcagcttgctccggccgaatcaacaccttcttataattgaaattaattgtattcaccggaaaaggatcatgatcaagtccttcatctatggccgattgaacctgtcgtcgaaacacattgcaatcattagtataatgagaatgagaatcatgccatttacaataagctcgacgtttcaattcttcttgagatggtatgacatggcctttaggtaatctaatttgtttctcttgtaaaagataatcaaaaatcttatcacacttggccacatcaaaactatatttaacctcactttgccgatctttgcgaggagtcggcattaggttagagctaacaaaaggcttatttttgttagtccatgaccattcagcaacatatatatcatgatcaccttcctcctcactatcactagcctcagggtaatcaatcacattaacattaggctttttgttatattcaagctataacatcggtttctaacatccctaaatctcttaatataatcaatgacaggctcattatatttttgcttaaccgatgttaaatcacataacctaagctcagtttctccagtatagaaataatcatgaaatttttcttctaattgagcccaagtatgaatagaatttgcccgtaaagaccatgtaaaagtagtaccggagaaagataaagaaaacaagcgcaatttaaaagtatcactattagcctcaccacattatactaaaaattgaccaacatgctcccatgtggtcctaccatctttagcactaaacttggtaaattcgggaactctataattacgaggaaacgtcacattatcataatagtcaggatatggctttttgtaaaccctagcacgattcctagtttcaatcccgaatttatccctaataatctcactaaatatatcctccatattatcaggcctatgctgatttggcggtggatttggtggccaaataggttgtgtttgtggcgcaatatgattatattggccttgtctagtatcgggaggataccccctagcaacatcattataagcattaggaacatgcgggggaacttggggactatttgcagcagtagatacaggaggatcaaatgttctaagatgatacaaataactagcattagtcgttggatctatcccctgtaccggtataatcgcgccggtctgaccggcccagggcccagtctgatcggcatgcagaggagcagtcggaccggcttgagtcccggtcggaccgacggtgaagtcgcggtctgaccggccatcaggtctggtcggaccggccgtgtgcgccgctccatcggttccgctacccgtttggtctataggaggttggttagcagtggtagaggctttatcttttgacatgtaatcggccataagagggccgaatttaaatcttaaaaactcatcaaatttaccctcaaaagttgcatctaacttatctttaaaaacagtcatagatgaatctattgtagatgctacttgttgttggatagattgtgttacctcttcaatgcttaccaaatcgggagcgagcttaggacgtggcccgggcttgatgatcacgccttgacgagtcctagtgcatgccctcatcagcgcctcctgtgtgatctccttgaggtactcctccatagacttgcggtcttccccttcaaaatcatccaatgtgataggtatcacattagatggctccacctccgtcttggatggcggcttcgtcttggcgaagtcgaagttgagttgacgctaaacggatctcctccccagcggagtcgccaaaaatcgtgttagcaactttttgtgacaagttgacaacgacgatcgcagcaccttaagccttgcagtgatccttgagtcgccaaccacctcgatctagcaaagagctaaacctagatgggttttgataactaaaccggctagcggagccgatttctagataactacccgtctcgtgggcaaaacggaaggttttcaggacaaacctacaaagagatgtcgcactctcgcagtggcggcggacggtttacggcgcaaaccgacaaagatggacaaactaagagaaaactaaaagcaatatgaaaaacgattcgattgattgattgtagattagttttttacaatgaacatgccatgtcccttatataggggttggtcttgccctctataggccctcctccacgtccaactcggggtagaaactaaaggaaacctgaaacatgccttcccgagcaaggaaacctcgagacccgacgaaacacagtcagactcggacctgccggtcagaccggccacacaccgccggtctgaccggccctcaatcagcggtctgaccacccaacacacggcggtcagaccgacccactcggaggaaaccggtagacttccaaattctggcaatttttcctattttaatcctaggtgccaaatttgggtgtaaacagtgggctgtcgagttttcttttatgccatcgagtttgtcctagttcaacaatttgccactaacattctctccatatataatatatcaatgacttcatcaattgttctacaatacccaaatggttgggcctttattttcaaaaatacacaaaatacccttatggacatacaacattaacaattgatttatcttattagaactttcaaaaaaatatgattttttatttggcctccttacactacacggaagtttgtatataagtttcaagatttgcatttctacttttaaaaaatataactaattcgttatatgttatgtaaaatacttttttatattgttgattttaatgtagatcatctttcgtatgctacataagattttctttttgtattattatcttttgtgtaagcaatttctctcctacagtacacggaagtatttgttttgacaaataaaaatactaaaaaacttgaaacttatatagtagtgtaaggaagtcacataaaaaaaatcatttttctttaaacttgtattgagataaacctattgttgaccttatatgtcactaaggtactttgagtattttttttaaaaagccctactgaaatgacatattatagaacaattgacaaaatcattggtatattatagaaaaagacaatgtcagtagcaaattgttgaacggagataaattcaatgcatagagtagattatctcttaaaaatatataaagtgtttcttttatacaaaagacctccttgtgattatgttttttatcagataaataatatattagtaaagcatttttagtcaaagcctggtcataacatacaaaatacaccttataataaaaaaaatggagggagcagcaaagtaaaggatacatgtatacttatcaggcatcctgtgctctaataccacttaatgtgaatcggtgctcaatattccgataaattttatttgcaggcatgaagacattaatgtttggaggtttctgatcagcctatcgtcaccttgtaactgctgcacctgcatgactcattataatcgttcatgttctcacacaattaatctaaagaacaaggaagtgtgatgcctgaattacatataaatgtttaacacattaagttagtttcgacgaactgatctagcacaaactacaaagtagaagaataatctagaaaaacctaaaccctaaagacgatgacatgtacctaattatgagtgaggtgtggtgtaaagtcatgcataacatagactagatggccaaacaaaactccatctcaacgcccaaggccctatatttggaccggaagaggtatgcgacttgatatcatgcagccatgagttggatcggtagacttcataaacattccaagaaggcccccaagcaatctcttggatcggtagctaggtttgtttgaagttgatcccgtcaggtgggccaaatctaaatccaaaacatgcagaactttattttcttcccttttaagacgacaaaagtgacatggggaaatggcaggaggcttagggaaaacctaaagctggtcccaatcatctgtgcatttcttacccatgcttcccatttcttcaaccatgcatgcctgcgttcacacggttgctatattgtgtgaacaggcttgtaactgctatgcacatactcatactcatgtatacccattaaatgataatggtatagaagaggggattaaaacccataattccaatccttaaaattagtataatccatcatactagtcatccatctcatgttgcctgctggtaaatttctccgttttcaacatacatgatgtcttcatctcggtcatgatgttggctcaaacagattgtagactaccctcaatatcgtcaagtccatcagtaagacgaccctcacgatcctcaattctgtcgggcagcggacaaccgtttatccatgcgctcaatggagttcctgatgtccattttcgcatgtatgtctttcagccttttaatcacttggtctattgcaccctacatctgagcatgactaacacactcgttgaaattcttcgggctgctatctccgctttacttttttaacgaaaactacgaacagaaaacaaaaactcaagagattattcctatcagctgctagaacaaggattgcagtggagactagctaatggaagtgtcttattaaactcttacaagtgtcttaccaacaattctaaggatagtacaaccggtggacgtgataccttgagggtgcgatctagcgactgtaacggccgaagctatgctaatcagaagtatgtatgtggagtttgggagaacaaatttgtttttggtagaatacaattcagtaacacatagtaatgttgagtaaatatctcaaagtatgtgtatgcaatcactagttgagacacgttcccaagcctaatcagtgagaataaaaaacaaaccacttaggacagttctctcacaaagtctctcaaagcagctcgaggaaaaacaatattacacctcctttatcacctttttattcacttcttttatttattttcattttcttctcaaccacaggcatgaaagtagaagcacaatatgaagaagcaactcaagctgacgaaagatgcaactgtagaattttgggagcgtcctttaaaatttgtgctagaacttcgaagctcgataactcaatcttccatgccaaatttagtaaaatttttttggcaaaccagatgaagtgcagataatcctatatactttttctatagatgtgcgtagattaattttttacccaattccatgtccatatgtaaaagttatatctgttttaagataggtgacacaagttagtgtttggaggcatacccttgtttctctggctagggtaaaattgcaaataatcctcaagaatgcatataacctactgtttaactacaatattgctgtgggtggcaaaaggtagtaggatccttgtagtcgatagagagacgatagtgaagtggagcccatatgtggtggcaaggagttgctcttgtgggggtcggtcgactacgaatcacatgtacaatttagtaacacctagtctgtccacgggtggccaagtgcgaagccgccaattgatctcgtcattccgtaaatctgatgcctgaaaaatctgagccgctttaagttgatgttttttattgggttatgttttttaaggtttgttttgtaacaatgaagaaatcaagttaacagaaccgagaaaacaataaaaaccaaacacccatccctattgtgattgattaggtcattaggataagagagtacgtggagaagtcctcatattttaaagaaaaaaaaagtatgttttacaccctcaaactatttcattatccacttaaacctctattgtaatatttttgactgattttaccaactaaagtcttgtttgttctctttacatgacccgtattttctgctagaattttgtagatccattggtaatatcattattaatgttcaactttttttgcaaaaattttcatgtgtatctttttttaaagaaaaacaataggggaggtcccccactattaaataaacatttattaatgaaagaaataaaggaaaaataaaaaaagaaattacaacaactgatccatctcatgactacattttgtctctctcatttaacctaaaaagcaaaaggagaagatcacccttaaagagctgtatccaagaagacaaagaaggagacttattatcaaaaataaaatcatttatttgctttcaaatattccatgccccaaacaagaatttttcaataaaacaatggccttgatatcgatgtctagcatccactatcttgttctccagatgcaaagaaatgtcccaagaaatacctatagcattccagcaactcctcatgaaggggcaatgaaaaaaagaagtgaaacaaattttcaaagattggattgtgcatagcacacaattcaggtcacagtttggacggccaccatgcttattatccaacatatactttgtgtttaatctgtccatcagccaatgaaacattttaacttttgaagttgctttactctttcataacaataagaaatgctgtggtagctgtggcccgggctaggtggatgcgggcgaggcctcagctcgccttgtccggcggtggtgacgggcgtgaccggcgaatcggacggcggcggcatcgggcgtgactggcgaatcggacggcggcggcatcggccacgtggcatcgggcgggaccggtggaggactaggctaggtggatctggcgggtggctgtggcatcctcgagtgtgacgggctgaaacctaggccccacagatttgggagtggcagcggcggcacatgcgagcactggcttggagaatccgacggcggcgggcttgaccggcgaaggtgcctcttttcttcctcatcgccagtcggactcagctcccgctcctgcctctgaagtgcttctaggtcctgctcgatgatgttgccgcttcacgtcaacctcctggcgcttgttcatgccatcatcagctcagccattcactggcaccacgttgatcggtacatacgctccagatgaagggagaggaaggagattaaggaacaagatgaggatattttggtccagaaaatcttgtaagttcaccaaagaggtaagtagtggcttatctcaaatatatgtaagattgtaatggcatcacttcaaatagttgaatagtaatggtatttttcaaaatagataaaattgtagtggtatgatccaattaacccaaatataaacccatgtatcttagcccggtgacaagttcacctcttctaacagttaaggttgtaaaatgagtaaaagaaatagtttaggggttaagttaaccaacagaatagttttggggagtagtattgattttttttctagtttaaaacggatgaaatatctatgttagcaggaagtgcattttggcacgttcagagcatgagagcagtgctttaactctgacaatgattggaatttcctagacgtttcagtgtttcgtcgaagaacaagttccggccggatgatgattaccgagctaggcgcatgtttcttgggtgttttgcgggtgttccttttttttttttttgtaagtttctttcgggtgttttggtcactacggagattctgctgtacagtagtgatgtctgcagtagtcgtcaacacaacagttagctggatggcgtatgtaacttggacctatttgctttgtgtaattgtgtggtatggtttatcgccacgagacacgccgcccaagtatcgacagctcagacatttcgtatggccatatagctcagacatccacccaaaggtaccatcgatgtcatcctgctagcactgcaataatcatgcgaccatgtatacataccagtcgttccgatttcacgattcttaacgttgaataacgttggacttaaataattaaaattttactaacctaataaccataaaaatatttaacttgaagacacttaaacacgacgtcaagattagtctaaaaaatattttaataaacatagatatttacttattttgtacacatattataataaaaaattgatagtcaagcatatttcttgaaactatgttattgtctaaaacgccgagagctacagaactaggtagagttgaaatatctgtttcctttatttttgtggcaaaataataaagaaactgaatattcatttttatggctgttcaagagagccgcctttgaaaaatcaattttattttcacacaggcgtgctattgcgcgaattaatcagcgatttccacccaacccttagttggatgtggttcaaacaaacaccggtgtagataagttgtccaccgtctaaagggtatatatatattagtgtagcaattgtgttttcaccctcactttcatatacaattgtgatttttccctcttttttagggtttgtcaatttgttgttgttattttgaaatgaaactaccgtttacccctagttcagatggctgttaggtgggcatgaaactattgagttaaattaaagaaaaaatatttatgaaacaaaaaaatgaccattctaaccccatgtgtatcacctacccatgtccaactcatttccaaattcttattgttagcttattgttagcttattgattggttgcttgcacccatgcatgcatccatccaccatgtgccattggcatgccgacgaagccgccaactccaatgtccaatcttgtgtcgttcttctcttgtagttgacttcctttgttcgcatgaagcaaatgtttatgcaagttgtgttaaatacaaccgatcttttatcgtggtactcaaaaaacaaatacctcggttagatttagaaccggtactaaatttatttttagtactggttaaaaaagtctaagtcccaaaaacatctttagttcctgtttaggttaccatctatagtatcagttgggaa

SEQ ID NO: 37693 - DNA, 6182 bp, Oryza sativa
caactcatactaaagatgtctccaaggttagattaaaaagatgtgtgcaataggtgggatggtaacacgtacatgtgagtgctgagatgagagatcgtgagttcaaatcccacattctgcataagtttgttaaaatagaccaggtttgaattatgtgaaacatcacctaaaaacaacggtcgggttgtgccgtgcctggtccgggacaaaaccccatgacatgggtcgggccattaggccacttgccttttggccatctataaatagaggcaatgccaaattccttgatatcaaaacaggactaaaacacaaatattcaataatatgtaagggtatgcatatcattttttttacaaacttaacaccattaatatgaattggcagaataggggtaaactgaaacttcacttcgaaaaagtatggacaaaataaaaaaccctaataagtgggaataaaatcataattacaacttaaaagtataagtagagataagaacacaaatacccctaaattaaacggcgattaggataaactgaccctacatactgttatatacgttactgttggcctgttgcagatgcatcaacgagttagggtgtgtttagttcacaccaaaattaaaagtttggattaaattggaacaatgtggtggaaaagttcaaaatttatgtgtgtaggaaagttctgatgtgatggaaaagttgaaagtttgaaaaaaaactttgaaactaaggctgtgtttagatccaaacatcagtcattttccatcacattaacctgtcatacacacacaacttttcagtcacatcatctccaatttcaaccaaaatccaaactttgccatcaactaaacacagcctaaaccaggccttaggcgaaagttgctgatccacacatcagtttggcaggcatcagaatttttgtccggtcattctcctacagtacacaagtgcatataattgctctcgcatggacccggaccagcagagattgaggtagcgtgcaggcggtgcagctcttcgtctctcaaaatctcccaattaccgtacagaggtacagagttatgtgattgttttggaagatacacgtgcttagtcctatataaagcagctatagctagttaaattaaagcaaccatatcacacagaagatgcaaagctagctagttttcacagatatcctatcttataatattagattaatagtacgtatacacaaagcttctagctacttaatttctcggtcgctgaaagggcactatgtctgcaagctccatccctctccctctcttgtgtaatggtcctcctgtgcatattagggttagccatccgccggctgggcttcttgctcgttcggatggtgtccgagcaaaaggttacttccggcaaagcaatgttctgcgacatgcaagtggacatgggattcgatccgggaatgagctagcgtctagctttgagccctctgcgtggggggatttctttatcaactacgagcccaagcccctccaggcatatatatacatattttatttttcgtgcggtatatgtttgattctaataactctgataattaaactatacacctttgatatcccagataattttgatacctaagtgttctcattatatattcatcaagattggtgcaattttcaaatgtaaaatctcataattaatgcttatgttttttatttgtctttttttaaagtgacatatatagttctcatgtcccaagtacggatcaattgtgtttcattaattttgttttttattctagttatctttgttctgctttttgcaaaacatttgtcatgccacgaattgcacaaattaattatattaattggaaatcatttaattgaccttattaactgttcatttcagtgtattttttctttcactcaatcataacaaatcaaattcatgctgccaaataagcagagatcagagggatggatgatggagatggccgaaaagctaaaaagagatgtccgcatactgtttgggacctgcaatgatatattggagaagatgaatttaatagatgcagtccatcgtcttggaatagatcaccttttccaagaagaaataggaagtgcaataagtgacatcaaaggaagtgaattcactagctctagccttcatgaggttgctttatggtttcgcttacttagggagcatggcatttgggtatctccaggtattgttctacatgctaaaacctaaatgatactagcgaagcatgtgttaactgatataaggaaatctgaatattattggtttccttaaaaaccaaaacattttttgagaactaaaaagaactataactaattattacaaataagtatggcttccaaaattctatgaaatcaacaaaaagttaattccagcacatagtgataggcgtttttggaagagttgattgccaaacttttgaatgttctctttggattagaattatttaatttccttatcattttgtaggcgattcagaattgcatttatttgcattaattctgtggaacaacttctctgtatctgtccgaactaaccacactacaacctctgtttcaaattgctcaaattgcttgtcaatctagctttttgttaagtcaaacatttctatctttggtcatcaattttagaaattttgggtaatttagaaacatatgtattatgtatttcggaagtatttttcatgatgggtgtacaaacataaatattaagacttaaactatacggtggcgctaatacgcgcgctccacgcggaatattactttgagcgccacacaacgctccctccttccgattttccttttttaccaccccacctttcttccgtctgcttttttcgttttttaccaccccaccttccgtgtttcttttttctcttttccacctcattcgttttcatcaaagagcccggtaaaatattaaccatccatatttttccctttttcgttcgttctctccagtttttctgttttcacattttagtaaaatatttactgtctagtttttctttctaagtttttttatttttctagagtctccccacgtttcaaaaagtaacgaatttactctatagagctttccatttactcccggcttcccatatctgcacattcaaaagaaacaaatttactcgcataaatgcccccttcaaaagtaacaaatttacttgcacgaatgcccctacatcgtacgacaccattcctagatggtcgtaaaagaattactaccagcttacaacgctagtagttcatttaccagtgttataaatattgttcagacttcatggtctgtgagtaaaacaaccaccaccttcctcttgatatagcccgtgatctcgtagcctgcaatttatttactgatgtgttcaatacatagtataagaataaaaactgatactaaaagtattgttaatttgtatcacgaaatggtcgtacgaatgaaaaaaattaatggctcaatcacacacgagtgataaaatcacttacaggtgaattaaactagaaaagaaaaaaatgacagtttctacctggttacaagctctgtaatatttatgggactgttgtacttgtatattttatacattttataactttcttttttgttttaatgtattaaaagtaatgggggatgcctcgttgtaattttactaaaaaataaatccattgtgaatctgggatccttgaggctttcctggatcttgctataaggatggagaggctgacctatgtcttgtgactggtagcggagagggtaaccaggtggcgtcactactacaaaattaatttttcatggcaccaccttttttttttctctagcagttatacgtgtaaaccgtcagcaaaaatattacaaggggtaggggggctacggaccgccagcgaaaacagatcttcgctacggctgggttaagagggccgccagcaaaagtataactattttcgttggcggcccacttaaggaaccaccaacgaaaattggatttttggtagtggtcctctttaccagctgcctgtgaaaatctctattttcgttggtggttggtaaagaggaccgccaggaacaattcgatgttcgccaacgaaaattcaatgttccctggcggctactaaagtgcactgctagcggaaatcataccgcacattacaaaggcagccccaccgccacccactcctcctctagatacactgcctcccactcctcctctctttgtcctcgtctctcctccgcacccttctcctccccctccaccggcgactccaccggtgttctccaccgcgcggcttgcatagtcggacgggccgctgggcctcatggaggacaccgtagggccgaaggaggatggatccaccaccaccaggacgcggggaggacagatccgccaccgccgagccgtggggaggatggatctgccgccgccagtccattgggagcacggatctgccgccgccgagccgcggaggcacggatccaccgccgccgggctcctccaaccgcctccccactcccaggtctggaggctgcggatcagggcatggacttcagcgggcgatgtcacgtgccgcggatccaggcgatggaggggcgtgggcggcgggcgacaatgaccaagaaccatgctccagcaagttccaggaggagacggcgttccggagctggccttcctctcgctgttccaccacaagcacctcatcggcttcctcggctactgtgaggagaacgacaagcagctgctcatctaggaagtgtgattgtggttggggatttgggacaacgatttgggattgtgattggggattgggacaatgatttggaatttctcaaaactattttggacctagattttctatggttgtgattactgtgattgtgattattgtggttgtgatgattgtgattgtgattgtggttattgtggatttgggggatttaggacagtgattgtgggtcggagaattatggattttggatagtaattggggatcttgatttttatttttttatcctaaaatcattttcattggcggctctcactagccaccattagtgaaaatcaccttttctctagcagctgtcctaactttgctgcctgtggaagtcaattttcgctagcagttggtggaccactagtgaaaatttattttttcactggccttaggtttctggcagtgttgccggccggcagcggaaaaagcctttttgtgctagtgcgtgcggtagtagatgatggaatgatggaaggatgtagctgcgtggtatagagacgatctcgatgttgcgcagtagcagttattcgtcatctagaaagcacgaaaaaaatgcaaaaaacattctcgttcatgtcatacaaatgacgagtaaaagaaaaataggaaacaacctccatcaccggcggacttcaccctatcctctgcggcaaaccacatggagcatgatgtccaaatgtaggacatgtgcagcccatcaatttagatcaggtaatattggagattgcatgttaatttgatttgcaaaatgaatttggggcttcacgcatgaaggtgaaggagagtatgcagatgcaaattggagtgtcatttcgttactttcttattctgccaatgtcgccgacatggagcagtcgccggttattgctcttggcctaggtgaacacctccttgctagttaaggtgctgctcggcttccagcagcgaaccccgaagcaacgtccattgtcgcgtcccaaatcgactctaaaatctatcctcgaaattgtgcaaaagaataattaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctggtatcttcctactcccgccaggtacgccgccgcgcccgtgccctatcgccgccg

SEQ ID NO: 37694 - DNA, 11393 bp, Oryza sativa
tgggacccagggtcgggttgccagttcggtctgaatcatcataggccttgggttaaggcaggttcgtgtgggttcacggccttgattaataatattgtatagttctagcttcgtgtttacagaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgctgcttttctctttgtttttgtttgtagatggccggcagcgttacccgtcgtggtttgagcatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgctagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaacctgcagctcaagaaggacctcgacgcgttggaggcgcagccgcaccagctcaaggtcgcccagggagagatcagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggctcgcgtgtgtttttcctcgtttgtctttttgagttgtgtggggcatggttacgccggtgtgtggtgtaactatgtcggagcctgtcttattttatttgcctaagcaacttgaaccttaatgaaccaatttaatagcagtgataaatttaagaataatagtagtcgtgggtggttagttttaatcgtcagctctctctctctgtttgctggttctgtgtggggttttcagatggtgtcgaccaggagaaatgttaacaccggtgaaggcaaccacccgagggcagcaaccccaacccccaaggcaatccacctccaccaccaccaccagacaccaacgccattctcacccagatcctcgcccagcaagccaacatgatgaatgctttcctccaccacctccaaaatccaccacaacagaatgctccaccacctcctccccaacactccaaactcgccgaattcctccgcatccgcccacccaccttctctagctccaacaatcctgtagatgcgttggattggttgcatgccgtggggaagaagctagacacggtgcagtgcagcgacgaagagaaagtcatcttcgccgcccatcagctgcaaggacccgcatctctctggtgggaccatttccaggctgcgcagccagaagggcaaccgatcacttggactcgcttcaccgccgctttccggagaacccatgtgcccgctggagtcgtggctcttaagaaaaaggaattccgggagttgaagcaaggcaaccgctccgtgatggagtacttgcatgagttcaacaatctggcccgttacgcccctgaggatgtgcgggaagatgaggagaagcaagagaagttcctggcaggaatggaccccgagctgtccgttcgtctagtctctggggactacccggacttccaacgactggtggacaagagcatccgcttggaagccaagcacaaggagctggagtcgcacaagcgccgcttggcgaacatccgcaatcaacagggtgctaaccagagggtccgctacaccaatccctacccagggggatcctcctcgcagcagcagcagcagcagcagcagcaacctcgctccgcgcctcgacctcaattcgtggtgcgcgtcccacagcagcaaccgcagcagaatcagcaagggactcgtgcaccccgtcctcctacgccagctgggcagcccgttcaaggccgcagggacgcttcaggtccgcagcggctgtgcttcaactgcttcgagcccgggcactttgcggataaatgcccaaagccaaggcgtcagcaaggccaagcgcctccccgccccaacaacggtggcaaggatgtcatccgtggtcgcgtgaaccacgtgacggccgaggacgtgctgacaactccggacgtcatcgttggtacgttcctcgtccattccatccccgctacaattttgttcgactctggagcttcccactcgtttatatctgtgccattcgtgggaaaaaatcagttgggggtagaaaggcttaggaaccctctgctcatcaccacccctgaggggttatgacagcaaagtattatagtcctgccgtccctatagaaattcaggggattccttttccctcggatttgattctgctagacaccaagaacttggatgtgatccttgggatgaattggttggctcaattccaaggagtagtggattgcgcgagacgcactgtcactctgtaccgaggtccggaacaaccggttgttttctttgcacccccaacctctgtccgaagttcagaactgcatcagataggactgtcagaaatccccatcgtcagagagttcggagatgtatttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagttaccatcaaaaacaagtaccctcttcctcgaatcgatgatctgttcgaccagcttaaaggtgccactgtattctccaagattgatcttcgttccggatatcaccaattacgtattcgtgaagaagatattccgaagaccgcattcaccacgcgatatgggctgtatgaattcacggtgatgtcgttcggtttgaccaatgctcctgccttcttcatgaacttgatgaacaaagtgttcatggaatacttggataagttcgttgtggttttcatcgacgacattctgatatactcacaaacagaagaagaccatcagcaccatctccgtctggtattgggaaagctgcgggaacatcaattgtatgccaagcttagcaagtgtgagttctggttgtccgaagtcaaattcttggggcacgtgatatctgctaaaggagttgctgtggatcccgaaacagtgaccgccgtcaccgaatggaagcaacccaagacagtcactcaaattcgcagtttcttgggtttggcaggatactaccggagattcatcgagaacttctccaagatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgtcctcatgaaggcaactaccctacgcatgacttggagctagcagcggtggttcatgctctaaaaatttggcggcactatctcattgggaaccgctgtgaaatatatactgaccataagagtttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaactctatggaacggaaagcgggtgtgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggacttccaaaaacccaaggaggatatgattccatatgggtagttgtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcgtatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagtcggagaaagccaagtgttcgggactgatatcctgagagaagctgaagctaaagtcagaatcattcgggataatctaaaggtggcacaatctcggcagaaaagttatgcagataaccgtcgtcgtgacttggaattcgcagtggatgattttgtgtaccttcgggtcacgccattgcgaggcgtgcacaggtttcagacgaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtctccgagtgccatccgagcaggccaactcagagcaaattgaagtccgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcctgatctcttcgccagttcttccgaatctcggggtcgagattccgtttaaggggggtaggtttgtcgcgtcccaaatcgactctaaaatctatcctcgaaattgtgcaaaagaataattaaaattcaatgtgaaagcctccaacaattaaaatgtgcaaagatgaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctgtcatcttcctcctcccgccgcttccgccgccgcgcccgtgccctagcgccgccgccgccgcgaatcccgccgctcccgtccgccccgcgtgcaatcaagaggggggatttactccccgcgtttccctcccccgtttccccctctttcccctctctctctccctcggattcgttcgaatcaagcccgtaatcgtcgccggcgcaatcaatggcggccgagatccccgcgcccgtttcctctctctccggccgctctttccttcctccggcgctatttaaaccctccccgagctccgcccttccgtttccgccgctcaccgctcgctctcgccgtcggaatcgtgctcgcgccgcttttccttctctccgccgtcgccgacgagttccgttccgccgccgccgccgctccggttctcctcccggctcggcgacccctccttcggcatcgccgcatcgccgccgaccccgtccgccgctccgcttcgtccgccgaccgccggagcaccgtcgtcatcgtcttcccgagccgcgccgccgtcttcctccgctccgtccgccgtttccgccgccttcgctgtctcggggtgagccgtggaccgtccccttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggaatttttaattgaaaattaaatgaagaaattcgcaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgttgaagtcgaagccgtcgattgggaaaacgagcaaggcaagacacatcatcttgatcatattgaatcccagtttacaaaattatgttgatttaaattattgcattatcgctttatttaaattcccgcgttatcactgttttatttagccatgcctatttacctttgttatgaccatattattattgttattgttattattactaccttgttcaccctagacaaacaaaacctcaactagtggacactctactcatagtaccactagtataattctaggtagatgcttcgcaagttaattaggcaacattaggtggttttacaactctagacttgggaaattctcatatcacttggacactctggaattgttggattattgtggaattggcttcacaccgccccctctattcaaaattccctaaaatggttttaggctgggctcggggtgcatggtttggatggtagcaccttggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcggaattgggtcggtactcttgtctaaggctaggatgggttggaaactatgtcacgtcttccgtctgtataccgtggtggtatgtggcacgtggtaacacgtgaggaagccgtgtcttgtgggtaaagatgtacacctctgatcagagtataatctattcgaatagccgagccctcggatatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattgtatagttctagcttcgtgtttacaaaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacatccatggtgcgtcatagatctatgggctgggatggtggatcgattcagatcaggaaaaaaaaaggaaaaaatgaagtgggggtgagagtggttggttgggtacaggaaaaatataatatataccagaagcaaagaagttgtttttatcgaagtaaatcatttactccattagtggtgggagcgggatgacaggacgtgtggtgggatcggaagcagggaagttgtttttatcgaagtaaatcatttactctgataatggtgggagcaggatgatgggacgtgaggtgaggtaggccttggctgatatatgtttggcgctcggaatactagaagctcctagtagtatctctataataagatgttttaaaaaatcaatggtcaacaatacaaatatttaatttaggacaaaattaaattgaaactgagggaatacatagaacgaaattaatgtgatttggagaagtggtttcctttatatgaagaggattatgtcttgcagatgcattcaggagattcaaaggagaggatggcaggttcatcaatactggaatagctgatgaaccgagggggttattaagtttatataatgcagcacatctcctcatccatgatgagccggaacttgaagaagcaatctctcttgcaagacaccatcttgaattaatgaggggtggaggtgggctcaaaccccctctagctgatcaaatcaaccgtgccctagatttaccattaccaagagcctacaagagaatagaaacattgcattatatgctggagtatgggcaggaagaagggcacaatgtggatcttctggatcttgcaaagctagaatttaacctgctgcagcatgtccacttgaaggagctcagaaatttttctcagtaagcatgtgtttatttgttgtacggggtatatatatatatatatatatatatatatcatctaagtaaatggatatgataaaagtaattaactctgcgctttcaaaaagtagctaatcatgataataatatcaaatgatatgcatgtctcaatgatgttctactttggtattaccagaaaaaccttgttttggcaattcatctaaacaatcagccgttataaagtctactggccctgcatagagctggtatacaaatattttttatggaatatttgtatacgatcgatggacagtttgttcaaatggtctctattggtagtagaatcgatatctagactgcccatcgatcgtttatgttccaacagtttgtatctatttatactgccatctcaactactaagtagttctataatatgttttatactggtattaaaactgacaaattaacggttgctatcactccactagtgataatactagtatagtagtagagaccaccgtaaaggtattctcagtgaaatggatcttcacattggtagtattttaggtctgcttgataggtatacacgtccacattattactatcataactaaacacaatgctactctatcttaaatacagtattaaacatgcacctgaatcacttaattttcaggtggtggaaaaatatctatggatatgtgcaactaagttacgccagggatcgtgcggtggaaagttacctttggtcctatgtcgtgttctacgagaaagatttagtgctttcacggatgatctttgcgaagatatttgcactgcttgtaactatggatgacacgtatgatgactatgccaccatcgaggaaagcaggaagctgaatgaagcgatacaaaggttggattaatatgaaaaaaaaacagggcaaatatccttgagatgaaaccacctgtgcggtagtattgcgaaaaccactccacaaccgcaaactatacttacaagtttccaaaagttccaaacaaattctctcaaaaaacctgagttacgaatacttttttgtcaagttggtgagacaatattt

SEQ ID NO: 37695 - DNA, 642 bp, Oryza sativa
gcttcaggtctgcagcggctgtgcttcaactgcttcgagcccgggcactttgcggataaatgcccaaagccaaggcgtcagcaaggccaagcgcctccccgccccaacaacggtggcaaggatgtcatccgtggtcgcgtgaaccacgtgacggccgaggacgtgctgacaactccggacgtcatcgttggtacgttcctcgtccattccatccccgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccccgccgttcctatagaaattcagggaattccttttccctcggatctgattctgttagacacaaagaacttggatgtgattcttgggatgaattggttggctcaattccaaggagtagtggattgcgcgagacgcactgtcactctgtaccgaggaccggaacagccggttgttttctttgcacctccaacctctgtccgaagttcagcactgcatcagataggtctgtcagaaatccccatcgtcagagagttcggagatatttccggaagaactacctgg

SEQ ID NO: 37696 - DNA, 417 bp, Oryza sativa
  unsure (1)..(417): unsure at all n locations
cccaggcgagggtgggcgtgatggagttgggtcggccggggtgtccggttgatcggcttccggattcaccgcggcacgaaagggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagttnnnnnnnnnnnnnnnnnnnnnnnnnnnnnnnnnnnnnnnnnnnnnnnnnnnnnnnnnnnnnnnnnnnnnnnnnnnn

SEQ ID NO: 37697 - DNA, 3093 bp, Oryza sativa
cgtgacaaatccaccccccttacaagaatctcgtccccgagattcgaggaggctagcaagaagataggttgggcggtcttctcttcttgtccgacttcttccgctctgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgaccttggtcactaagtactcttcactccgagagttgtggatgcttctggtggcgatgaggtcctttggtctgctacctttcagtgaaaccttgaagtgtttcgccaaaagctacactgactgtcattgcctttgatccggaaaaaacacatctgaaactcttagtccaaacatatgtctctttggttaatcacttgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacgtggagttggaattggcggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggtcactaatggggccagaaccatggttgttggtggtatcatcagcattagtattgctattgtggttgtctgcgttgcgttcatctccttggggcaggaactcttgatacacaacagaagatccggtgatctgaagtggctcagtgcgctgtctttggttgccacctggaaatactgggttgttaaccatccttctcttgcagttcgtcatccgactatgctcactttcgagttgcatggctttgtccacaagtttctcaaaatcttcataatcctctaaaagtagttgcactgcgagctcatcttttaacccctggaggaacttctcttgtttgtcttcatccgtttccacatcttctggtgcatagtgagccgaacgatagaactcatgcaggtactctgtgacggtcaaatctccttgcttcaggtagcgaaactctcgttttcttagtgtgatcattccggcgggaacatgtgatctccggaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgtcggttgcccctgctgggttgttccgattctgtaatagttgaaaggctgttgccaacatgttggtttggttaaccacaacttggattagctctggtgaggtttcgttgatgcttttctcattcccattggcttgggttcttgagtcatcggatccatcattcccatagcctttgttaccagtactatccatctgtcacaaggtagaggttgagagggaaagcatacaagggaagaatagaccagaactagggacaagaccttaaaggaactaactcttcttattgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttccctccttcacagctggcttcactacttcctccatttcgctagcggatcctgcagtcttccggagcttcggcaaacaactgacgatgtcttcttcttcactgacctgaccatctagtactagttgaaaatccgaagaaggaagaacggagtaaaccttttgcaaatagcattaggggaaggagaaaaaggaactttcgcaaataatttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctagacatcttct

SEQ ID NO: 37698 - DNA, 634 bp, Oryza sativa
tttgagggttttttgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccctgggtcgacggcgacgacggaaacggcgaccggagcggaggaaggcggcggcgcggctcgggtcgacgaggacggcggcgttccggtgatcggcgggcgaaacggaggagtggacgaggtcggcgaggacgcggcgaagccgaaggaggcgatgccgaagcgggaggaggtccggggcgacggcggcggcgaaccggagctcggcagcgacggcggagaaagagg

SEQ ID NO: 37699 - DNA, 655 bp, Oryza sativa
tctcttctttcttcaacaactgtgtcatgggtcgagcgattttggagaagttctcgatgaacctccggtagtatcctgccaaacctaagaaactgcgaacttgagtgactgttttggattgcttccaatcagtgacagcggtcactgtttcggggtccacagcaacacctttagcagatatcacgtgccctaagaatttgacttcggacaaccagaactcacacttgctaagtttggcatacaattgatgttcccgcaactttcccaacaccaggcggagatggtgctgatggtcttcctccgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagtccgtatcgcgtggtgaatgcggtcttcggaatatcttcttcacgaatacgtaattggtgatatccggaacgaagatcgatcttagagaatacagtggcacctttaagctgatcgaacagatcatcgatccggggaagagggtacttgtttttgatggtgacttcattgagagctctgtagtcaacgcacatcctcttcgtcttgtctttctt

SEQ ID NO: 37700 - DNA, 6137 bp, Oryza sativa
gtggaggtgggctgccatggttgttgtggttgctgccttcgggttggttgccatcactggtggcagcatttctcctggtcgtcaccatctgaaaaccccacacagaaccagcaaacagagagagctgacaattaaagctaaccacccacgactaccataattcttgaatttattactgctattaaatgggttcattaaagttcaagttgcttaagcaaataaaataaagacaggctccgacacagttacaccacacaccggcataaccgtgccccacacaacccaacaagaagacaaacgagaaagaacacacgcgcaagcctactaactgctcgtctaccgctgcgacgggccagggcggaaggtgagcaacagcgcatcctccgtgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcggcgcttggggcggcagacctctccctgggcgatcttgagctgatgcagctgcgcctccaccgcgtctaggtccttcttgagctgcaggttctcctgacgcagctcctggatcttcatgttgttctcgaccatcccacggcgcaccatctgatggaagtcgatacgagccgcgtcgtacgcctccaccatgcgcgccaggtgcatgatggtagcgtcatccttcgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggcaagcggcggggaaggaatccccacccgcggtgactgccagcgaagtccgctcgggagagccagagaggatcactgcagtaacctcccaaccagcgtggggctctgcgtcatcaccctcctgctccggaagcggcctggcctggtagtccactccatgtggataccctaggaccacgcacatgccccgcagctccaagacgaaaccagtcatgtccaaaccacgacgggtgacgctgccggccttctacaaacaaaaacaaaaagaaaagcaacattttaaaggtcagattttggcgataaatgaagcagcaagacagagagagactagacagttttcacaaataacaaaaggatttttatttttgaaaatattgctaaggcttgggatctacggctcgtcctagggtcaagggggctctgataccaacttgtcacgaccggaaataacccaacgggcgttccttacgtgcgtgcattaatccttgtcccaggaggtaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcatgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcctagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatctgtcacatcctgattttcgtttcaggatttataaattatttaataaattattaatagaatttatattaaatgatctttaattttcaagtgaagtaaaatgtgggaaataaaattttctaaatctaaagcatggatggatttaatttttgttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccatataaaatttcattaaatactttgcttaattctataattcctagatttttctgggatttatttgagctaaggaagtatttttaataaatggaattgcatttaagaaataatttaattgaaaaaggttttaaaaaagtcttcttttggctttgggccgaaagccggcccaaaacccttctctctctttccctcggcccagccggcccagtccgccgagccgccgctcttctctctctcggtgtcgctgacaggtgggtcccacctgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgacgtcggtcgccgtcgccaccatcgggttcgccaagtcgtcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcttaataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgcgaaggttcacgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttctcgattactttattccttgataccttgggtgattataattggactagttgagctttatatatattggttcaactagatgttagatataattgcttagccatgcttagaaacattagcacactattgggataacttatgactcactattatttaatgatggcttaatgatagttcacgatggtcaatcgtgattgattaattaattacttgccaactaaaacttgataatggtgggttgtgagcacatggttttgagagtcgtgctcatggcaattaaggaccggttcgcgagctactattgtggaacattaaccgtgccaaccacaagccagcgtgggcaacggctttaccttttgtatagcatggttcattgcggggcaccagactgagaagtggcggagataagcccacgggggtcgctggggagtccatgccttgttttataagggggtgattatgatccaggaatggtgcactgtggtgagttgtgttatgcagagggtattgtcatagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcatcattgtaaaagatgcttaaactggtaataatttgattagctcctggtttggagttagatctgttcagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgcaagtgtgtaacgttattattatgatggatttgtatattaaattgtcagtttgtgtacctcggctgattcctggacgaggattttatgcacaaatgagttcggaaattactagtgaatttccgggcgtgacacaatcccacctacggccggaacccccgggacaggcaggtaggactgagcccctagcagcaggactccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatttagggtgaacaaggaaataataacgggctgcaggaatt

SEQ ID NO: 37701 - DNA, 861 bp, Oryza sativa
gatcacatccaagttcttggtgtctagcagaatcaaatccgagggaaaaggaatcccctgaatttctatagggacggcaggactataatactttgctgtcataacccctccaggggtggtgatgagcagagggttcctaagcctttctacccccaactgatttcttcccacgaatggcacagatataaacgagtgggaagctccagagtcgaacaaaatggtagcagggatggaatgaatgaggaacgtaccaacgatgacatctggagttgtcagcacgtcctcggccgtcacgtggttcacacgaccccgaatgacatccttaccaccgttgttggagcggggaggcacttggccttgctgacgccgcggttttgggcatttgtccgcaaagtgcccgggctcgaagcagttgaagcacagacgctgcggaccttgaacgtccctgcggccttgaccaggctgcacagttggcgtaggaggacggggcgcacgagtcccttgctgactctgctgttgctgcggctgtgggacgcgcaccatgaattgagggcggggcgcggagcgaggttgctgctgctgttgttgctgctgcgaggaggatccccctggatagggattggtgtagcggaccctttggttagcaccctgttgattacggaaattcgccaagcggcgcttgtgcgactccagttccttgtgcttggcttccaagcggatgctcttgtccaccagacattggaaatccggatagtccacggagactagacggacggacagctcagggtccattcctgccaagaacttctcttgcttctcctcatcttcccgcacatcctccggggcgtaacgggccaggtt

SEQ ID NO: 37702 - DNA, 3197 bp, Oryza sativa
tttcttaggcaggtggaggcccttgtggtgacccctgtccagataaaaaggaggcccaggcctaggagaggagagggggagggagaaaaaagggaagaggggttgggactctagcgaatgggttctagaccctgaactctcgctcgctaggagaggagagggggagggagaaaaaagggaagaggggttgggactctagcgaatgggttctagaccctgaactctcgctcgctctccggctctctgtattccttcacgcacagatccaccagaacacaggagtagggtgttacgcttctcagcggcccgaacctgtctacgtcgcccgtgtcttgtgcacttcctctctcgcggacgttccttagatcgagggcgaagaacctcacttagcgcccccggccgaaccggcaaaggggggcctgcgcggtctcccggtgaggagccccacgctccgtcaaagtgctatgggtaataataccaccttcgaaatctaagtgaagaggtctcaacttaaatacggagctagtcgagagtctctgttgaccggttgagatggtgcgcggacaaccaggcggggcgaggcgaggcgaggcagacagttgctgctgcgctctctcattttgtaacagacggtaataaacacggagaattgatttcgtatcaatgaacgcgtcggttacggaattaaacgccgtgaattgatttgattccgtcggttacggaattaaacgccgtgaattgatttgattccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcctctgttcctgagctgcagaatccttccccggttctgttcacctgcacgcacaggtgtacaggacgagcaggtgcctccggaactccgtccgcttgagaacttgcacgggtagacgggcgatcaagtttttagatagcgcttcaagcgcgactgctcctgttcttcgcgactactactgctgcatcgacgccttcgtcaacatgtcgacggagattggagacaaggaggtgaacgacatcaacggaggcaatactgcctcaaaatccagcggtgggacgttcttagggtatagtttcattctcctgattctattagatgtttctttgttgatgttcttcgcaatggcagcattgcgttactatgtaaatgttgatgcgtatttcattttaagcatgctcaagttgtatacatcaagcattatcactagatctactcatattaaaaatgtcatgtttattgtcttaatattttggattagaatatgccgaattatgaccaaatttccaacagacgtcggccgcatgtcacttcgctgacatcaaacacgagccgaactgagatcgatgcccaatcagaggacgagaccggcgccgtcatcctcctcctcacgctaccatcgccgtgccttcctcgtcctcctccggtgaaccgacttcccgaatcctataaatagccggtgaagccctctcttttccccacatcatccgagctctacgagctctctcttctctctccaccatgaccggccaccactaagtcccggccgatctcctcccatacagctccacttctcgaatccatgcaccactagtctctcttcactccggcgaatccattttgtccatttcccccttctctctccctccaaactaagccaccaccattaccaccttagccggccgaaggtgagctcgtgttgccgctgttccggctaactcacccttcctctctcccagccaccaccctccccgggtgcgcgttgctcgggaacacgttccgccaccgacgtcgccgtcccccatccactggagcaccggcgtccctctctccctctcctctcgtttactcggctgaaaaagaagaaggaagatacgggaggaagaagaagagaaagaaaaagaaaagaaaacaaacactgacaggtgggcccctgcacagtaactctcctattttccctatttaattcaaatccaattctttagaagcccatatctcctaaaccgtagatccaattccaatgaaacctagatctaaattcatctaaattcaaaagctatattttgatacctaatttgctattttataattttatttgaatttattcaaatatcatttgaatttatatttgcctttttcaaatactttcttttaccccaaaatacctattagccactaaaatgcggccggttggaactttacgtcttccatggggacgtttgcggtctattggccctgacgtcgaaccgttggttgtaaagcctgacaaaacccaaaccaaaggtcgaagtgctgctcctggcatcttacgcctcgctgcgtacaacggtcggagcttcactattccctcgaccaccatagcacactgcacagttagctttcgggccctgtgtgatcctagccgctccgccgccactcacggttgtcggagtaacacttccgcctcgctaaacctgcacaaacctcccatccctctagccgttatattgtctattgacaccgactagagaagataccaaacctagtcgtcatgctttagcgatgactagcgaacacccaaaccctagccgatatttatcttaccttgatatcggcttagacaattgaagccagacccccaccagctataatctcaaccatttaccctccaactacccatagcatatacatgaaatacgagccgatatgctatcctatttcagcatcgactcgagaacaactaaatcctagctattcttctaccaaagccaacctcgatcaatactagccacatatccacttaaccagttagattattcaatatatctcctactctccaagaaaccaaaacccacacatgaaatataagcgacattagttgcttaatcccctctagcctccaaccctttagaacctccacatataatattagctcaataatccctatgtcctataaaagagataggctatatcctaaaaccaagccctctttaccg

SEQ ID NO: 37703 - DNA, 11200 bp, Oryza sativa
ttgcttagccctgcctaattggactgcataaaatataatgaacttagattggaacagtatggtagagatggttgatttccaggtggctagtactgttccaaccgacataaaactgctaagtacatgtgaagaacatacgagtacgaccgcaattcttgtatgggcatagacctagctgattaagttatctagcaaaggtggtacctctgtatagtggttcttcttaagtcctcgcgcaggaggcaaatttatgccgcgaagggcaactgtgatatttaccgaggcgcaggtaaatatatgagatgaattgtgcacaaattgtttgtgaaccctgattgcgatgacatggtgtcataaaatcagttctctctaaagacctcgggaatgccagaactcctctcgctgctgataacgttacgttcagagcgcatggggactagagttcatggaacaggtaccaatgatgttagtaaccgaaaagctttgcgatgacaaggctaatgtgtttggcacgtcatggattgcgagtaaagcgtacatctactgtttcttaaaactattcgaatagccgtgctcgtggttatcgggcaatgggactcacaatggcatcttggttagaaacataattctagattttattaaatactgttgcattataaacattatagactttctacttctacattctcaactttctgcaattaaacctagctctacacatatattaccatttcatgcattcattgttgattaatataatagcttgctgagtacgttgtactcacccttgctttaacccccttctttcagagttaatttggaattcttgccgaagccgggagttcaattatataagttagtcttatataagttagtctcatctcaacctaattcgcaaatatagattagatagatggtttaagtctatagccaaacattagggtcaagtcattctatagcttctgttgtaatagttagccacaaccttgtaaataccctattatatcacataaagaagtctcctttggagccttgatcaaatgtatgcaatgaagatccagattgttgaacctgtatcaatctactgatccagggcttgatacagttaaacatgtcggtttccgaatcattagttctgggacccgacagcgttgatatcagagcatatgttttactagagccttaaacccataggttttctaacccccttcatgagtaactttcccacctatatagaataatttggttaaaaactaaaaatttgcctaataattttgctaaggcctttattagaatgaactccccttcaccgttggttttatttttttgcttttacttatgcatcatatctctctttcaaaagaataactattttaacaataaaagtatattcccctccgaagacccttgtccttgatatttcaagaaagtcagtgggtacaagcctttgattatgccagcatgagctgagtttattgcaatccaagcaactaagaatacaagttctgaggaattatttggtgaagcaaatatgtgtccatattgtcaatataatagaagaatattggaatataagtggatttctttaagggggggggtagttcaatataagaactatcaggattcaaggagccgttatatttgaacatgaacaaagtcttgaagctcatatcgtgaagaagaaagaagggatgcatattacgaaattttggaattttgataaaagaatcctttgagtagtatttatgaaaatattgtctattcaggcagaaatgatcgaagacattctaacagtttacaagacattatatatatatatatatatatatatatatatatatatatatatatatatatatattggactagggaaatatgtgcaagatgaaaaggggatgtcatattatatgttttgattttatgcgaagaaaggatagtcttgatccgttgatatctatcaagatctatcattgacatatatacaatcaagaagacatacaatatgaagccaagtgacagttcaagtacttgagaagcatccagatatttccaaacaaataagtgactcagaatgaaggattcccgagattatagaaatctagttgaagaacttccaaatatacaagactcagaataatttgaaagattccaagagcttcaatttcagggagtagaagatcaacagactggtgatgacaataaacatgcaaattaatggacgcggtctgaagaaagttaaccaaccaagaaaacatttgttctgaagactattgatgtaatttagaagggaatcatctcttccatccatatatacaaaaaaacccctatgttatcataaatcataggtagagcgaattatcaaagaatacactaatatgaggttatatgtatataatgagagcggttatacctatagacatcatactattatggagcaatgcatggagtaacaatttcatgaagacaagagctcctattggttaagtggcacaaccaatcaagaagaataaatgaagcttcagaaggaacaaaatattcatggaatatttgttgccgcgctgaatgaagatattttttccaagtatacaagtacttacattaatgaagatagctctttctgccaagctaaaactatgactggataaaaaaaagcaagacctacaaagggagtctgaacagataaatctaagcaacataacgacattgtgtagagaaaatggaataaaggtttatacaagaaaataggatagtaacttatgtgccatagtaattacgacacataagcatgactattcataatttgaagattacatgataaagtggacacaaagaagacctaggacgaccgactatgaaggcctgaataaaagaggtattctattcaagaccctgatctggaaagatggatatgaaccaataattattcaagatggtagtactgaaggaacttattatactcatttatcctaaatatataaatgggtatatcagaccaggagaaaatatctgaagaaatcaaacgatacaaaaatacgggttagagacatataaaattccctcaaggcatgacagataatttcactactcggatacgtatgattggaggaagaaaatttgcaatttcgacaagtaccaagattctgaacaaatattgacaataaatttggattaaaaaaaaggatatgaaccatctacgacaaatttccttatttttagtcatagattgagttataattttctcgactcgagaagaatcagcatagaagaccaagaatcaacaagaggaaaataattagaggacacaaaattattggttgaaaatataccttgaacaagatctctccatggttttcgtgaccatacaaaaacttggagattcatggctagagctagagatttgtactcccgacaagcacaaggattttgaatggatatcggtggtatatttggataaaaagaacataaattgtttatagcaaattttgttacccacatttgaagaatcaagtcaacaattttctggacaccacgaagaccatgaattaaaaagaagaaagtgtctcgacaaacattttcaacccaaagaactatacaccatgccaatcatgttgaaggcaaggttatcaatgtatagcaaaaatagagatggccaataaaagtgcgactgaatggaatggtttactttaggaagcaatgattacttttatgcagtaatcaaacatgtgatataatttcttggagaaagagaagttctggaataaattcactactatttaaactctatggattctgaaatatttcatgatatttcctaagtacgggtagtgaattatgcacccggattgctatgacataccttcttatatgtgacacgcaataaggagctaacacatggatttgtactaaaggaaatggttagatatagttagagaatataacttcaatgctcgacactattcaacaagttgtaatcatagaaatacagcatgtagttaccgcaagaaatgccgcaagggaatgcataagaagaggatcggtgactacgaataattagagaattaagaaacaatacaaaactatgagtcagaaatctaagttagggagttacaaaaggttggaagaaaatattgtctaagaagacattgaagccatgaaacgaagaccattcatcagctctatttcgaggatacgagcggaagtccgaccaccccaatgaggagcagaactagaagatcatagtaaacctcatcgataggtatcatgactgcataggtgcaagaaagattcaaagtatacatccaagaatacaagttatctatcagcagttgaccaatcgggtatccgaaacttttgaaaggaataaggaaagaataaagttcctatacttctacttgtactcttcagaaatctcgaggacgagatttatttaagggggcaggtttgtaacatactgaaaattagctattttctaattatgcatcatgccggttcttatgttcttattaaccttctaaacctaggaaaatataattagagagagacctcctaaaactaacttgcataaaatccctctttgatatttaaaagcttttgtgattttcatttaaaattatcttgggatatttcttgatttggttttaatttaaaaccttctattgacaaaattccttttattcaaatttagtttaaaaaccctttccacttttatgaattatggtccaagaaattctccatcattgtcctagaacctaaaccaagtgattccaattttataggaattaattgtcgatccatcctttgattcgaaacctatccttaactttcttccaaatccaaattccttcctttcgatctagccactaatttaattcatgtggcttgataccctctttggcacaataataatatttttttgaataattgctcttgtgctaagaaggatatatttttattttatttccctcttccaaattaatctccttttagcctcaaataattttctaaatccatgtcaggcagtttgtggctaaaaatcctatttatttcctctctttgttttcttacctcattcccaaaaatattttgaggaattatattaattccctcccatttgagtctttaatatttagaccacattattgcactcaaatatttaggaaatatctcttttgaaagttatctccaaaaatagattcatttcaaaagttagccacctaaattccttccaaatattaatttggattcaaacttccttcctcaaatatcttccaaaattcaaaaataacttctatttgcttttgggccaaaattcccttttcttcttctatcggcccatctccctcttggcccaggacggcccagccaacccttccagctgagccgcccctctcctctctgtgggcgccaatgccaggtgccctgggcgccgttgtcgtgcgccgtgatttgcgccgccgccgacgccgtgccgtaccttcctctgccgccgccaacatccttccgtcgccgttaagaaatcaagtcggcgttgttagattaatgggctaggcccaattaaatcctaataaattccattggcccacattaagtgctatgggtaataataccagctttgaaatctaagtgaagagttctcaacttaaatacggagctagtggaaagtctctgttgaccggttgagatggtgcgcggacaaccaggaggggcgaggcgaggcgaggcgaggcagacaattgctgctgctgcgctctctcattttgtaacggacggtaataaacacggagaattgatttcgtatcaatgaacgcgtcggttacggaattaaacgccgtgaattaatttgattctgttggttacggaattaaatgccgtgaattgatttgattccgttggttacggaattaaacgccgtgaattgtttccgtattaacgagcgcgtcggttacgaaattaaacaccgcggttgatgactccgaacgttactctcgcgctcgcatatatatactccgcagcgaccagaacgacgacgaagttcttcacgactcttgcacttcgagttcctcctcctctgttcctgagctgcaaaatccttccccggttctgttcacctgcactcacaggtgtacaggacgagcaggtgcttctggaactccgtccgcttgagaacttgcacgggtaggcgggcgatcaagtttttaggtagcgcttcaagcgcgactgctcctgttcttcgcgactactactgctacatcgacgcctttgtcaacatgtcgacggagattggagacaaggaggtgaacgacatcaacggaggcaatactgcctcaaaatccagcggtgggacgttcttagggtatagtttcattctcctgattctattagatgtttctatgttgatgttctttgcaatggcagcgttgcgttactctgtaaatgttgatgcttatttcattttaagcatgctcaagttgtatacatctagcactatcgctagatctactcatattgcaaatgtcatgtttattgtcttaatattttggtttaaaatatgccgaattatgaccaaatttccaacaatcccaaaacttgataggtctttttcggtagttggctttgctgcatcactaaaaccacatgctttcgatggttcaaattataaaaaatggaaagcacgtacacttttatggttgacggcgatgcattgtttctttgtctcacggggcaaaccgagtgaaccgcctctctctccagaggaggaggctaagttcgaggcttcggattgcctgttccgtggagtattgatcagtgtactcgttgactatatagtggacgtgtacatgcacatgccttcagggaaggacatgtgggatgctcttgaggccaagttcggggtttccgacgccggcagtgagcggtatgtcatggagcagttctatgactacaacatggtcgatgaccgttctgtagtggaacaggctcatgaaattcagatgctggcaaaggaacttgggaacaacaactgcgagttgccggacaagtttgtggcggatggcattattgcaaaattgccactttcttggtcagactttgctacttctctaaaacacaagaggcaagagttcagtattactgatcttattggctctttgggtgttgaggagaaggcaagggcaaatgacaaccggggcaaaaagatcgagggaggttctagcgccaatttggtgcagaagaagaaccctcacacatcccacaacaacaacaagaaagtcaaacttgacgttaaacccaaggctacaaccaattttaagaagaaaggcaagggaaaggcaaaaggagattgctttgtgtgtggcaagcctgggcattaggccatggattgtcctgagcgcaaggacaagaagtctgcaaacatggttattagtgagggcggaggaacattgtggtatggtaaatttttacctacagttctctctgtctgtcactcacctgattggtgggttgatactggtgctaatattcatgtgtgtgcggatatttccctgttttcttcttatcaagtcgggagaggttcctccttgttgatgggaaacggatcgcttgtggctgttcatggtgttggtacggtcgatctgaagtttacttcgggaaagatcgtgcagctgaagaacgtgcagcatgtcccttcaataaagaagaatctagttagcggctctctactgtgtagagatggttttagacttgtgtttgaatacaataaatgtgtcatatctaaatatggaacgtttattggaaaaggttatgacagcggaggtttgtttcgcttttccttgaatgatatgtgtaataaagttgtgaaccatgtaagcgatgataatgatgagtccaatgtgtggcattcgcgactttgtcatgtgaattttggttgtatgacaggcttagccaacatgagtttaattccaaaattcactttagtcaaaggctctaagtgccatacttgtgttcaattaaaacaacctcgcaaacctcacaaggcatctgaggcgagaaatttagcaccactagaacttgttcattccgatatgtgcgaaatgaacggcgtgttgactaaagggggaaagaaatatttcatgacattgatagatgattgcactagattctgctatgtgtacatattgaaaacaaaggatgaagcattacattactttaagatctataaggctgaggtaaaaaaccaactggaaaggaaaatcaaacggttaaggtctgataggggtggagagtatttttccaatgagtttacttctttctgcgaagagtatggaattattcatgagaggacgtctccctattcaccctagtcaaacagggtagccgaaagaaagaaccgcactctaactgagatggtgaatgccatgttagacactgcagaactttccaaggaatggtggggtgaggcaatattgactgcatgtcatgtcctgaatagaattcctactaagcataaggaagtaacaccattcgaggaatgggaaaggaagaaattaaatctctctcacctacgcacatggggctgtttggccaagataaatgtacctatagccaaaaagcgtaaacttggaccaaagaccgtagattgtgtattctttggttatgctatccacaatgtgggagataggttcttaatagtaaattctggagtacccgacatgcgtgttggtacaattactgagtctagagatgccacattttttgagaatgaatttcctatgaaaaatgcacctagcacttctagtcaagaacctattttatcccctgagcactttgtgccgataaaacacattgatcaaacgcttgaggaaaatcctaaggaggataacattgtagcaactcgaaagagtaagagacaaaggactgcaaagtcttttggagatgactacattgtatatcttgtggatgatacttcaagaaccattgaagaggcatattcatctcctgacgctgactattggaaggaagcgatacgctgtgagatgaactcaattatgtctaatggtacttgggaagtcgtcgagcgtatatatgggtgcaagcttgtaggatgcaaatgggttttcaagaaaaagcttaggcctgatggtacaattgaaaagtacaaggcaatgcttgtggccaagggttatacccaaaaagaaggtgaggattttttcgacacttattcaccggttgctcgcttgaccacgattcgagtactactcgctctggcagcctctcatggtctactcgtccatcaaatggatgttaagacagctttcctcaatggagagttggaggaggagatctatatggatcaatcagatgggtatgtactagaaggtcaggagggaatgatgtgcaagctgttaaagtccttgtatggtctcaaacaagcgcctaagcaatggcatgagaagtttgacaatacacttacatctgctggctttgttgtgaacgaagctgacaaatgtgtgtactatcgctatggtgggggagagggagtaatcttgtgtttatatgtcgatgacatattgatctttgggaccagcctcaatgtgattgaggaggtcaaggactttctatccaaaagctttgaaatgaaggatttgggagtggctgatgttattcttaacattaaactactgagaggagatgagggtgggattacacttgtgtaatctcactatgtggacaaggtcttgagtcgctttggttatagtgactgcaaggcagctcctactccttatgatcctagtgtgctattaaggaaaaaccgaagaatagcaagggatcaattgagatactcccagattattggttcattgatgtacttagctagtgcaacgaggcctgacatctcatttgctgtgagcaagttgagccggtttgtttcaaatccgggagatgatcattggcatgctcttgaaagagtaatgcgctatctaaaagggacaatgagctatggaattaactacgctgggtacccaaaagtactggagggctatagtgattcaaactggatatctgatgctgatgagataaaggccacaggtgggtatgtgttcacacttagagggggtgttgtttcctagaagtcttgcaagcagaccatcttaacgaggtcaacaatggaagcagaactcacagctttagatactgccacagttgaggccgaatggcttcgtgagctcctgatggacttgccggtggttgaaaaaccagtaccagcaatcctgatgagctgtgataatcaaacagtgattattaaagtgaacagtttgaaggacaagatgaagtcatccaggcatgttaaaagaagactgaagtctgtcagaaagcagaaaaactccggagtgatagcattagactatgtccagatggctaaaaatctggcagatcagtttaccaaggggctaccacgtaatgtgatagactgtgcatcaaggaagatgggtttgagacccacttagagttgcacaatggtggaaacctgtccattgtgatcggagatcccgtgaatttggatggcgaaacaaactattgtgtaactgagagaagagaccctaaaatgggcttatcttcatgatgcacttctcttctaatctgtatggtaggatggtatacaccttaatgtgatccgagtggctttccataaagcagagatgttggcctacagaacatcttagaaggaacacacctatatgagtctgattgctagtcacaatctatgagatctgggtgatctctagatactcatgaaaatgccaggagtatgacttatacgctccaaacagagaggatgcaaacggcagcctagtaccagttaacggtttgagtgaaacctgaatcacacaagactgacaattcaaggcatagtccattgtttagttgtgatctggtgtagttcttttcctaggtggaagttcaacttaacagtctccaccgaaacactggtataacaaacaggataagaatcgagagcatttcctgtgagccatgaaatttggtggggattgttagattaatgggctaggcccaattaaatcctaataaattccattggcccacattaagtgtgtcggtgacatggggccgggggtatcgtgactagaggcttgggtagccgcggtcacccacgtggcctgaccccctcgggggggggggggtc

SEQ ID NO: 37704 - DNA, 32249 bp, Oryza sativa
  unsure (1)..(32249): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgattttcatttaaaattatcttgggatatttcttgatttggttttaatttaaaaccttatattgacaaaattccttttattcaaatttagtttaaaaaccctttgcacttttatgaattatggtccaagaaattctctactattgtcctagaacctaaaccaagtgattccaattttattggaattaattgtcgatccatcctttgattcgaaacctatccttaactttcttccaaatccaaattctttcctttcgatctggccactaatttagttcatgtggcttgataccctctttggcacaagaataatattttttttgaataattgctcttgtgctaagaaggatatatttttattttatttccctcttccaaattaatctccttttagcctcaaataattttctaaatccatgtcaggcagtttgtggctaaaaatcctatttatttcctttgttttcttacctcattcccaaaaatattttgaggaattatattaattccctcccatttgagtgctttaatatttagaccacattattgcactcaaatatttaggaaatatctcttttgaaagttatctccaaaaatagattcatttcaaaagttagccacctaaattccttccaaatattaatttggattcaaacttccttcttcaaatatcttccaaaattcaaaaataacttctatttgcttttgggccaaaattcccttttcttcttctatcggcccatctccctcttggcccaggacggcccagccaacccttccagctgagccgcccctctcctttctgtgggcaccgatgccaggtgccctaggcgggataagttcactttgggtctctctatttgtcgcccagtccgattttcgtcccttggtcgcaaaaccgggtacaactggtcccccaacttacgaaaccgtttaaataaggtccctcagcggtattgtacctggtttttgctgacgtggcgtcgacgtggcttctttgactaggtcttcgtcatacatggcattaacgtggcgcttacgtggtaatttgatccctgaaaaataattaaaacagtgggacccacatgtcagcttcatatccataatctttccggtcagcgaagaaggacaagcggccgagccggagcggacgacgccgacgaccggagcaagctggcgacaagaaaggcggcgccaagggccgggagccactctcctcctccttgtcggccgcgggcggggagatatcggcggcggcctcgacggggagccgctctcgctaacggtggccgcggaaggggagatgtcggcggcggcctcggcgggcacaccccgctcctctcccgccgcctaccgcccaccgcaccccgctcctctcccgccgaagcccgtcggcgggcgcaccccgctcctctcccgccgcctaccgcccgccgcaccccgctcctctcccgctgtcagccgcccgccgcactccccctcctctcccgccgtcagccacccgccgcaccctgcttctctcccaccggcatcgttgaagcatacagagccacagaggtagatgaggttgaagaagtgggacccgctgacatgtgggtcccttttttattttttttactggcatgtgggtcccacaaattttgtataatttttttattttgaattttgatgtttttattttttttcggatctaattgccacgtaaacgccacttcaatgacatgtgagacaaagacccagtcaaaggagccacgtaggcgtcacttcagcaaaaaccgggcataataccgccgagagacctcacttacatggtttcacaagttgggggacctatcttacccggttttacgaccaagggacgaaaatcggactgggcgacaaatagagggacccagagtgaacttattccccctaggtgccgttgtcgtgcgccgtgatttgagccgccgctgacgccgtgccgtaccttcctctgccgctgccaacgtccttccgtcgccgctaagaaatcaaaaagacgtcagccgcacgtcacttcgctgacatcaaacacgagccgaaccgacatcgatgcccaatcagaggacgagaccgacgccgtcatcctccttctcacgctaccatcgccgtgccttcctcgtcctcctccggtgaaccgacttcccgactcctataaatagccggtgaaaccctctattttccccacatcatccgagctctacgagctctctcttctctctccaccatgaccggccaccactaagtcccggccgatctcctcccatacaggtccacttctcgaatccatgcaccactaatctctcttcactccggcgaatccattttgtccatttcccccttctctctccctccaaactaagccaccaccattaccaccttagccggccgaaggtgagctagtgttgccgctgttccggccaacccacccttcctctctcccaaccaccaccctccccgggtgtgcgttgctcgggaacacgttccgccaccgacgtcaccgtcccccatccactggagcaccggcgtccctctctccctctcctctcgtttactcggctgaagaagaagaaggaagatacgggaggaagaagaagagaaagaaaaagaaaagaaaacaaacactgacaggtgggcccctgcacagtaactcttcctattttccctatttaattcaaatccaattctttagaagcccatatctcctaaaccgtagatccaattccaatgaaacctggatctaaattcatctaaattcaaagctatattttgatacctaatttgctattttataattttatttgaatttattcaaatatcatttgaatttatatttgcctttttcaaatactttcttttaccccaaaatacctattagccactaaaatgccgccgattggaactttacgtcttccatggggacgtttgcggtctattggccctgacgtcgaaccgttggttgtaaagcctgacaaaacccaaaccaaaggtcgaagtgctgctcctggcatcttacgcctcgctgcgtacaacggtcggagcttcactattccctcgaccaccatagcacactgcacagttagctttcgggccctgtgtgattctaaccgctctgccgccactcacggttgtcggagtaacacttccacctcgctaaacctgcacaaacctcccatccctctagccgttagattgtctattaataccggctagagaagataccaaacctagtcgtcatgctttagcgacgactagcgaacacccaaaccctagctgatatttatcttagctcgatatcggcttagacaattgaagccagacccccaccagctataatctcaaccatttaccctccaactacccatagcctatacatgaaatacgagccgatatgctatcgtatttcagcatcgactcgagaacaactaaatcctagccattcttctaccaaagccaacctcgatcaatactagccacatatccacttaaccagttagattattcaatatatctcctactctccaagaaaccaaaacccacacatgaaatataagcgacattagttgcttaatcccctctagcctccaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacctgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattagactgcataaaatataatgaacttagattggaacaatatggtagaaatggttgatttccaggtggctagtactgttccaaccgacataaaactgccaagtacatgtgaagaacatacgagtacgaccgcaattctcgtatgggcatagacctagctgattaagttatctagcaaaggtggtacctctgtatagtggtttttcttaagtcctcgcgcaggaggcaaatttatgccgtgaagggcaactgtgatatttatcgaggcgcaggtaaatatatgagatgaattgtgcacaaattgtttgtgaaccctgattgcgatgacatggtgtcatacaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcaactttctgcaattaaacctagctctacacatatattaccatttcatgcattcattgttgattaatataatagcttgctgagtacgttgtactcacccttgctttaacccccttctttcagagttaatttggaattcttgccgaagccgggagttcaattatataagttagtcttatataagttagtctcttctcaacctaattcgcaaatatagattagatagatggtttaagtctatagccaaacattagggtcaagtcattctatagcttctgttgtaatagttagccacaaccttgtaaataccctattatatcacataaagaaatctcctttggagccttgatcaaatgtatgcgatgaagatccagattgttgaacctatatcaatctactgattcaggacttgatacagttaaacatgtcggtttccgaatcattagttctgggacccgatagtctggaatgtaatttttatgttagcatttaaatatagtcaatatggatattaaagtattgttttcactaaaaaatatagtagttcaaacatatcacaagttgaatatgtgatttaaaaggttataattattttatttatattgttcctataaatgctagtaagaggagaaagagaagaaaaggaaccatggaagagctggctagacctgatatgtggaggtccattaatggttttctccccataaagataatttaaatttcaattatcataaggataaaactaagagaaaaggatgaacgacgcacaccacatggggatagggagggccggatatttttcttaaaaaaataattgatatgatgacctaaaataatgcgttgcatgtttaagtcgaaaccgatagtcaggtgttttgttttttatcataattttgtacgattcttttaacttatgagagacctgtatagtggcttagaaatatttataggatgtttaatgtataagtctttaacattgtttgggtggggagcgtggaaagaaggtttggtattgtcttaaataaaaatctaataacaacctaaatggtacgtccatcggtttaagtcgaaaccaatgattagatgttttgttctgaaatttttaagatttttctctaatttagaagtgtcacatagtgttttagaaacatttataaggatggctaatgggttttaatgctgcataggatcgcggtgggagtttaggatgttttttttttgtaagaaaaagatatatctaataacctaaaataatgtaaacgttactcgaatgttttatttttttagattttctctaatttagtagtcctatatggatgtttaggaatatcccttctttctataaagttaagaccaaagctgcctcttcaattcgccacgtcatcaacattatattagccgttcgatcaatatgtacatcagatatacaccattggatcccttatcctcttgcccagcatgcatggtaatcaccttgctccttcccattcccctcccttaatcacatgcattaatttacagtagaaacagccaaatcaattgagccaggaggtgcgatggttaataagattcatgtgcctcttgcgattctcttccaaaccttttaataagcccctttacaatccccactataaccaagtctcttcccctttgcatgaatcttttcatcgtatgttggattctatttggtaagcctgaatttaacatttattttaaccagattctatttgagtacacattatgatttgaaccaagcatgagcactatgaaagttttgtccattggtttctctgaacttcaagaaagaatccctatcctatgcatttattgttgttttagtttcttaagaaaagattcgtcatacttgcagccaatacttatatgtcctatcactaatttatttgagtagttgggaaggatatagaggattacaatatagctgtcctgacatagcgagaagcagcttaacttgctcggtatgtattttgttttcaggttcaaacaatacaatctaattgtccatactaatatgcatatttacatacgttctcaaatgtgcctgcagcgaagcgcggggtttcatctagtttatatgatgtgtaatgaacttattaggagaggctagaggaagagctaaatagatctagtaggttaatgcttttaaggcctgtaatttttttaattttaattattatggaaataaaaaaggaaaagaaaggaaatggagggatcgtacctacattgctgtgaagatgaataatgcgtacgttgtggaggcgtacggtagggatgaaaaccgatcgaatacggtcggaaactagctctatcatatttgttttcatattttttctcggaatcgaaatcggaatcggaaacccggatacgaaaacggaatcgaatattatcgaatacagatacggagcgaatacgaatcgaaatgaatacggtaacgaataattatcaaaatatcaagacccctcaaaataagcttcttaaaacgaggaagagatgtagccattagttttcaaaaacaaaacaatagtattctcaagctgttgactgagttttcagggtggtagatgtctaagctaatctaatctagcaaggcgatttagccaataccggcataaaccctaaaacgagaagcagccgatagagctaaattgatatgctaagactagattaacagagacatatgataaataggtaggcaaatatatcatccaaaccagagcaatccaagaggtcgaatgtactgatgcagccttgaacaacgccggcatagacgatacaattgcctaggccgacggaatattgaacttaccccttcgccggagatcgaacaccgatgcagccccgcatcaggtgccaagtcccgccggacgataaaataaagtagaaaaggtaaaagggtggcgatgcgccgaattgtattgatcgtcgagatagattacatagaccccgggtgtacatatttatacccatgggttgatacaagtccttgttggacaagaaagaaactttcctaaagataaaaggaaaagataaagtccttataactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactacttcgggctttccaaattccactgttaacagtcatgtatcaggtcatggatgaaaaaacgccgaaggaaatttgggacaagttggcaagcctgtatatgtccaagtcgctgacgagtaagttgtatctcaaacaatagctgtatggtttgcagatgcaagaggagtcagatcttaggaagcacgtggacgtcttcaatcagttggttgtggatctaagtaagttagatgtgaaactggatgatgaagacaaggccataattcttctgtgctcgcttccaccgtcgtatgaacatgtggtgactaccctgatgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgttgaagagcaaggagaagggggcacggtgctataagtgtcatgagtttggacatataaggaggaattgtccgttactgaagaagaggaaagatggcattgcaagtttagcagctcgtggtgatgattcagatagcagtagtcatgagattcttacagtgtctaacgagaagtctggagaagcgtggatgttggactcagctagttcctatcacgtgacatcggagcgggagtagttctcttcatacaaatctggtgattttggtgttgtttacttgggcgatgacacgagttatcgtgttgttggaatgggcgatgtcaagttcaagatgtgagacacgtgccgggactaaggaagagtttgatttcgcttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaggctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctaggttctctcataaatagaggagcgtgcctgttgtaaccgcatagcgacttagcatagcgagagggagcggctgccggcggcgaccggccgttagtcgttgtaactctgatacgctgtatatgctggatcggggaggagcgcccgtaatcagtaccccggagatgtaggccttggctgaactccgttaccaaatatcgtgtctcggtgtcgtcatcgttttggatctcctatggtgttttcttccgcggtttggtttccggtgtgatttcggggccggttttataacaccacgcatgccacacgctcgcacgcgcacgcacgaggacgaacgacgaacgaatgcacggacgacacctccagcttcccgcctccgtatttccttcgtttctcaactagaaggctcaagactggaggcaaaagaagcgcaatttcaacctatttcacctcctcaaatccgcccctactcccactaactcaatcgtcgtcaccggaggaaaattccccgaaactctaataccggcgccattgattgagctccaaaattcatcgcatacatcgccaatcctctgaaattgaaggtaaaattggattctccatgccgagtactccatttcccctctcattacacatccaatccatcgccggaatgctgccggcgctgcctcccggcgtcgccgctctgttcggccgcagccagccgcatggcgcgccgccgctccagggcgccctagctttggccgtcgccaccctgggactcctctcgcctcactaaacctcaccaggccgcctcccgcaccggagtttgccggagtcgccgccaccatggccgcctccgcctcctattactgcccgccgccgccagcctcgccaccggcgcttctctcgctgccgaccacaaaaacggaatcgcctcgacccctagataacaaaatcggcgcccccttgtccaaaaccggcctcctctgccgccggcaatgtgggattccggccagttcatgtgcagaacgagaagaacaggaaatccaattttcctattgaaaaataaatcagaaaaatcctttttatttttctatcaggttgaccatccgtttgaccttaaaatcgaaatctgagacctattccaaactcctagaattattctgaatccatcagtatcagttttgttgcaatccgagcacccgttgtcgcgaccctaattttagccctagggttcgccattctccgaaattccaaaaatccctaaatttaattatttaaaatcctttccacccattgttgcactttgtgatactattttcttttgtttatctttgtttttctgttatttattgtggtgatgattgttgcgtaaatagaaaacgctgacgttggtccggtagtcgaagcgagtgaaatctccgcaccaggaggagacgatttgtacgactacatcgcgcccgaaggttgcaagacatgcaccctcccttgaacaatttaatcccagcagttagagagttattttggtagcgtacttgtcctttggagtatgatagactgcacgaattattttaaattaagtatattactattattgcattatattttctgttgttgttataaacaccttaatgagccttagagtctaactaacttaggataaaatttgagaaacacttaaacaaactgttaattatttaatatgatattgatttaatatggatattattactgcatatgaaaacatgcttatggaactatttatggctatatgctaagaattgatcacaccacatgtgagcgggtggtacacatgatagagttcatgtgtttggttttatggacctgcttatggtcatgatggatatatggatatatttatggttatttcttatttaaaattgatataataatcaacccccttgtgtcaataagaatgacatagtttcgcccatccacacgatcgatttgtcgaacctggccgtatattgctccaattgattgaacttctgcaggcctttcggtgcactggccattagctttcaagtatgtgaagcaaagtgacatggttcatgtttatatgatttatatatgtgggctcgatgggccccgagagttcagaattaccctatgggtccatgaagttctaggctgcccatcgagtaacgaacaatggtaagtggatgcggaggtaggttggcacacacctcggaccagatcactccgagcaacatcccgagcatcctttaacttataattactaggcagaagggagagatatatggagcaatattacaccttgttacttttcagcccggccagctgtgggtatcgtgtgggtaaagctgggcagacactgcagagtcgttgagtattcgaatacgccatgctcccggttaatggagatgtgtctatgggtgattcctgattatgggcacaagttaaactaaatggctatgaattaatatggttaacttatttattatttaatgttctattcatgttatttataagtaacattcatacttttatgctcgttattattgtttaaattaaatgttcaatagtgttgtttataacaaatgcttattaagataggctctatgaaataactgttaaggttagggtttaaaccttccagctctcaatactgcatgttgtatattgcaattattgtatttattatcataagcatgtcttgctgagtaccatttgtactcataaatgggttcagatcatgaagaggaagatgcatgtggagaacctgttgatctgttagagtgggacaactatggtttctaggtcatcctatgctcagacagttcctgtggtggagtctagcagtttatctgtttgtagaaataaggctttataggccatatatgtaatggtttgtatttatgttgtgttgtgaattaagtgacttaagtattgtatgatggaagtttatgcttttatatcatttcatgcgtaactgaacatcctgggcggttacgtattcgtgggtgcaccatgactttatcgggtgtccccacactcgagcggcgcgccgtgcggcggcggcgtcggcgggcggcgacgggttgtggcgggcgtgctcgcgcggcgggagggctcgagcgacgcgccgcaaggcggcgacggtggcgggtgggagccgtggccggcgacggcgtcggccggcaacgggcggcggcagcgggcagttggcacggccggctagccggctaggatttctggtttttttttttgctgaaaaatatctccggatatccgatgaaaaatgccagatagtttccgaccgttttccaattccgtcggatatcacccttactgtattcgttttcatatctgagaaaaaaaatccgaattcatttctgaatccgagaaattccggatatttccgaccgaatttttccgaatccgaaaattggtccggacggacggaaagcatccgaaccactttcatccctaggcgtacgtggacggagggagattttattttaatggaaagaaaaatctaacattaaaattattgggttcaccaatttaaatgtaaatcgatggtcagattttttatatgatgtgtaatgaacttattaggagaggctagacgaagagctaaatagatctagtaggttaatgcacattttaggcctctattttttttaattttaattatcatggaaataaaaaaggaaaagaaaggaaacggagggatcgtacctacattgctgtgaagatgaatagtgcgtacgttgtggaggcgtatgtggacgaagggagattttattttagtggaaagaaaaatctaacataattattgggtccaccaatttatatgtaaattgatggtcagatttttctattttattaaagtgacatgtggcgactcggggagagagagagagagagagttcaaattaatggatccactagtttgaattatctacacttcaaatctaatgtttaagatagtaggtttctggaaatggaaatggacagtaagttgtttcatttcttttatattttttctacattaaaattagtagctaccttcagaaattattagctatagaatagaataggattatataggaaggagagatgtagtactagaggaggaagcgtacatactacgtgtatgtccgtacgtagttgtagtactgtgggccggtgggagaggggataggagggagttgggttgtgggcttctttttttaaagataatctaataataaaaaataatgggtccacccatctattaaaatgccacgtagcgattgaggagtatttatagaaataacacgtggcagtttaggaaagtttgtaggaagtttaatgtacttttagtatataatagatagataatagataataaacttgtagaagttgaattttaacttgcattttgtggattgatatattacatattgatctatcttattcatatttttttaattttttttataactatttagatgacgcgcaataaacgggtgtatgtccactcaagctgttaaaacagtttccctgtatacgtggcaacgtccttcgataagcagagagactgacttcctaccaaattttcttcccttgcgaagcgtggctgatacgcggacaaggctttaccatttttcaatgctatagctgttgtgtattaaccttcttgcgaaattagcttttccaatacaaaacccaaatgcgtgcgttattcaagaacacataataggttatttcaggcaccacgtttcaaggttgggcaaattgctaaaacagaaaattatttctctcggcgtcagcatttcatgagcataatgtgaccatgcagcttcaagaattcctccaatgctgtcttggacgaaccaccgtcctccagagttcgaccaatcatcccctgaatctgcttcacactctgtcgtatcttgtccgccttcgccgtaatccccatcaccatctccacgacctcgaccaccctctcacgctccagcgccggggagtccggccagttcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgcgccggtggacgcgtgcgcgaggatgctcacctgcggagcccacccgtggatgagaagcccaatgttcttggcacgcatcctctcctcgaacccttccggcaaccactcggcgctgaactcgcggccgttggtggtctcgatgtcaaacccgaacggcggacggatagcccaaatgaacggcctgccggtgagctccagtgccatggcgaggtcaaccatctggtcaggccttagcgagttattagacccgaatgagatgtacagcactgacctctcttctcgggtgtcgagccaccgcttgacgtcatcgtcgttatggtcaccgatgtgatcggagtgctccgtccggcgacgcactagagggccgatgggatagaccgggacgcccatcgttttccggagcatgcgcagcccggtcgtctccaactcctccatcgtgctgatgagaatcgcgtcggtgtcgtacccggccgatgtctgccggcggtggtgggccgaccaccggtccgtgccgtcggcgtggagtaggtaaggcggaagctgcgaccggtggacagtaacctccgggtggtccgggaggcagaacgcgtcgtcaccgggcgcacgcaggtgcggcaagtggttccacagcgagtggaacaccacgctgccgaacgcgccgcaggagacgaagatggcgtgcgcggcgccacgccggcgggcgacgtctgtcgtccacgcgaggaaggggtcggcgatgacgcagaccctggcaccgtccgctccggcgtcggtgatcaagtcacggacgaagctgtcgaagctgtcctgtagcgagcgcgactcggtggcctcgaacagcgtgatgaagtggaggagcggcacggcgtcggtcgactcgatgtctccgggcaggccgtgctcggctggcgcgaacggcagggcgtggaaccggaggtaccgcgtctgggagctcgaccggcggcggaggtcttccacgttgcgcggggtggagacgatggtgatgtcggccgtgggctgggcgtcgtggaggtgggcggcgagggagaggaaggcggagaagtggccctgcgccgggaacgggaagaggacgatgcggaagctgccatcgctgggcatggtgaacacgttgttctttgacttcgaggttctccactggaaggaaattaaatttttgctttgtctgaaaggagaggaagcacgacagcaccggtcggtgtgtgtgtggcaatggctctgggtggacaggatgaacgatagggtggggagcgaggctgggaaggatgcgcttggcagttggcagacaggctttgggatgaacgacgatctcgcggcgtggggcagttggtaaggcttccgacgcgggatggggcagggaagcaatggtgtcgtggacttgtcctttggtttcctgtccgtgagatcgtgacgtgaggtggggccgttggatttgatggtcggggtacgacgcagcgcgattccgggcagaaaaagggcccttgccctgtttgcgccacagggctgatgcgaatgcgagggaggcgtcggcgtcgctcgcggctcgggtgcgacgtggtgctttgcgtgcggcagcggcgcacggcaggctccggcttggagggcgggcggtggtcaagagcgggaccggaggcgacgtgatgggacggagtcgtttgcccggcgtggtgtggcgacgagtgcgcaggagcagcacactggagtatagcaggcgcggcgctgcatcatgctcgcggtcgtgggcgtgcgtcggcgcgagactttggagggcgaccacggtcgacacggctcacggcactggcgctacagtccacacgattgagcgcgagactggttcgtcacggtgtagcggcggcagctcgtgctgctacgagcagcggcgcaaggcaaaggcaggcatggcccgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttttagaatcggaaagattccctttttatttcttttcgcccttttttttttactgcggaatcggattcatttttcttttctttttttcgcgatttggtttctcttttcttttttttcgcccggttttttcggccgttttgttttggatcggacagattctttttgcccgttttttttttgacagtagagaatagtggtaaaactaaattttaagaagaaatagtggtaaaattaaattttaaaaataaacagtgcctcagcactatacttgatggcgccgagccgaggttgaacatcttagctttcaggtgttatattgaataaaatctggtggcaaggctgtgattataatcgatgtggtgtttgatgaacttgctcgagctaaccgatccttattaggaccaagcgctcagatgaaattcaagaagtgttgtgagtttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctccagtccgttagtccgtcagtcccctctcttggtaggcatggtccttcttttatatctcaaggggataccacatataccatttctacctacccttcttttgggtggggactcatcctactttaaccaaaacttggctcgtaccttcgcctgacaccgggataaccctgtccttccttcattaatgggcggagatttgcaatggctgctctccgaatgaccctccgatgggatgggtcataccaacctccactccgccggaagcaggtgcaacgtgggagcacggttgtttgctgatgacgtgaccggcgtcagaccagtcacaaaccggtcattcttgtctaccacgcgtcagtttagcatgccacccgtcagcccttcttcgtaaaatgacttccttgtaatggttgcgatgaagcctggtatgaatctagccgggactgacgtgctaactccaggagttcccacgccggctctggctagggacgagtgtctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataatgagcggctttcttcaagaccgctacattacttgagtagcacgcaaatcgggacgagccggttcgtttcgcctagagatgtgatgatggtgcatcggttggcgagcgtagttaacgcgcgcacgatatgtcccatctcgactgtcacggccgcacatccgcctcgtgcgccgcaaacgggcgaacgggattagtggagtagtgggcgcgagaaacgagggggcgagatagtgggcgcgggaagcgaggagccgggcatagcgttggcaagggtataaagacgccaaggaagagattcgtttccttcctcttcgccattattccccttgccttcgccgcttgcgctctaacttctcgtttcctgtgccctaccctcgccgcactcactcgctctcaatcccctcctctgccggcgtcatggcacggggctccgcaccgctcgacggtagcgtgctgccgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcacccatctctccggctattccggtggttcttcaccgtacagccggtgtcgccaccgtcggtagtcggtggctgctacttcccgccgcgggggccggtgctgaaccgctacattccctgcgtccttcgcaagaagtgggacgactggaagagcgactagttctacacccctctcgccgacgaagcgcgcctccgacttctgagccagcccccggcgcaggcctccagctggcgggcgccggtagatctgggagacggctacgacgccgttcttgaccgcctggctagtctgcgatcccaggggctcacgagggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccttcatcccccaaggtgtcctccccctctgcagcgatccagagcgcgccaacatcctgaccatcatgcaggcggtcggggcgtcaggggagcgggctcctcgaggccacgatggcgcgggcgggagccgaaggggggagcaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggaccgaaccatgccggggaaacctcatctcccccccaaggtggtcgtttagccgacctcctcgcaggttcgtccccgcgccaactgcggctgtattcattctcccatctcccaaggcaagtttttactcacccgtttttcatcttctggtttttcttctgcctcagcgagatcccgtcgcgcccttcccgccattccaagtccggccggtctgaggccgaggagacggcgaccgcggaggcccggaggcgggaagctgaccggcgagaagccgcagaccgcctccgggaagccgaggaagctgcccaggaggccgtccgggctcgccaggctgaggaagccgttcgggaggaggctagactccgccgggccgaggagtccgtccgggagacggaggcggcgcgcgcacgccaggcggcctgccaagcccccgacccgactccgcccgaggcgacgacgacttccgagtcctcccacgacgaggccgcgggcgcaccgctcgggcccgacccctcgggcgacgctcaggatgagccaacttcgggggacgtccccgagtccggcacgtcgatcggcaggccgagccgtgcggcatccttaccgaggcgactctcccccatgccttccgctgccccactgagcgcggagccccttctgcaggccttggccgccacgaacaccacggtgttggacgggttaagtgcccagatggaggtcctgcaggcagagcgggcggagctcgacgcggcgtgggcgcgtgtcgaagaggggcgacgctcggtggaggccatggtggagacgggccgcaaggcacaccgccggcacacctcagagctcgaggcccatcggagggagctggcggagatcgccagggaggtggaggaggagcgggagactgccctcatcgccaccgccgtgttcaacgcggcgcgagacgacttctacctccaatacgggagccgggcggcggagctagagaagaagctcgacgcgtcccggcagcgcgaagaggcccttgaggctcgcgccacggtgctggaggacgcgcccgcgccctgaacagaaggagagggaactggcgggtcgcgaggccgccgtcgccatccaggaggcaacgctggcggcgcacgaggccgcctgcgccgaagaggagtccgcactccgcctccgcgaggacgagctcactgagcggaagcgagctctcgaggaggccgaggccgcgacgcatcggcgggaggagcaggcgcgcctgaatctggaaggcgcccgcgccgagagggccgcactggaccagcgggccgctgaattcgaggcgcgggcgaaggagctggacgcgagagcgcgcagcggcggggcggccgcgggcgacggcgacctagccgcccgcctcgcagccgccgaacacaccatcgccgagctgcagggtgcactggactcgtccgccggggaggtcgaagccctccgcttggcaggcgaggtagggcccggcatgcttcgggacgccgtctcccgtctagaccgtgccagccggcaggcgggcctctggggcgggcggaccgcgaaatacgctgccaaccaggggggcctcgcccagcgcctctcagagatggccgggaccctccagcggctccccgaggagctcgaggagacgatcaagtcatcctcgagggacctcgcccggggggcgatggagctcgtactggcaagctaccaggccagggaccctgacttctccccatgggcagcgctggacgagttccctcctggaaccgaggatggcgcgcgcgcgcaggtccgggacgccgccgaccacatcgtccacagcttcgagggtacggcccctcggctcgcgttcgccctcgactctgacgaggagggcggtgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcaactctgtttgttgtgtgtatgagacgagggtggtctgtgccgcggtccttctgtgtcttggcttgaacgagggctcgtgcccaggtcccaacctcaaatggcgcgggtcggggctagtgcctggggagatccacgtgtcgagactggccaggccgggaacatggtgaccgagggttatggatgacccgattgtgggcctttgccgattcccccccggagttcaccacgccccagggcacggctcggttctgggccccgtttggcgattttagccggcccgggccaccgagggtagggtcgagcacgagcgtgctaattcaagccaagattcttcaaaaggaaacgatggcacagacacagtcctcaggaaatcgaaaatgcttttattgaaatacggaagagaaaaaagataaggatatgcatgtggtagcccccggccaaccctgcacgccttgggggggcgcggggttggcccgagcccgagacctgacacccgacccccactaggggtagaagcgacgaaggtgttcgatgttccacgggttaggcagctctgtgccgtcgcccgtggccagccgaacggagcctggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggaagcgcgcggctcggagggccgcgcgccgccttcgctcttccaagtagtcgaggtcatctctgcgacggcctgaggggacctcagggtgagctcggatgggagaaccgcctccgtgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaaggccctagaggatttctgcgttggcgcgctccacttggccattgcttctggggtggcgggagagcgacgccccaaacgaaagggggcccctttnttttgccagatgcccatattcttcgcagtagtcgccgaagagctcactagtgaactgggtgccgttatccgtaatgatacggttaggcaccccaaaccgagcagtgatgcccttgatgaatttaagcgtggagtgcttatcgatcttgatgaccgggtaagcctcgggccacttagtgaacttgtcgacagcgacatacagatactcgaaaccgcccggggcccacctaaacggacccaggatatcgagcccccaaacagcaaacggccatgaaagaggtatggtctgcatggcctgggccggctgatgggtttgcttggcgtggaactggcacgccctgcaccgccggaccaggtcaaccgcatcgttgagagccgttggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtctcttccatcagcacgtagcgcttggagatgcgctggacgcgttcactcccttcgcggtcctcgggtagagtcttatctacgaggtatgcctggatctcagcgatccaagcaatcaatctaggagagccgggaacgctcccctcgggtcccgaggcctggactccgacgggcctcgggggccgttcaggcgcgtccgtctcccctagggggtcgggtcgcgccgacggctgagcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacataagcatccatctgcgggtcagagcactggtactccttggagacctggttgacgaccaactgggagtcgcctaacaccaggaggtggcggatccccagtccagctgccactctgagtcccgcaaggagtccctcgtactctgccatattgttggttgcccgaaaatcgaggcggaccaggtatctgaggacgtcacagctcgacgaggtcaacgtgacccccgcaccggcgccttgaagagacaaggagccgtcgaactgcatcacccagtaggcggtgtgaggcagctgcgaggggcccgagctggcctcgggggcggagacgggctcgggagctggggtccacttcgccacaaagtcggcgagggcctagctcttgatcgcgtggcgtggttcaaattgcaaatcgaactcagagagttcgatttcccatttcaccacccgtccagtaccctctcggttatgcaagatttggccgagggggtaagacgtaaccaccgtgacccgatgcgcctgaaaataatggcgcaatttcctcgaagccatcagaatagcgtaaagcatcttctgggcctgagggtatcgggtcttagcgtcccggaggcctcgctaacgaagtagacgggccgctgcacctttcggcggggccgatcctcttcgctaggggccgcatctccagggcgctcttcgtccgagaggccgcacggggcgcactcggcttctgtgccgacgacctcggggtcggagggcgactggcgcggccttcccgcagtggccccggggccatcctgggggtcgggggcacttggcaccgttggacaagcaggcggagggccagctccggccgtcgggggcctcgggccgccgttcggctcgggggcctctcctccctgctctctcccgggtcgagtcgacacagggtggggatgcgcgaggtgagggttgtcctcatcgcgctccacaaccaacgccgcgctgaccacctgcggggttgccgccaggtaaagtagcagcggctcatctggctccggggcgaccaggactgggggagaactgaggtacgccttcaaatgagtgaaggcccgctcagcctcctccgtccagataaacggcccggagcgtttgaggagcttaaataggggtagcgccttctctcccaacctcgatatgaaccgacttagggcagccatgcagccggtgacgcattgcacatccctaagcttgctgggggggcgcatccgctctatagctcgtatcttctcggggttggcctcgatgcctcgggcagagaccaagaacccgagaagcttgcccgcaggcacaccgaacacgcacttgtcagggttcagttttatgcgggcggagtggagactttcgaaagtttccgctagatccgagagtaaggtctcttggttgcgcgtcttcacaaccaagtcatcaacataggcctcaacattacgtcctatttgactacccaaagaaattcgagtagtacgctgaaaagtaggacctgcattctttaacccgaaaggcgttgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttaccgttcgccttgggaacgacgaccgggttcgccagccactccggatggataacctctcggatgaatccggcctccagaagtcgcgccacctcctcgcggatgaaggcttgacgttccggggcctgccgccgcactttctgccggaccggccttgcgcccggccgcacggtgagatggtgctcaatcacctctctggggaccccgggcatgtccgccggtctccaggcgaagacgtcggcgtttgcccgcaggaaggagacgagcgcgtcttcctatttgccgtccagaagaccactgattcgtgtggtcttcgacgggccgtcgcccaaggcaacctccttgaccgggacctcgtcgcacgtgatcatccgctgcctcggggcggctggaacggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcaaagttcacccgctccgtgcggaagttggcggatccaccgaaggtgaccgggaggtcgatatgacctagcggccaagtgtaccccggcgtcacaccgataatcggttgggacggccgaagcaccatccccggggccttgatggcgtcaaaggctgcgggggaaaggatgttgagggctgcacccccgtctatgaggacacgccccaacttcacgttgcaaacggtgggggaaaccaccattgtgatctgtcctccccgggcaacgcacggcgggtggtcggtctggtcgaaggtgagggcaacctccgaccaccgcgcccgccgagtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcatttcgccggttgccaaagggagccgccggggccttgccctcacggcgctcctgcctcctctcctcctcccacctcctcgtccgctcagtcaaacttttgaccacgcggcagtccgcgaggtcatggagggaggtgttgtgcacggtgcaccacttgctggtcgggcgctccctgctgggagcaccggcctccttctttttgtcgctcgcaagcctcccctttcgggtggcccgcgaagcgccctcgacggcgaggacgtgtccctcgtcgtcggaatgggccgacctcttcttcctcctcctgtcccgccgccctgaccgagcggtggatccgggggcggccgaagctgccacaccggaaccggtggagttccaggtccaggcctcctccttacgagccacacggtccgcgagctgaaaaagctccgcggtggtctggggctccttggaggcgatcttttcaagcatgcggttgtgccgcacgccccccctgaacgcgtagattaccgcgtgtgcggggatgcatggtatggtgttgcggacttgacagaaccgctgaatgtacgagcgaagagactcatcgtcccttcactgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaagttcgccatgaccctgtcgtcacccccggcggcctcgatcccggtcgtgtagacctggagaaactcggcggggttgacgcttccgtcatatttttcggtgatggtgggccggaaccttgagggccaacggacgttccgaaggctcgccacaaaggctcgacagtcgacaccaccaaccgggggcacgtggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggctgacgaacggcgggtaacggccgccgctcgccgcgccctccgcctcgacgacacggagccggcggtagcagcgccggaggccttggtggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgcgccctggggcgtgctaccatcgccgtagacgaggaggcgatgctccccgtctcgccgtccttctccatcgctcgtgggcggcgaagtcgcggatctttcaaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgaacgggagaagcttggcgcacacgaaagaggacgagagcttagaaaaacacacgcgccccctacctggcgcgccagatgacggaccgttggggctcctcaccgggagaccgcgcgggcccccctttgccggttcggccgggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgcgtgaaggaatacagagagccggagagcgagcgagagttcagggtctagaacccattcgctagagtcccaacccctcttcccttttttctccctccccctctcctctcctagcgagcgagagttcagggtctagaacccattcgctagagtcccaacccctcttcccttttttctccctccccctctcctctcctaggcctgggcctcctttttatctggtcaggggtcaccacaagggcctccagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggaatggatctgaccgggactgacataccaactccaagagttagcacgccggctccggctagggacgagagccaggaagctctcatcattccgacgggacggggcgaggcgtgtgacaggccgcctgttgccacctaacccgcgatctgaccggtctgtgaccggtcacacaccgtgaccggtcacggaccggataagcgtgcgccgcgccgcattaaatgcggtgtggcgcgctcgtccaacccgcaataaacgcggttaggtgagcgccgctgtgctcacctaacccacacacgtggcgccaaacccacagggggtcgggacgccccagccctcggggtcgaaacgggagcggcccgacacctcggggagacagagggaggggcggccacatcaccctcgggcccgacccccccgagggggtcaggccacgtgggtgaccgcggctgccccaaacctctagtcaagatacccccggaccctcaattttctgttttatttcctccgttttactgtgtaagtcattctaatattttccacattcatatgaatgttaatgaatatatatatatatatatatgtatatatatatatatatatgtatatatatatatatatgtatatatatatatatatatatgtatatatatatatatatatataaaatatatagtaacactactacaaaagtaatttttttgtacgaggacccttatttttgcaaacggaccataactagtggcgtctgcaaaaattgagggtcatttttgcatgcggcccccttaagtgggccgtatggaaaaatcgattttcccatacggacctcttaagacagccgcatgcaaaaatgagctcatttttgcttgcggctcaattaagcgcccgtatgccacttaaggaggcgtatgtaaaaataaaatttgaaaaatttgaaactagtgtatctcactcatataaattctaaattaaatgattcttttttctaaatgtttctaaaatcatgctctatcatgttattgtgttcttactgctattattttggcctttttttcttgtgactttattttatcaattaaaattttgaatttcaaaatttcaaataatattttgaagcggtaattgatttcagctgaaaaagtcatcaacaacaaagttgtataactcatcaagatatataaattctattttggtcatttattcatccgacaaaaatatttgtaagattgtttacaaaatgtacatgtctcttatagttttataaacaatataagagatatgtacattttatgaataatcttataaatcactttgtcggatgaaaaaatgatcaaaataaaagttatagatcttgatgatttatacaactttgttattgatgactttttcagttgaaatcaattagtatttgaaaatgctatttgaagttgttataatttgaaattcaaattcaaactattcaaacaaagtcatatagaaaaatgaccaaaacaaaaattatagatcttgataagttatacaactttgttattcacaacttttccatttgaaatcatttattgcttcaaaatattatttgaatttcttatattttaaaattcaaattttatatatctcaatcaaacttggatggagaaatgaccaaaagaaaattggtagatctcaatgatctctacaactttgtttttgacaactttttcacatgagttcatttaataccacaaaattagatttaatgttcatttttatctagaagtctaatttgtctcctctccctctccaccgcttcagaattccagcaaccttatctccaaccttatcttctctccaccattatttctcctcaactccctctatctctctctccccctcacacacagcaaggtcgcggcgggcgtcggcgacaccgaggaggtacgcaggggcggcggccgagggcggcacgcactggcacacggcggcagcggccgagggcggcacgcggcggcagggggcgggagcggccgcctgcgtggatctgccgactctacctccctccgtcgtcgccggcgactcccccgccctcc

SEQ ID NO: 37705 - DNA, 12271 bp, Oryza sativa
gacggcgggcggcgtgagcgatggatccggtgccggcaacgacagcgggcggcgtgggcgacggatctggtgccggcgacgccggcgagcggcggtggcgacgaatctggcaccgtgcggcggcatgctagggtttgggatttttggattttattttttttgtttgctgaatttattttcgcatgtggctggtataagcaaccgcatgcaaaaataggattttcgcatgcggttgggccggccgcatgagaaaagggtgatttttgcagaccttctctcccatgaggttgcctcaaccgcatgatgccttttgcccgtatgcaaaaagcctttctgtactagtgtaacatctaagtatttaaaatttatcataaatataataccacctacattattttctcaaccgagatcacaactctctcctatttaatttttctacctacgtcttcttgttaaccaatcataatccaccactattcgatttcacatactttttatagttctcatgttcaaacctagaacttcttatatttggaatgaaggtagtaaatgcctatttacttacagataatcttagatgcaatcatttgtataattgtatgtcatctggtgtataattacatttaggatctatttggcagggctccaactcataaaattaactttatgaattgggtctaaaatatagttgtggagcagccaaaaactaggtctatttttctagtttattttgtgagagcaatgtagccaatttcactcccattttgaatggagttgaaactgtttggttgggctttagcttcaagagctctaccaaacagacccttaattcttgttccaatattaaagacatgtcagttgtaatagattaggcctaattagggatggactaggagcgtaattgaggaatattggatccggtggttacacaaatggagcaaacatgctgtgtgtggtgggcaaaagtggaaggaggacgatccaccagcgtatctaggatttacggtatgggtggtccgactaaaaaaaatagataaacaccgtaaatataataatgctaatatatacgaagtagactacaagtacaccatgatatattaataagacatcttaaaaacattttaaaattaacagttaagtaaaattttgagttagagaagcttatatacctagagaagtttgaaggagattgctatacaacaaacgaggacgaaggcaactcagaagcattcttctttcatgaatgtttccgaaaaaaagatacaatattttcaacaatagtataatttaacatcaaaactcagaagggttaaaactaaaaattaagagtaagtgtagaggccttaaatacctttgcatcgaccgtccatccatatacaaccataaaatagacactgtagtccaaagttggacaaaatgctaaaaatagtaaattattcctcttggtttcataatttcatgggcatagtacgatcccgcagcgtcagcaaggcgaagaattccttcaatgtgttcatggacgaaccaccgtcctccagtgctggagcaatcatttcctgaatcttcttcacgcactgtcgtgtcttggccgccatctccatgctccctatcaccatctccacgacctcggccaccctttcacgctccagcgccggtgagtccggcgcgttcccgcggcacagctcgacacacgagccccactcctccagcacttgggcgttgagtggccacgcgacgacgggcacgccgtgtgccgtgctctccagcaccgagttccagccgtagtggctcaggaacgtgccgatggacgcgtgcgcgagaatggccacctgcgggagccaacccgtgaatgaggagccccgtgttcttggctcgcatcctttcctcgaacccttccgggaaccactcgtctgtggccccgctgatatcgtcaccattagtggatgaggagccccgctgcttctgtaaattcatagtcccattcccagcaaccccatttctagcatcaattcacatattccatcacagccaattcatatagacccattcccagcatcatatcagccaattcacattcatattctatcacagcacagccaattcacaaaatcaaacacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctgaagaatataattgtattacaaagaatatttacaaaaatcaaatgtttgtctcatatgcattgcaaatgttctgccattccgagacgagctacctaggacttcactctaaacatccctttcgatgacaagatatcatctagtatgaattgtgctatctcctctctaatgatttcgaagttgatttccggaatccttgaaataaattcctgcatgttcggcgccaagttagtctacatacttgtaaatttgtcgtcctatgtgtgtataaacaattgaattacacacctcagggtcgagcaatgtcaccttgtctgcgaagctcctcatgttatggcagacatggaacccacactggtcgctaacttgttgacgtattgggaagtctttcttgtgaccgagtttgggatgcccatccttatgcctcccgcctcttgccacgtattggtcccatgcctcgttcaaggcagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactattgattgtaggcgcacataatgaagtccttgtcttgacgggcaaataagcagtccttgatataggccaccatgtttgctcgatcgtttttcagcattgtctcgttgacgacagctggatcgagtaaggcaacatggggtgctttacgatggacatgcttccaggttaacctacgagcaagacaagagtcagggtaagtgtaatttatggacagtcactaccatatcgcgtaccaagaaatacttacaaggagtagcacttaaggaggttggtgtcgatcgctcgcaccctgtagaggtcccatagatctttgaagtctacggcgatgaaggcagtaggcccgaggaacggctgaccatcgtgctggcccaacatggaggtctctctattcttcctccttgcgttggacttctccatgtagtacccgtgcaacaccttgcatgcagggcccatcttgaataaggcatcgtctccgaccaatggcatgcccaatgtgaattcggctggaagctttggaggagctactggcgccttgccaagatcaagcttctttggggcaaatggcacctttatttttcctctccccgttccagcagcttttctgcgtgtgtcaagcttgggtggagaagatttcgccctcttgctccttttggcaggaggggggaggtgcggcctgctgtcaacctccataccgtcgtccccaaaatcagtatcatactgtaattggagatcttcatctctttgttcaacggcaggagggagagatacaacagtttgatggggacgcgtcggcggcggacgagaacttggcgctggccttggagttatattgatctcaatgctgtgcttgggccattgaataaaggtcccacgtgcagccccaagggtcagaatctcgtcattaggtgtgtcggtgacatggggccgggggtatcttgactagaggcttgggtagccgcgatcactcacgtggcccgaccccctcgggggggtcgggcccgacggtgacgtggccacctctccctctgtctctccgaggggtcgggccgctcccgtttcggccccgagggctggggcaccccgaccccctgtggtgattggcgccacgtgtgtgggttaggtgagtacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagacagtcgctggctattgaatgaaggttgaaacgggcgtccaccgggagagctgacgagcggagcaggaggcgtgcgtactgcttgtcagaggtcatttccggctgtagattagccctcattgtaaaaagcatgttcttttctgaggcagagagaggcccatgtggtgacccctaaccagataaaaaaaggaggcccaggcctaagaagagaggagggaaggaaggggaggtcggacgctggcgacttgatcggagagcctgaactctctctcgctctcgagctctctggctctggagctctctgtttaccttcacacacagatccaccagaacacaggagtagggtattacgcttctcagcggcccgaacctgtctacgtcgcccgtgtcttgtgcgtttcttctcgctgacattcctcagatcgagggcgaagaacctcacttagcgcccccggccgaaccggcaaaggggggcctgcgcggtctcccggtgaggagcccccacgcaccgtcaaggtaggtgtgggatagtgtagccaacccaatcgggcttcagtaagtccacttgaactttggcattgccggcttgcagctgcgccccgtgcactcgggtctccggggtaggcttgaatgcttgaccctctgcggcaggaattgcaaatcctggtgtcaccctaacaactagggtacacgatgtgggttcctgcaatagattcattagtgtccttagtatatgttgcaatgtattgtggtgctaatataatatatgcgttattaagttgtttttaccgttatgtggtccaccgtggcggggccttcaggctgttctgccggagcctcaattgatgcgcagctgctacgcctctgcgtggggctcacttgtactatgggaccaggagtggcatcggtcgacctatccctgatgcgtgcctccatccgagcctccatacctaacagctcggcagtgagctcttctctaagctcttctttaagctcctcccgaagttgggccttaatgcgtgcagctttctgcgccttggaaagcttgtgcttcttgtactgccacacgtattggggaaacccaaacttccatggaacattggagccaatgccccttgttcgtccacggtgttcttcgtttcccaacgctttcgtgaggatgtcatcctcgcgtttttgtgagcatacctcttaggaggcctgtctctcagcattcagttcgacctggggtacacttaggacactttagacgaagaacaagatacaacataatgaaacttattctatgtgttcaacttacgattttctggtacaccacttgatcttcgggatttgggaacgaaagagttccgtcactattcttcttcacccttgcccttgcccagttccttgcccgctggaccgggatattagcaagcacttgcggggtgttagattccgctgcagcttcatcctccttgtcccattctgcctgtttccccgcgtagccaccggtgccaagccagtgcgggtgaaggttccttgcctgcagatcacggtaggtctggctttttttccgagactctttccatgatttggcggcatggaactcatcccacacgggttgggtgatgaatggatatttcccaaatggttctggctgggcagggttgaggacgtactccgtgaccagcgttgtcttgaaatttttccaacaattccccatcttgcggatagcctgccgcttcagtcctaccgcggcctctgtaggatatcggaagctttccttgaactacctctaggcctcttctttttcttcttgagggaccaaatcgatgtggtccttcagaatagtgaagttccgcctccctaggactccgcatatcgtagggaactttttgacagctttcgtcggagccgtcggatatccaacatcgtccacctctgttatggtgtagacttctttaggaatcttattctgggtcctaggattccggcacgatgtagtcccagaagtggtcgttgacatcggttcgccttgctgcgacatgtcctatgtcactgttgtacggggagaaagtactttttaaacacaaaattgcatccacacacattctcttatggtttgatatacctctatatcctacctacattcgcctcgtcgacgaaaccatagcatccatgctcaatagggctggagcagccgggaactcgacctcgacatcagtataccactcgaacttgctatcaatgtcactgacataagatagtggcaacggtagcaagttctagtgggatatggatgtcgaggtcgagatcccgtctgctccggctctaaggagtatggatgctacatatctgttgacgaggcggatgcagatagaacacacaggcaatcaaaacccttcctatccaagatccctaacgttatcatcagcaaactcctagattgcatccaagatcatttcgttatggaacccttattcccatagatacagcaaccatctttggatactgaatttatgggaatggggttccataaagaaatgacgttgaaaacaatctaggatgttggtaacgataaaagatttctagaaatgatgtatttgaatgaaatgttctgtttaccaatttgtcttggtcggtaccgtgcaggcagtaacccgaccaaaccagatttggcaaccaggacacttcgtattctcctaaatgccataatttcagtaacttcatttaataacatatttctatgcatatccatcccatttccctcaaaatgacccaaaacagcccatactacacaagtcacatatatattatttttgtacctaaaaaaacacaagtcatgacatataataagtttggcctcaattttgctcagaaattatgcttcaattatcatcatttgcaactgcccccacccccaaaagaaattaagaacaagtgtagagggtctatccttatgcaaaaaagaaacagccatataaaaacagccataataattcaaccatcacaacccacatcaattcatccatcccattggaccaaaaatatcccaaaaattttgcaaagaaccatataagaacaagtctagagggtctgtccttatgaaaaaaaacagccatataaaatgatcccatattgccactccccccaaataaaatgaacaagtgtagatggtctgttcttatttaaaaaacccaaaaatcacaagtgtatatggtctgttcttatgcattaaaaacccacatttgaacctaaacaagaacaagagtgaggctggcccaaaaatgcatccattttgtaaaacatcccatactgccactccccccgaaataaaatgaacaagtgtagatggtctgttcttattgaaaaaacccaaaaatcacaagtgtatatggtctgttcttatgcattaaaaacccacatttaaacctaaacaagaacaagagtgaggccggcccaaaaatgcatccattttggaaaacatcccatactgccactcccccccaaataaaatgaacaagtgtagatggtctattcttattgaaaaaaccccaaaaatcacaagtttatagggtctgttcttgagcaatcatcaatggccattcatcataaatacatccatcacatcccacaacatcccaagatggcatttcccccaaaaatcacaaattaattccatcacagcccactgcatcccaacatggcatttcccccaaaaatcacaaattaattccatcacagcccactgcatcccaacatggcatttcccccaaaaatcaagcaaaattcatccactgcatagcaatatctaattcatccaactatacaatgcaaaaaacatccactgcatccactgcatccatacatctaattcatccatacactgcatccacaatgcataaaaaaaacgagggagaggaagcgtacctaggaggagaagaagcggcggagaggaggccagtgacggcggcggacttggcgtcgggcttgacgtcggtcttggcggcgggcttgacgtcgatcgctgaagcggccgtggcgtcggtcttgacgacttggcggagaggaagccggcggcggcgaacttggagaggaggctggcggcggcggtcttgggcgtggaggaggcgctggcggtcggggagggcggatcttgaacctggaggcggcggcggcggtcagtaaggccggatccacgactatggaggaggcagcgatggatattgaaccgggaggcggtggcggcgtcgaggaggaggcggcggcggtcgggaggcgacggcttggaggaggaggaggcggcgtcagcggtggcggaggaggaggaggcgacgacggcggtggatctgagagagtgagagtgtgagagagtgagaggcggcgtcggcggtggataaggacccgtggatgaggattgactaagtaaaccctagtcaatcctcatctctatcgggcagactattatacccgatgcagatgacactcatccgtgacgggcgttagtactctgcccgatacggatgatacctatccgtgacgggcattagaactaagcccgatagagatggaataatctctatcgggcatagtactaaagcccgtcacagatgacttattaaaatattttgaagttataaaaatcatttataattatcttctacccgatttaaaattgctattacatttgatctatcacatataattaacaaatgtcttatttacatagtttaaaattcctattaattttttaaattcatataattgacaattgcctttctcacatatagtttaaaattcctattaatttttttttaaaatcatctaattgacaaatgcctttttcacatatagtttaaaattcatattactttttttaaattcatataattaacaattggctatctcacatatagtttaaaataacaagtataattttttaaaaccacataattaacaaatccatttcttcaaagagttttaactcgaatggcatgaaacatatgcaattcattcattaaggctccaatacaaattaaatacatcattcacagtgatatgccttccgaatggtctgaacgaacgtaagccacttcgtcttcgggatcatcgtcaaggtcaatctgaggtctgacatgaagattcttgttgtattcttcttcatcggcaacattgtccacccccacaattcttcgcttgccatccctaacaacgtacatcttcttgtttacagggtcttttatgtagaaaatctgttcgacctgcttcgctagtacgaatggttcatctgcgtatccaaccttggccaggtccactaatgtgaagccttccttgtcaaccttgacacctgtgcagatattcacccaactgcaacgaaacaaagggactatgaagttcagatagtttagctcccatagctgttctatgcggccgtagtatgtgctcgatccaacctgatcctgatatgcatctatacggattccactgttttgcactgtgcttttctcatcttgtgtgacggtgtaaaatgtgtattcattgatatcgtacccttgccatgtgtcaacatcccaagatggaccccttgccaacctttgtaatatctcacttgggccatcggtcgaccgtgctacacgatccttgaaccattcgttgaagcgagcaccatgttctctgttgatccaaatatctgatcgaccaatattgtcctgtcggaccttcgctaaatgctcctcaaagtatggggttacttcagccatatgttgcagcactgcgaaatgagcttgcgcgtaggaagcttgatcgggaacaattctttttctgccagttgtgctgacacctgccaaccttccttcatggcgagacgtaggaactccgataggatcagtctcggccacgtaatcgatacaaaactcaatggcttcctcggtcgtgtcaccttcaatgatgctcccctctggttttgctctgttccgaacgtaggacttcagaattcccatgtacctctcgaatggccacatttctctcataaaagctggcccacatatttttgtttgcttcactaggtgaacagtgagatgaaccatgatatcgaagaaagctagtggaaaatacatctccaagtgacacagggtactgacaatatcggtctgcaacccatctaggtcttctggatctataatcttctgaccgattgcattgaagaaggcacaaagccgttggatcgtgtgacggacttgtggtagtagaatgcctcttatagcaactggcaagatctgtgtgattagcacgtggcaatcgtgagacttcattccaaccagcttaagatcctccaatttaacgtacttacttattctcgagcaatagcccgaaggaactttaatatctgccagacatgatagcattgcgatcttctcatccttcgacaatgtgtggcaagctggtgggaggtacactcttcccatcttctcatctgtaacaggctgaagttcactgcgaatgttcatctcctgtagatcgagacgcgcattcaacccgtcctttgtcttgccaggcatattcaacaatagccccagcaagctatcgcacacattcttctctacgtgcatcagatcaatgcaatgacggacctcaagatcttcccaataaggtagccgccaaaatatggattttttttcttccacatcctcttcttgtcctccttgctacgttttcttttcttcccaaactcattattaatgtccttcaccatgttgtgtacttgatctccggacaaatccgcaggggcagacccaagttctttcttaccattgaaaattttcttctttcttctaaaggcgtgccgtagggggagccatctcctatgacccatgtaaatcatctttcttgatttcttcagccacctactgcatgtaggttccatacagtcaaagcatgccttctttcctttcacggtttgtccagaaagataacccagcgcgggataatcattaatggtgcagaacaatagaactcgtagtgtgaagttctcctgaccatatgcatcccaagtttccacaccctctttccacagaatctcaaggtcatcgataacaggctccaagaacacatcgatgtcattgccgggttctctcggaccttggattaacaagcacaatataatatatttccttttgaagcacaaccatggcgggaggttaaagtttgcaatgagaactggccaagtgctgtgagaactgctcatgtctccgaaaggattcatgccatccgtacacaaatatatcctcatgtttttggggtcgacagcaaagtctttgtgctttcgatcgatattcctccattgaatcgaatccgcagggtgtcttagcaaaccgtcattccttctctctgtggcatgccaacgtactaactttgcttcattggggttggcaaatattctcttgaaacgatcaatgattggtagataccacacaaccttcgccggaccaccccgctttgacttctttccctcgcccgcgctcttctttcgcttgtatcgagaagccttgcagacaggacaagcatctaagtccgcgtattgcttgtggtacaatatgcaatcgtttggacacgcgtgaattctccggacctctaaccctaggggacacagaacctattttgcttcatatgtcgtctcgggcaatgtgttctcctgaggaagcatgtccttcagtattcccaaaagttttgtaaaactcttgtctgaccatccactactagccttcaacttcattaggtctaatgttgctgataatttggtgtgctttggcttgcatcctgcgtatagaggagtctccgagtcactgactaacctgctaaacttcatgaaatctctctcgttcatagctgggtcatcaatgtcacgtaacatgtcttgcagcatatc

SEQ ID NO: 37706 - DNA, 2156 bp, Oryza sativa
ccactgtaaactgtttttgttttctttggctgaatcaggttctatccggctctacgttgcactttgaaagcagaggaagcatcatgagacttcttccaaaagctcgtaattaaagcatcaataatgctacagctaccaggcatcacaataaagctacagctaccaggcaggagtactacttgccatgtgtctttctgtcagcaatttattctatcgaagggaagaaaatctggtagggcgaaagtccatccggtaggattggagccatggtttcgcttaggccgaggttagttctaaactttttctttaaacttttaactttttcatcacatcaaaacttttctacacacataaacttcgaactttttcgtcacaacgttccaatttcaatcaaattttcaattttggcgtgaactaaacacacccttaataagcgaaacggcatatttacaaacgaaaaataagttataaacaaaatttgtatatacgtgttctttgcaatctaaaagcaaagattgaaaaataaacttcgatgaaaaaaatcttaaaatcagctctaaatttaaaattgaaaattcaaattttagttaataatcataaacataagagatgagtccgtctcagtcataatctcgtgcaggacacgtgcctcagtcataatctcaaaggctcgaagcatcccctcaaaaatcgtattaattactaatgtcattagcaacaaaagtgacttcgacgtggacttgttcttccagcgcatatggactttctcccagcggggcgctagtcgcggcaccagcggcaattacgtgaggacattgttgttcgagtacagcagagtgccggcgataccgtgtgggacggcggtggcggaacattttcgacagcaacaaagcgccgcgcttggctcgtgttcggcgcgggaggtcaccgcccgccatgccgcgcttccctttccaggccgtgtcgccgccacacgccacggcaagcgaaggattctaaatagacatgtatcactatatacgtggcaacgtccttcaataagcaaagagacttcctactaccaaaatttcttcccttgcgaagcgtggctgatacgcgtacgagtctataccatttttcaatggtatagctcttgtgtattaaccttcttgaaaaattagctttttcaatacaaaacccaaatgcgtgtgtactcaagaacacataataggttatttcaggcaccacgtttcaaggttgggcaaattgctacttcctccgtttcacaatgtaagtcattgtagcatttctcacattcataatgatgtaaatgaatctacatatatatatatatatatatatatatatatatatatatatatatatatatatatatatatatatattcattaacattcatatgaatgtggaaaatattagaatgacttacacagtaaaacggaggaaataaaacagaaaattatttctctcggcgtcagcctttcttgagcataatgcgaccatgcagcttcaagaattcctccaatgctgtcttggacgaaccaccgtcctccagagttcgactaatcatcccctgaatctccttcacactctgccgtatcttgtccgcctacgccgtaatccccatcgccatatccacgacctcgaccaccctctcacgctccagcgccggggagtccggccagctcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgccggtggacgcgtgcgcgaggatgctcacctgcggagccaacccgtggatgagaagcccaatgttcttggcatgcatcctctcctcgaacccttccggcaaccactcggcgctgaactggccaccgttggtgggctcgatgtcaaacccgaacggcggacagatagcccaaatgaacggccggccggtgagctccagtgccacggcgaggtcaaccatctggtcaagccttagcgagttataagacccgaatgagatgtacagcactgacctctcttcttgggtatcgagccacctctcgacgtaatcgtcgttatggtcacc

SEQ ID NO: 37707 - DNA, 11243 bp, Oryza sativa
ggtgacccgactttactgtgtaggaggactaattttagactttttagttgttttggcccataatattgaagtccatttaacaagcatatataaaatctaaccctaagtcaaccggtcaaacaccaaatcctccacccaaaatcccaaatcctccaaatccgcactgccgcacggcgcgcacgcccgtgccagccaccaccgccatccgcctgtccgccgggagccaggcgcgccgccgtgcactgccagttcgccagccactaggcacgccgccgctcgctgtctttctctcgcgtcgtcgtgctgccgggagcccccatcaactgaagccgccgtcgccgggagcctgcttcgatgcgccgtcggaagacgccatcgccgggagccgccgtcaacgtgccatcgggcgtggtgactgcagccgtcgtcactgggagccgccgggagtcaccgtcgccgcaccgctgggagccgccatcgacgtccgccagcgccctccgacgtcactcgttgtgagaatgattcttcctgtgattttcatctataatttgttgatttgttgagtggagcattttggatatatattgatataatgtgattgtgaatatgttgtttaaccggggacgggctaaccacggggataaattcaccacatggtgatcggggctggagaaattatagccccgtcgtggttgacggggacggggacggtgaaaatttttcaccgcagtgacggggacgcggtggtgattcccgacggtgaattcatcattgccatatctagtggggagtgaggctgggaaggatgcgcttggcagactagctttgggatgaacgacgagctcgaggcgtggggcagttggtaaggcttccgagcagggaagcaagggcgtggacgaaagtcggtaaggcttccggtcctgcgattaatggtgtcgtgggctttgtccatgccgtgaggtgggacggtggggccgttggatttgatggccggggtacgacgcagcgagattccgagcagaaaaagggcccttgccctgtttgcgccacagggctgatgcgaatgcgagtgatgaggtgcgacgtggtgctttgcgtgcggctgcggcgcacggcaggctccggcttggagggcggtcggtggtcaagagcgggaccggaagcgacgtgacgggacggagtcgtttgcccggcgtgctgtggcggcgagtgcgcaggagcggcacactggactagagctggtgcggcgctgcatcatatgctcgcggtcgcgggcgtgcgtcggcgcgagacattggaggcgacttcgctggactagagcaggcacggcttggacgccaaagttgtcgccacggggctcgcgtgacaagcggcgcggctttgctgaacatgtgagcgtacagcgcagcgtgatggctagctgcttcgggcgaccacggtcgacacggcgcacggcactggcgcgacagtcgacacgattgagagcgaggctggttcgtcactcggtgttgccgcggcagctcgtgcggctacgagcagaggcggatggcgaaggcaggcatgggtgcacggcttggctggctggctgcttgccctagccggcctggcttggcactgggctgctagctgtgctgggcttggccagaaggtggcgacctggcctgtttggtggttgccccgactggtttgctttagaaggaataagttcactttaggtctcttcatttgtcaccgagctcgaaattcacccctataccaaaaaaaccagatacaatgtatcctctaacttacaaaaccgagcaaacgagtttgtaaaatctaaatcgagaagcctctcgttttaggtcttgtttctttcagcttgggattattataatctagattattgagtcagattactgtaagctagattgttataatttatagtaaaataagcggttagttgtttctttcctaaattattaaagcctaaattattgggtttgcaagtctaaagagggagtgggtggcatggtgggtaatttttcacccaataatctagaaaaagctcaccaaaatgagcttattagattataataagctgggctccagattataataagctactttaataagttatctgtttctttcagcttactcctaataatctgaattataataatcctaagctgaaaaaaagggcttagtcatatcgcgcgatgcgtctcagagccatccgaccataggcttggcacatgcacgtagccggagccacaatgagcaagaaaagagagtactgctacatatctacacatgcatgtcttgtttattattatgtcataaatgtatttcttccttcttataaaattttctcttaaactagaaagtaagcccgcgtaaatgcacgggcaatttattttttttgtttatagaaagaatactaaaataaaccatatgttaccgtattcattttaagaaccatagattaccttataatctaaaagaagaaatatttattatgcgaaataaattataaagtttgatatactaattgataatatctattatattcaaacaaatttcactttgttatggctatacgtaaagtcgcatatcaccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtttttttttgtgaatagtactgcacatattcgtaggatggttgtgcacatatttatatgagtgtctacgatttcgttttagatcattagttaaaaacatattttaaaaaagtttggtgggatggcatgaagagatgccacggtggcatgactttttcgataacatcttaaagagtttcattatatatatatatatatatgcataatttgaggaaaagtttagtgttgcaaagaaagaaacaaaaaacaaccaaactaagcagatcatatatacattctttttttttccgttttgacatctcttgtgtaggtacgtacgtatgtagggagagattagttggtttttagctggaatatatccaatataatggttgaaaataatggatctaccagttgaagtgtaaattgatgaccatatattttcttttttatattttttcttataatttttttctaatttatgagatctattacgtgatatattaagagttcttgtagaagtgtagaaattctattgcctatactgataatatacttgtagtcgattattatttattgtggcttggtggcatgctttactttacctatcatttgttgatagttctccacttagtatagtccgttatatatggtgcttcatgacataagtgctcgttggatggtagctaattattagatgcactatgcatgaatacctcgtaagcaatatgacttgacgattagtggatagaacttatatacttatggatcagtggtggcatatgattgatatattaggatatttttttattcataaagtatattatatactacacattaaacgttttagtaaataagcaataagttctagagtaattatcggattggttgctccttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatatattttggctttattatattcaatatttaattaatcttgcactaatgatacgtgtcgtttcatgtatcctgaataagctcagccatccagctagatcaaatgaagcataagtagaagataaaggagatcagtacggtgtgaaaagaatatatacaatctttgatatttaaatattatacgaatagagaaaacacattcatgataaatttagtgatatcattttgacatatcattatttttataaggagtaggtaacttttgagaattgctagtcacaattagaattgtttttattttaaaatatgcaagtctaatttaactattacataatatatactttaattaatttatgcttctcattggtgtttcgatgacatctgcctacatttttacaacgtaagtagagcatagttaatatgggcagtttggttttttatccgagtgaaaaaaaaaagaaaataaaaagatgtcgttagcccggcctgcttatgtacatatgtacgtacttttttaccttggaatatatgtacgtacctttttttttttgggaatacctactaaacgtccgtacttatgtgcacatatagatcggcaatattgagttttggagataactttaattggtatttttacaatagatctaatggttgaaaataatgggcccaccatatattaaatgaaaatcgatggctaatatttttttagaatttctataatttattagatcgccacatggcggcgtaggagcatttccaggggtcctatgtggcggcttaggagggtttctaggaagtttaatggacttttagtatataatagatagatagatagaagatagatagattacttattcgatctatatttcgattacaccattgtgttcgttgtaattaaatcattataacaatatcttacatgattatattatgataaaaaatatttatactggtaaattacttttattatatatgtaagttacttttatcatatataaaaattacttttagatttgattaagttacttcattcatagtgctctgagtagattacatttattattgtttttagtcaattccacaatttggtgccgattaaatttaattttttgataaactcatgtttttcatccctataacggatttacttctaatgttgtaacaacttacttccatttcgtactaagttattttttttatgatttatgtaaattgctttcagactttattaaacttactttcataaatgtatttacttgaaaatcttctctacactttggttgtgaatttactccacatagtttcttactacaatccagttatagtgtaattacttctaatcttatagtagagaattacttctattgcatatctaagttatttctacaatttaaataaattgcttttaaattgataaaatgtttgaatatattccacatggatctcattttagcacatattttgagtagagtacaatgatgtaaatagatcttaaaaataatatatgatttataagatataaatctttaaagggggatttatatatggaatggagtgatctctggttaggattaacccactaccgtgcactacctagtcacccctcggcggtattctcccgggttttggctaacgtggcaccttcgtggctcctttggctaggtctttatcccaagtggcattgacgtggctcttatgtggcaattcgatccgaaaaaattaataaaccacgtgggactcacatgttagtttcacgcacaaaataataaaaatggtgggggcctatcgatgtttgagatcacgactacggtatttggatggtatggggatcgttggtaccagggtatatgcgagattgaggtaaaagagatggagacggagatttttatacaggttcgggccccttatctgacaggtaatagccctacatcctattggccgaagccggtgtagctctttattcatctggatcacacaaatacaatatttgggataacctatctggtcatcgttgacttggcggcatgaacaccaactcgtagttgacgacgggtagtcttcctcctcgagtatgaactcgtcgagatgagagatgccgctagatccctcttgtcggcccccgtgggcactgatggggtttgccaaggctaatctgatctctaatgttgatatctggtgacgtgtgttggcttgtgtgtatgttgtgttggtcttgtggcttccgtgtatgttggctgtgccccctctcctcctagggggcttgtatttatacccatggataacccattgtccaagtaaaactagggagaccaatatggatacaatctgggtagtctttgtcatttccatatagaactctatttgtccttccttatccggatttccttctatatacgaagtttgattccgtataagacatggtatatggtgggccccgccgagctgaatcgattactattgggtatgtggtatccataaccctgacagggcctatgtggccccacattttatcctcattactcccgtcttgtatctatcttctctatcctcttctctctatcatctatagagtcccactctgaagcggcggcaagcctcaggcggagcggagcaaagggatgaagtggggtgggcggagcggcagggcgagcgaagcacggtagctggatcaggccgatggaatggagcggaccgtcgtcatcaactgctatagcacctgccatagttgccgcgctcgccgacgactgctcgagctcctcctccggccatctccaccgttgttgcccccttcaccgcccgtggcctgccttcgccgctgctccgtccacggtctaccgccgccaccgctccgctggcatgcaccggtcaccgcgttgcacccgtcccactccgctagcatgctccaaccgctgccgctccgtagtgagactctacagaaggatagaaagaagaggagagaggatagagaggagagggggtagtgaggatggcacatagggtcacatgggccctacccttttttatcgttttatgtgtgatacttacatgtgggtcccacgggttttattatttttctagatcgattgccacatatttgtcacgtcaatgccatgcagaacaaagatctaatcacaagagccacgtaggcatcacattagccaaaaccagggacaatattgacaagggacctcgtttacacggttttttaagttggggatgcgttgtagccggttttatcatccagggatgaatttcgaactttgtgacaaattgagggacctaacgtgaacttattccgctttggaactaagggtgttgggccagctgaggttctggcccaaaaggagttagactttttgaaattaggcttttaattagttttattaattgtaagtcctagatttattgcttgttatttactggaaaggtcacatattaatattccccataatatatgtgggttccatctgtagtagttttatagaattaagtgataattgacattcttttttaaaaaaaattacatagtataacgcagacactcacaacgcacgcacactcacccctatgaatgcacgcacacaaaccctacccctatgagcatcttcgaagactgggccgataaatcatccttaaaattgacgaagtcaccataggcgtctcgctgtcgacgagtacgtcgcctaccattgaaagcacagtgtcattaaatcctgaaaaattcgctcccatggggagtcgaacccagaaactaaggtggccctactttagttttatacttcaattaggagaattcggaattgggggttgtacttaattcttattttacttgtataatctttactttagttttatacttcaattaggagaattcggaattgggggttgtacttaattcttattttacttgtataatctttaattcggagaatgtatgattgattcattgtttgtatttataagtatcggaaattaaaaatttcccttttttgtgttgtcttttatttatttgagattatcgaattatcttgtaattcaatttgtgattgtaagttgcttccttacttgggtcgattcaagcaaagcactcaaaaaagcaccatgttttaaaaaagttaacaagtttacacgtttttattaatatacgatttttagggtgttacagtttccctctccgactcggatccgaacttgctggggaggcccaagataaggactacacgccgatccaagaaatttttatggcctcaagagctgaggatgaggaagctcgccgattaagggagcagtgggaacgtgaggacaaacgcctttgcaagggggcagaagatgaagaacggcagggcctgcaatcaggatccgtgcacgagttcatgccgtgttcaccaaaactataatcacaactgtatgcttaattaagtgctatataaaaaataattacgcaagtatgagatgaggtggtgagagcctcagaataaggagtctagattaattaatttatgaattaggtcattggtatgtctagattgataattcagacagagtggtacatcagggttgataatttcagattatccgtgtaaacggtctatcagaaaatccaatagaaatattaaataatccgcatatgccggattttagagataccacatccacatccgaaagcgcaccatactatttggaaacatataccatatcctcgtttcggatggattcggagcgattttatctgatccgttttcaccccttcataaatgtatgattttaaatccatctataatctacgagactatgaaggtgacatcttcagcttatacacttcggttgtttgggcattcagctcagtgagtgacatctccaaatttgtgcacaaatagctatatcacggtagtgggtcttactatgacccttcccctccttcacaatttcgaacaagattctttaacatattatcttctaaatttgagtgactataccatatatatatataggccacacatacattactagaaaaactattttcgcaaacatccgctttattttttaggtggggtcaaaagaagacccatctgtgaaaattaggagagtcccttgtcaaggctcgtaaataaaaatcgattttacacgcacacgcttaaattgctcacctacaaattttttataggcgagcgtcttaagcatgcacctttaaaaatttattttcacgtatggaaacttaagccacttgcaacctcatttccgcaaacgggcggtttgagtgtgcacatgtgaaaatcgattttcgcagacatgcggcttaagccactcacttttgaaaaatcatttttttaagaaaaaacatgtatctacacctaactttttcatacaaagttggatgaagataaagtttatatcaaaattttttatcttgatgatatctacagttttgtagttgacaattttttatttgagattattttagaggctgaaacatttgttacaaaaatctcacatgtatttttacaaaatttaatatctatgcttcgaacgatctctgatgaaaacatgcgctacatcaaagttatagggttgaccagatttacaactttgtaatggaagactttttcatttaagattatttagagtactaaataaacgttttaagtttcactgatgtgaagttcaaaagaatagcatcaactccaaacggtaagaactagatagtgtggtggttaggagggatgcgtgtggactatgacggcctgtttggcgagagaagggaagaggaatgggagtttgaaggagggagttgagggtgggattggtcatgggagttacatttttagtcctcatcgcttgtttggtttcacgttgaattcccttcaagtctcacgaattaacaggcctcccccaggtaagagattggtgggagttggaccccttaattccccatcccgaaccctcttgaattcccaagtcttccaatcaaactatagacttaaactcccaaatatcataaactcccattccctatcactaactccctccaaccaaacatgccgtgaggtcttgagtttgagtcctatatacttgtatttagtaaaagaaaatgatgtgtattgtgattcgggtgtgcaaatgtttatggatggttactaaaattaaaaaaatatttttttattttgttttggtgcctaaaaaaattcaaaaatgtgaaaattcactttcaaaaacaatcctcttatgtcgtccacttgtgaaaatcgtttttctcatacggccgccttaagccacctacttgtgaaaaaacgatttttccactcgactggacatcccacctatgataatctctattttcacaaacacctaggaggaggcggggtcgctcagcctcttgcgaaaaatagattttggctgtctgtagagaccatttctatagtagtgagataaatacttggcccacatgtcagccatccaatcaaaaatacttaggagtatcacactatcaattctgggttggttcgggctgattgctattgtatttgttttatactacctctgttttttaatagatgacgccgttgatttttatcacacgtttgactatttatcttatttaaaaaattacataattataatttatttttttgtgagttgttttatcacacgaggtactttaagcataatttattttttatatattgtgtaaaatttttgaataaaatgaatggtcaaacatgtgttcgataattaacaatgtcatttattaaaaaactgagggaatatatctttcggcttttggagccggccccatcttcccattcgctccacaaggaaaaaaaatgtcttaaatggcattgctgcagtgtagacagttatactatgcgtgacactggctagaatcggagcaattatttccactccatagttgttggaagtatcctagtatatatactcgatttggagaaatctatctatatattcattttgaggtatattcattttgaggcaaatttgggagaattaaggatagtcgggatgacagacagaaatttacatggaaggaatcatccatcgatcagctaacaaactactagtagtaccggagaagtacaaaaaaaaaatgtcagaattcgaggagcgtggtggacatgttgagcagcggcccgagcgcgctgggcgcgaacttgcgggcgaacaggtagcacacggtggtgggcttgccgttgtacgcgcagcgcgtcccgttgttgcggatggcctgcacgaacgccggcgtgacggtggccttgccgaaccgcgcggggtgcggcccgccgcgcgaccagtccacccaggtgactgtgcggttggcgttgcgcgcgccgtgggcgaggtgcaggtacgt

SEQ ID NO: 37708 - DNA, 13444 bp, Oryza sativa
ctgccggccgtggaacggcgacgacgacgacacgttcagcctgtactctggcagggcgtgcacgtacacggagtagagcccctcgtgcccgtggaaaaaccgctcccacagcggcgcgaacggcagcggcccgcgcgtcaggaacaggaacgccaccttgggcacgcgctggtacgggtactcctccacgcgcggcgccatggacgcgcgccagaacagctcctcgtccttcatcgagtgcccccatggcgggtgcggttgcacgaaccgctggaagctcagcgccgcgccacacccgtcgtcgcgacaccgtgaccccccttccccgccgcctccatctccgcgccgcgcctccgcctgcttgccgctgccctcgacgtagtagcaggacaggctcgcgctggtggccaggccgatcagcacgccggccatcaggatcagcagcgccgccacggccttgaggagaatccccaacgaccagcaccactccttccgtgtcgccgtggggaggccgccgctgccgccagatccctcctcctcgtccccggcgctgctccgccgagacttcagcaatcccggcttcatggcggaccacgaaccgcggcggccggcgacacccgcgtggagtaggggcgattcgatcggatggacgacgatgactgctcaccgtaggcgatggccagatgatagctggcgatgtctgcccgtgcccggccggccggagatggtgcccggtcgtcgttgctccgtccggtggtggcaatgcaacgacatgcacgcgcggacgaacactctgggcgggcagctgctagcgattgcgaatgcgaatgcgatgggagggaacggccctgcgtgcgtgcatgtgtctgcgcgcgttcctcggctcattggccctctctctgccttgccttcccttccctctaatttaatttgcacctctatttatttttatcttgggaaaggccatttaatttacctctatgtcatctcttacatactagcatccaaatggtcataacaaagttataagatacaccatttatgaataagtgacaaatcgtctttttcaaataatttcaaaacatttcagaaacgttaaaatattaaattgtattttcaaaatatttataatttcttaaaaaagtatggcggcactaatacgcgcgcaatgctcgaaacagtagttcgagcgccgcacaacgttccctccatccggtttttttcgttttttaccagcccacttttcctccgtacaccatctttccctgtctgtttttttcaattttcaccaccttaccttgtgtattttttttcttctttccatctcatccgtgcttcatcaaagggtccgataaaatattaaccatccagatttttatattttctcgttccatctcttcagatttttgtgttttctcgtaaaatatttaccatctagtttttcttttcgagttttctatttttctactgtctccccacatttcaaaagtaaaaaaaaaaatactatacggagttttccatttgctcccaacctcctagctctgcaccttcaaaagtaacaatttactcctatgaatgcatcatttaaaagtaacaaatttacttgcatgaatgcccccacatcgtttggcactgttcctagatcgctataaaaaaatattaccagtgttataaatattgtttaggcgtcgtagtctacaagtaaaacaattactaccttcctctctatatagcccatgttggcaaggagttaactctgttccttctccactaactctgaaccctataaatcaaagccaattctagccaatgttggttatcactgctcgggctagcaccccccttgaataatcaccaacattcacacgaagcctagaacagatggggagcatttaggatttggactagagggaataaagtgggcgtaatggggaatgagagcgagaagaagaacctggagtgcgccgtgggaagatgaccatcgccgtcgatgccggcgcagcgctggatatgccagttccttcccccacgccagtcttgagttttgtttgaaccaaaaagaaaaatcccgacaacttgtcccagcgtaaatgagatagacgcgagtgattgcgcaactagaaccataaaaatagctagtcccgtctggacgggacaccggtaatagcatttccgtaaaaaatacatatgatgtattttaaaacggatgattgattacttcattattagtctcccgcaacaaacttcatgtttgtttgtgatatgtctaaggagcctgatgctctagctaatgcatcagccgttgttgaacagtctggctcaaataatgatgcgaaatttgttgcttttaatttgggtgcaaaacacggggaaatgataaggccaaatcaaattatttaggtgggctcattatgtgtggagattgttccatgccaagagtttggccatgcttaataacttaattaagcatctaccattagtaacttagccgctacgtgatatgtttatgttaaaattttgtacttgagaggtgttctggttgtttctttctttcattttttttttttgctatatgcattttatgcaaaggccagggtacacagtgattcaatttgattgcatcatctttatgtaattaactgagtctaaataaagtttctattatctaaaaaggtaacttagctgcaattttttaatatttctgcatatagcttatatagatgagtttagtcagagttctcgttgtgtacgttagacgcatatacatgggctggcctacgtgccacatacatatatattggccttttcttttgtatcaggttagttttttttttttgggcggtgtttaccgtcgaaagaggtatctaccgaggtccatggcggcgaccccgtcgttgctttcttgaagttgtgcctccacattggtttggtgtggagaataactttgtaaaagtcatattttaaagctgaaaaggctattatattttttaaatatatatttttgatataagttcttatactttattcttatggcaacgcgtggggttgtcgactattactataactaggacgaaagcccacacacatgcatggacatattactaaatgctatataacagtagttactctaaagatgtgaatatttatttatttatttattgacaaaaaccgcaggagagactatgcacatgttgagcaaattcctccttaaaatgaaacttccaagaaatgaaagttggattaacttttctaaaactagtaatatgcccgtgctaaacgctacggtgcaattcaaattgtctttaataatttttaatatttcatgttagcaaaacaaatatttttatgatcatattacgtggacagaataaatctttacaataattagttatatataataatttcagtatacaatatacttcagtatacaatatacgagggcaatatacgcttaaaaaatatgttaaaaaagtatagagttgttccattatttgttgcggacacaaaatagagcatttaatacatatatataatatactaccctgtaggtaaataaccatcctagtgtttagcacttgtgacacacttcagaaatttttcttccccgtactacaaattgttaagagatcgtgcaaatttagttaacaaaagtcacccgtttctgtctccataacctgcaataaaagaaaccatgattgtaaaaaatgacacagcaattttcaattcattcatttcttccaaggttcatatctttagtctatttcccatgaaaatcaggaaccacatgaacaaactatttaattatatcattggttgtaaaaaggtcagattcgacatatggaaagcaagaagagcttaaatgtaatatggcgtgctaacactacatacaccacaatttagtaaagcattaagtttttctaatttgatagcatctgacgatgtcacaatcagagcaaaattgacacaactgaacgtctggtatagatccaagctgaaacatcactcatgtcaatggagaatatgtatggatctaaattctgccaatttatgaagggttctacaaccatgcaatatttggataccaaacctaatatcaaatttactggacacagtattatctgatcatgaaagactgaagatatggaaagtagttagagctgactaattaaactaatcatggacatgattttacggattaacagtctgaaactactctaacaaccaaaccatgatgaattatgaactgtgatatcttaacagataaacatatgtgatgaacgagagcaattgtttttattctaaattccagcacatgcaaaaaaaaggaaaaataatatcttctaatatcaatcaatcaaggaaaataggaaaaaaaagagagaagaaactgcttttaccttcaattgaggcatgaaccaaggatgtcgactggaaacaacaggatatgggcacaggagagctctgattggcagggttacgcatggcaatctgctaaacttgttcaaattagcgaaatttctgagaattgaaaagaagctaagacatctattttcagttatttacttgagggtagagaagagcaatgcaaatagaaaactatatgagcctaaaacatttcatcccaaaatacaccactgaatcttgtctagtaatttgttttctcatccttctccaattcatggcattactaaatgaagtttatcttccaaaaaaaaaatactccctccatactcgtaaaggaagtcgtttaggacagcgacacggtcaccaaaacacaactttgacttcttaaatctataaaaatatttattgaaaagtgatatatgtatacttttatgaaagtatttttcaagacaaatctatacatataatttttacattttcaaactcaacaacttgagagttattcatgatttatattcccaaggtttgacttaaacattgtcctaaatgacttcctttatgagtatggagggagtattgatcagtggttaattgggttagcttgttaacatgaaatcaacaataaaatgatatgattgggccagccttactattgaaaccaagaataaaatgatatgatgggtgaaatggtctatttcctatgacatttctcaataatactaatctacaatttggctgtcattctatgaaagattggaagtgagaaagcacctggaaagagaaaaaccaaatcatgcgaactcttagttccaaaaatgcatggttgtaccttcctgatagtgtttttattttctggcagggctcttaataggatttgaacaattgaaaatggccatgcgtgtgcaacaggaaatgtaaattcagtatgaaccccacaatagatacaaaggaagaatctgtatagcaacacttctgaacatttttgaagatacaaacgaaaatataaattcagtatgaacccagtaatagatcataggttagctcttgcaaagtacaagtacaaagaaaatcagaggaacaaagatccctcttggaattcagaagatctactccaatattcagaatgaccaataataattcaaacagtagatctcagaatcaactttttgtacaatacataatatcattaggtttcaataataaattatgagaataacattttttttcaaactaaacagtagaccaccatatttttatcctaactgaacagtagaccacaatatttccatttcatctttccccgggacagcatatgctttctctgatacggcatgaaaagaagaggactaatggttgaaaaatctaaaatttgcactggaaaatagaagtgaatttgacaattggcatcacacggaaacactttattcaatcatccagatccatttcaccccaaatccaatcattttacttttctatcaaccaacaaaacggtcacagtgcacggcttcatatggcacaactacattatctagaaacgtcataactcaaggaaacatctatcaccttgagaagaggttgacggtgctgcataaatgaaaatatacatgtcacatttcagttaaaaaaaagtgttctttcagtccaagttgcataaacacaaagtcaggaattgtaggattttgtaggtacagtttaatgtttcttaaagatgaactgacattcatttactcaaatcgtaggtaaaatctgaccccgacgcaagcacaattcacatgctatcttgcgtgcaaaatggaaaccttgacatggtagtgctcacatgctgttgacatcaataggaggaatagagagcaggagatagagtaggcagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacagatcgcggatcaacagatgcagtttatatagtcaccttgatatgccttaggagatctttcttcaaagcctaaatcccagtgacgctgacctatttttaacatttacctcatgaggaaaacaggaatccacaaagcaatgcatacataaagcaaaagtcaagaccaaggacaacactttaggttttacatcaacttataactcacaaataactacaaaaggtgcatgcatgcatgtagattttactctaatctagacaccaaagtgttgcatctgcattttctgtcttaaaatgctttctttttcgctgaatagtagccactgatgcaatacaaggatcataatggctccgtggttctcacttcctagtggggccctgcatttcaacaacgtcatgtcctaactcctgatcttaacaattgtctaaaccatcttaccttgactgctgggatctcacattgtgacacaaaagagagagatcattatattttctttaaatagcaaatatgggataaataaatgaataaagttcagaagtgacactgccatggcacaacccacagcagacggtcgcccgctcgagggccgcctcgcactccatgacaaggaaccactactacggaaatcagtataggcgccggttaggaaccggctatagatgacggtttccccgccggcaccaattggtgggcacctatgctggttttagaatcggcagctacagagattatagatgccggttattacccccaaccggcatctatgggttagggatttttttttaaaaaaaaaaacgtcttcaaggaatataggaactgaagcatcccggtgatctcaccacaatcagaagcaaaaacttactccaaggaagcagaaacttgtaccatctcacaacaatctcgaacccaccatacatacgaagtagaaacttaccactaatcatcaatctgatgagctgctgctcctcatgaacatcccgcgcttacgagacgaagccctcctcgcctaccagggaaccccacctccagatcgatcggcagggcgtccagacgtctgtcgctagcggcacgcaccctgaatgaacagaaaccaaatcagagaaaaatgaatccgcacctccgccgctagcggcacaaaccatgaacaaacaaaaaccaaattagaaaaaaaaagaagaaatcccttgatcataagggcgcacgcaccttcgtccctggaagcacacctccaccgatccgcctcgcccatgcatcaatcgatcagcctcgccctgagcgaatctcacgagtcaagagatgcggcagaggagggattgctacgagggaaataggagtaccttcgattcgactcgaactgagacggagggcagaggcgggaggggcggaggccgggcaccgcgtcgcgccctccaagcctgctcgtcgctggccgtgcgtgggcgcgcgtgacgcgaggaggccgcgcagaagggaggaggaggaggagtccgtcgaacacctcgcccgcgaagggagaagggatttgggccgcctcgccggcgacgagcgcgaggggaggaggccggaaggggaggggagccggagggggaggaggaggggagggcggtgacggaggaggcgagggggagggagccggagaggaggggagggtgcggcggaggagacgaggggcgaagcgaggaagagtggaggtgcggcctggcggtgatctgacgacgggaggagcgagaatgggcggcgcggcttcggcggcggtggcgacctggcgacgggaggagcgagaatggcgagttttttttttccgggataatcgcgagatttggggcgaccgtgggggacgggagttgcggggagaggaggcgcgggtgggtgcgggagggaggagagggatctggttcattggatttgagagggtgattttggaccattggatatgtgattcgacgaatgatgaatgattaaaagaatttgttgaagtatatgggtagaattaaatgattcctcctacaccataaactctataattgagctattgccattaaattattacaataaaaaataattcgtagcaatatattgtaatgttacaatgataatttttctgtggcaaataattatattttattgcaacgatctacgatcgttgttttatttagtacttttgttgcaatagaaaatgagatatcgccacaaaaaatcttattgctaaaaaaaacatgttctatcgccacaattttaattttttggtaatttacatagtacatggtacttttcactatttttcattgccacgatcagcaaattcattgcaataaaaaaattgtcgtctcataatttaacttaaatttttcatatggacacggattgagacaaattttatatggaaattatagctctcgacgagatctataattttataggtgataacattttcatttgaaatcttttagatattcaaaactatgattcaaatctcagttaggcacgctcaaatggaacgatatgtatttttccaatagaattgatgtgtaggtgagttggtaaatgagagtatgtgtgaagaataggtcttgggctcgaatccttgccaagacacaatatcaaaaaaaaaatagataggatgatagactaatatttgaacttttaatttggtatatagaactaatgccacattatagagtggtggcaatcatttttattacaacgatgtgaagtgttgcaatatgatttttttgccacatccattccgtgacaacatcgaaatttattaccactaaataaaaatcgttgcaataacctattactacgctatttattaccacggttagcaacgattttaaaattatgacaacatgtatctattgtcacaattttagtattgatgccacgatttttttcgtggtaatgatttttctagtacagcaaactatggcgacaaattccacgattgctgaatatttgattttggataattttaacataaaatattctttaagtttattttatacttataattctaagtagataatgcgtaccaaggatccactaataatgcaagtctaaaaatcatagcctgattttctctgatttaagatggtgcgctgtggcgtaacatgtcataatttatttagtattgaaacaaaacaaacattattttgacttaattaaaatgctacaacatttaaaccgcttgtaaagccaatgtaacatacactatgatcaactaaagttcgcttatttataaaaataccaaaaccaatggaccctacatgtacgcatggtgcatgtggcattgggccattgaagttatagatggccatcataagacctgcccggcacggcctggcccaggcacgggcgaggcacggcccaaggcgatctggccggcacgacacggtcggcacttcgggccatgccgtgccggcccacgggctgcaccttaggcccagacacatcccaccagtagtcgggtcgtgccgtgccggcccgaaggcataggcagcccatcgtgacttttttaaaataagtctattttccttccatcctctttgggatgtgacatatatatagctaaataagtctattttacgtcccgactctttgggccgtgccatataatatatctattttgcctccctattctttgttatgtgccttacatatggttgagaataagtatgtttcgtatccctaaacttcgggccgggacgtgccggcccagcgtgccgaggtagcagcccaggcacggcacggctattgggccccggccgacacgggcatgaccgaagtcgggctgtgctgggccaaaattaccgggtttgggtgggccatcgggcctcgacccatatgaccatctataattgaagtccatagtcggtgtatttctaaaccatctacaataatgaatctactaatttaagtgaaaaccaataaccagatattttaattcttttcaaaatttataggattttataatttattagaataatcaagagaagagaagtcatagaggactttaaagaatgttttttattgaaattactattgggcctcgtccaatatataaaggtaaattttgctatagtacactttggtttcgtggttttggccgtaggacaccgcccaaacatacttttgggggaaaacactccgtaaacgtggtaatttgtcaatggacaccgtatcgattagaataataattttcggtcgaaggggggagagaaatcgcgtgaaatgtcaaaaatgtccttggacccacatgtcagttatatctcttctctcacaatcctctccttccagcgccgcaacgcatgccaccgtgttggagccccacgtcggagctcgccgtggcctcggaactcctccttctcctccacgccccaatccccaggcaacgcggacgacgacgacagggaacggcggtggcagcaccgatccaaatctaatcggcacagcttcggcaatgccgcccttgtcgttctcttcccacgcccgaccttctcagacctgctccgccgtgggcgacgtgcgcccttccttactctgcttccccgcgttgcggcgcatgccaacctcactgtctcgctcatcgtggcggaggagatggcgaggatagcgggagcgactgcggcggcactcgcggtgggagcggcggaggacggcgaggacgtggcgaagtggcacggggcgacgtcggtcaccggggctcgagcttgtcgcggcagaggagatggcgaggatggcgggagcggcagaggaggcgaggaggagagtcgcgtcgtcgtcgccaactgcggccactcccgcggcggaatgtatccatggtgctcgtcgccggcttcacctccgccttcatccgcgacgtcgacttgtaccgcgctgagccctgggacctcctgctgccgtcgctgccgccgcgttagtccattatcttgcatgctctggcctgagatcgattgcgacgacattgcttgcgtgcgtgcgttggctttgatcgatgtgccgtcgttgttgatgtgtgcaggtgtggcggcggacggagctgaggagtaggaggaggagcggtgcggttacttcttctgcacgaggagcttcaggtggccatcgggaacgaggacgaacagggccacggcggcatgaacaggggcaccctctccttcatctcccaaggcgtgacatgtgagagaggagagatagcagtgctgtcatgtgggcccaaggatatttttgacatttcccgcgatttctctctcttcttcaaccgaaaattattattttaatcggtgtggtgtctattagcaaattaccacgtttatggagcgttttcctctaaaagtgagttccgacaggcgaagtgtcctgtagcaaaatttgtcatatataaaatactataggatgtttgatggacttttaatgtgtttcctctaatttcttgggaggcggcatgcctctcaagatagatcagataatatcattttgaggcttcactatttaaaagcattgggagtaaatgttgtaaataatagatgagtatccagccgcgttgatgcgggaaatcaagttacataatatgtataaataagatgtaatataattattaaaactaaaacaaattgatacttatgaattttgagcctaaaaataattgaaattgcatggtgttatgagagaataaagaagagacaatttaaactatagatctatcgtataaaggctagaaataattagggtgacgtggcttaatgagaaaagagaaatagcgttaacttagtggggatgaactatataagtatataggattactcacaatcagatttagcccctagcaacgtatgtccaaaagttatatctacatatatttacatacttcccctattccaaagtataagtatttctagctatgaatctggacagactattttctagtttcatagctaaaaattgttatattttgggacggaggtaataataaatattgtaaatgttattatttctttcaagaaattttatattttatttagctacaaatatataaaatgataatataatctatatggtcaaatgacttttttccttacctacttgaaggtatatgtgcacaccagatctcaaatatagttgagttgatgtacaaacacctcattacactactaaaaaataattttctcaggcgagctgatgtgaccaaggcacctatctcttttgccggtgattctttgcaaatttgtgtcaaccaaattgaagagagaaaatcaattaaccctgctactggtttgatgcagaaaaaaactaaaggagtacatatatgttgggttaatacgtgtggtggtttgatttgggattcctaacccgcgcgtacgctgtccagtcactaaccatgtgattagcactaatgataacgtgattagtgattagtgctaatcataattaagtacctacaataactttttttttctaataaattgaaaactttcaagttagatttaaaaactttcaacttatgatttaaactttgaagtcaaattttgaaatctttcaactcaataattttaaaaatttttaactcgaaatttaaatttgcaagataaaatttgaaaactttcaatttcaactcggatttgaaaactttcaactcgagtttttaaatttgaattataaaaaatatttttttattaaaaatatcttataataaaaaaattgataactttcactgcatcctaaattaatcaagataaaaacataaaaaaagaaagatcgtatagatacatgcatgcatgtgtgggaccaaggtgcgcactggtggagaaaccatctttcgccggtcggccgatttccacaatagtcccggatgcaataaaaaccggggctaaagatgatctttagtcccggttcaaaagggtaacgggcatatttgatctttagtcccggtttgtgttaccaaccgggatctttagtcccggttcgaatgctgtcagggcctgtcaggcccccccgggatctttaatccc

SEQ ID NO: 37709 - DNA, 1218 bp, Oryza sativa
ccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacattttcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttattgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagtaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactgga

SEQ ID NO: 37710 - DNA, 3007 bp, Oryza sativa
agggatacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcgaaaaggggcctagaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttaagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtctagaggcaagcatcgccaagggttatggaatagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagggcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatggtagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatcttttatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaattttgaaatagcgggaaaagatatttactcccggttgttgagaacaacctggagtaaagatccgggggtatatatattcccggtgcgccctcgtcttcttcaccaacacttagacattttcggccgatcgatctctctcggcctct

SEQ ID NO: 37711 - DNA, 20143 bp, Oryza sativa
tacgttgccgcgagaacgtgaacgagaacgagaacgatcgaacgaacgagagcgagaacgaacacgtcaacgtacgttgccgcgagaacggaacgagaacgagaacgagaacgatcgaacgaacgagagcgagaacgagaatgatcgaacgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatattacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacggaagagggcacgcgggcaacgaggtgcagcgaagaagcttgagggtcggcacatcataacggaagtggaagaagatggacgtcctagtgccccggccgaagccgccaagaactatgtacgtcacagcagttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcagaaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggtgatcagatacgagaggctgcgcgacgactaacagatgcagtggaagcctcctctcagggcacgttccgaccagacagagatagggacgagctgacactcgccctgcagactccagagcatccaggatgaacacgagggaaaggggtgattccttggaagattggtttcaaggaggacatccacacgtacaggagtcggatgagaagcaagagagatatcgaggcgaagattgcagacctagagttccgggtatcgagctacgaactcaacatgcaagaggaggtggcaaggaaggttgatgaacgcatggccacacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggtggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcgtcgtgctcctacacctactcccccgcaagctcctcttccggcaccttcaaagtcaaggccccccccagctccactgcctgcccacacaagggcaacgaagaaggtgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttctttaggggtatgtctgcatctgtcaagaggagcatcttctggaaagtccaaaccagtccctcagcttggagagcaaccaaaccaggagatcgagccattggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacgaacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtctcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctttgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaattttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggatatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatataatatatatatatatacatatatatatgtatgcatatatatgtattgaaacatatatatgcatggtttatatatatatatatataaaccatgcagcaacagggccatgcaaaaaaaaaaggtcagctcgatctttagtcccggttggtaacaccaaccgggactaaagatcgatctttactcccggttatttcacccgggactaatgatagcgatctttagtcccggattagtactcccggtttggaaaccgggattaaaggggggttacgaaccgggactacagagggtttctccaccagtgtatgcatgtgtgtgtaatgcatctgcacagatgaagaccaaggtgcatgcatgcatgtgcagttggcttgtggcgcgtctgcccgagatatcaattgcgggtttgattagcctaattaccaaggtcattagcactgcagccggattattatattatttctcttgcatgtagcggtcaggttgagtcagttttttttatgcatgtattctgatagttcctgagtcttgggtccaatttggactagctagcgtcgtcggtgtccatctgtggtaggtctgcgagcctcagagcctgacctgaaagcctacgtatcttttaattggtcgatcacgattaattagcagagggattagattggtttgtttggtttcgccgagggtttctccccgagcgaacaaaagatggcgcccatctttctttcattgaaagatcttgtcaccggtttggttggtagaagagcaactgctgtgggaggttttctgttggtggtgctactcggttctataagtttctctcctttctgatcgtgtttgcttaagcaccggtagaagtatcatttatctagggtttggaatacaataattaagtcagtctggtagatatctattgagttactcagttctgagatcagctaattaatttatcgattatcgttggtaccgtgattgagagggaaaattcagggtactttgctgccaggtgctcatcacgaccaaaatgggttttcgcaggggctaacagctggagaccaaaggctagtgaagatgaagtattttccacgtggttgccaaccaccagctttactccatttccgctagcggatttcataaggcaaacgccaatgaaatatctcttcactagaagctcctttgatgaatgctgccagcgaaaatgatcttcgcctgtggcgggccttaagcaatgtggtccacctatgtatatatttattttttttccaaaccaatatgatcgggaaatcgataataagtttttttttcattattgattgatgaaaccacaactgagtgcacttttgattgtagttgttaaaatgtccatgcaaaattaattattttattaataaggtgcagcgagcaaatagctagcatattgggctagctggccttacaattaactgcaaaatgacatggcaatgggtattactagctactactagctataccattgaccttgctctaacgtgattatttttaccgtccgtgacgagctacattattaagcctgcttttatcccacatgggacgatagtacaataatggaccaatatataagaaattttgggaaaagagcttccatcaatttcaattttcttgttcgcattatttaaaaaactaggaaggtagcccgcgcattagcgcgggtatgtatattattttgtttcataaatagttctaacaaaataaggttaaattaaagtaaggtctctttcgttttaattgaattttcattgtttactttttatttaaaaagtctccaaaaatttgaattgatcgtaaatttatttttttacatcatgctagctctctttttaattgatcaaatatacatatcttatatagaatttctttgtaatatgtgagaccctatcttaaaataataatttattaggaaaaatatgacttttaatcatattactgtaaaaaaggttactgattttgtattcccatggaggttgtggagaaacccatgcagctactttaaagggtaggaatttactgaattcgttgatttatcgttgacctttgcctcttggtatgcttaatatgacttttgttgcttatgtggcatgttttatgagtatgctctagtatatatcaattgttgctttgttctaagcgacgaacaatttagcacagtacaatataaatggggacagatccatcttcataaacttgagttgtgttatttacaatataaagttgtagctcatcagagaaacttgccatggtgatgacaatctcctacaaccgcgagaggtgttgtagaattttttttccaccgtgcatcgcattcatgggggaggtgacgtgggcttgactgcatgaggctatggttaattagatcaaactaatctaacggttgaagcccaggttgttctcttttgatgaaatataaatccaatagcctcaaataacggatcatcaatttaagtgaaaatctttatcataatttacatgatttttgtaatttattatagcatcatatgatggcttatgagtgtatgtaggatgccatgtgatggattataagtgtttgtagaaagtttaatggacttttatataaagttgcgtgtttgtgtaactatattgcctcccctctattgaatttacaataataatgtacaatgtacatactgtagatataacgttgtcacatttaatttttttctgtaattaacaaaataatttgtcatatgttggtgcgatcttggtacatttgatcattctttgtcaagacgtcacataggggcgtggagtgaggttcggatgatttttctttttaaaaaagatagatctaacaatataaaatcgatttaaatagaaaccgatggtcgaatgttttattttctctaatttaagagggccatgcagttatttagaaatatttgtacgatgtttaacgtactaaaaatagaggatagagatagagcttgctacatctagtaggttgatgtctatctatggattttttaggctaaaaaaataattttaattattatggaaataagaaaagaaaggaacggagggagggtatgttaggtacatgcgtgagaacgccgtacagaggtgtggacagagcgatattttttttaagatagatctaatgatctaaaataaaaggctcactaatttaaatgaaaatcgatgaccaaatttttctgtttatagggtgtcacgtgacgactcgagagtgtttatagggtgccacgtaatggattataaatgtttgttggaagtttagtggaaattacgatcttcaaggtatctaattattgattttttttatatactagtaatatgtccgtgcgttgcaccgggtcgtggtatgttggataaagtttaactcaactattgtttggagcactccaatgtggcgataagcatgggtgacttgtataataatcgcagaggtatttttattttgaataattattgcactgtacacgtgtatggttcgaagaatgtaatgcgttaacataatgattgtaccacgggaggaataaacagtgaatgttccgatcactttcacgcaaaaagaggacggaagtttgtttgattaaataggtaagttttagaccaataataatcaggacggataaaataatacttttataatggtcatgcgtgctttcttactctgtcaattatgctttcttactgtcaattattatgttattagagcatgtacaatagtaggctataagtcggttgcaaacatattttaagaagttaaatagagaaagaatagcagcgggctacagatttatagacagctgtagcacgggaaacagtgtgagtataacaggtaggatcaggtattcaggtattaatagtgtagtatgtaactattgtatgaataagctattagattggctatagatgaattagagttagtagttggctatactattaaacttgctcttgcgtgtgatccagttcccaaaatcatatgtggactcgggtggagatcgaccgtgtgacatttggatgatcgatagcgcgcataatcttaatatgtcgtgtctcacgaatttttttttatttttttacaatcgacatttttttacgtcaaacaaatattaaagtggaagtttcctgtgtgttttatgtcaatgataaaaatcaataataaaagaaaataccactcgtctgtgatactgaagtttaagtttgtacgtatatctaaacattttttagtggaaatcaattccgtggattagcactatctaggaacttgaccgttgtagttttcttttctttttttttttaaaaaaaacgaaagctcgtagttcattaccgagagcaaatatctgtagccggtcggagtgcttccatcatttctctcgctctctcctcgtctttctccgtctctctctatcgccggccatatccaccactgctccaggctctttcccttactgctgcagttcggtgatgagcgtattggggcagcgccgcccctctgctgctccgctggccccttggagctcgagtccgcacggatcccttcgtctctccgcccccctcgcgcggatccgccgtcggcgcctggattccaccgtctctccacccttctctcgcgcagatccgccgtcggcggcaataggaggggctgatccggcgacctcttcccctctcgcacggatcccgtcgcgccggcgacgacgggaggggtggatccggtagcctcccctacggtgacgacgacgatgggtggacgctacctccatcgctccatctgccagcgacggacatccttgattcgccgtcaaccccagccactgccgcccaggtattctttttttttaagacaacatctgagaattccctctagtcacaacctgaaagtactctcttgtcaaaagtaagtgatttgtttaatcctttagttggtcagtcggctgaagagctggtctgtagcattttttggtccgttgatgctaatcgaatcatacaaatagcacttactcctggtagcgaggaactcaggatgttgtagcatggcaacatactaaatctggtatgctcactgttcgatcggtttatcatgcacaatgcaatcataagttctgcaatcaggataggcaatctgagaaggtagagcaaacatgatttagataaggtttattttgttatgcggcttacaaaaacatatttaattttgaattgattcttttattggtacatgcagtgataatatgaacttattccttttgatgatagtacctgttcatctaattaattttataccacacagtatcctgagggaaggcttcatatttgctaagtgagttgcgtttttttatgtgtgctattgaattgaagtgagcaaatattgctgtcgcacatacaggtctgttgttcttccatccttcttagtgatttttacctccagatgtttatatatagatagaatagacaattctaaggtacctctttagagataacattctcttttgccttattttactatcgtttgtgtctgccttcaaaataaatgttctgaatattcagatagtttaaatggggtatctaaatgatttatatgacttaggaaattagagctgttacaaacaaatttcttgattttttttcccatcaccatagtgcattaattgtctagttttttggccttctcagatgaaattgatcttgcattcttacattggtaaagaaatattttctttgttggtttaaactcggcttgcttttgcatgagcgaatgtactattttggtagatacatcacatgcataattaaagacagtataacgtaccatgaacagtgagtgcatcagcaagttattatgagccaatgcatgttatgacttagtgataacattaaaaaagtaggcaagcatgcatggagtagaattttttgagttatataaatctaatgaaattgtaattgcattcaggttgagtacaatgataacctggaatcgacattgattggaggtggcttggcaccctagaggaaaaaccttgtgatttgtattttttttgtgtgcttctattatttctatatgtatgtcttgcctgagaaatctgtaaaatcgtgatcgggtgagcgctaaaaatagtggaagaaagaagaaaaggaaaacggaatagcaagagcaggactcctggtcgcagttggggcaaaccggagtaggagtgggggtgcacctgggcttgtgggcttgtggtgcacctggacttgtggctctatgggcttgtggcttggacctggacttgtgggtttgtggaacacctggacttgtggctctatgggcttgtggcttggacctggacttgtgggtttgtggaacacctggacttgtggaggtgcacctggacttgtggctctatgggcttgtggcttggacctggacttgtgggtttgtggaacacctggacttgtgggcgcacctggacttgtagctttatgggcttgtggcttggacttctggcctggcctactgggctggcgctagagaaaagtgaaaaaccgaacaaaatcggatccgtgaaaaaagcatgtacgggcgaaaaaaattacgcacggacgaaaaaattggtgactaaaggaaaaatccgaatatttatattagttaagatgttgttaataaaggagagaaagtaaggggggagagagagagatacataagtacgtacgtgcacattcatacatacatgacgtgaaggggtgggaggtgggtattttcttttttttatattgctaagataaattaatggtagaaaataattggtctaccatatttaagttgaaatcaatgttttttttgttttttcttcgtaatttctgttattttctctaatttattagtgtgttaattgacggctaaggagctcatttagttcccggttattgaaacacaaacgaagtaatcattaagacaatagtttcacgtgacaacttcttttaattaattaaaatatagttgatatggatgtgacatttttatagataaaatacatcatatgctttataaaattttaacatggaacaactagagaaaataaaataaaggtgtaggattggttgctttctttaccgtaggtgaaaacgtgcatacatatatgttctttttttatttttttcaaacaaatagtctttttttgtttttctttagcacaaatagtgcgtagtttttccttacgtaagtttgcacgtgcgtgcatatgggctggtggggatgccctgacgtgggctgatgggtgataggagagggaggtgaaaaaaaacaattctaatggtaattaaaatggtgggtctaactatttgttaaggtgacacacggtggtttaggagtatttgtaggacttccacatggttgtttatgagtatttgtaggaagttttatgaactttagtattatttatgatataatagaagataatagatgtcaaatttttaagttgaaaaatcaaacaccctcccaacaaaccttgtactagtgtgtaattatccgatggcgatcagaaataattcagaagggtgaaccacacgcgttaggtcctgtgcctagtaacatttaagtcgccaactaccgctgagaaatgacgctattatttaacaaaatagaaatatactccattcgtcctaaaaaaaaagataaaccctaattttcgtgttcaatgtttggccgttcgtcttatttgaaaaaattatgaaaaaaattaaaaagacaagttacgcataaaatattaatcatgttttatcatctaacagtaatgaaaatacgaattataaaaaatttttatataagacggacagtcaaagttggacacgcaaccctaggatttgcttttttttttttttttaaacgagggagtaagaaacacggagtgatgtctgccaccagcaaccctgagacgtacgtgttgtcacatggagacttgttggagtgagtagtagcagtaatgacggcagcaactagcaagaacgtcgtcgtgctgttccccttccctggccatgggcacctcgccgccttcttgtccttcgccggcgtcctccaccgcgccctcccagacgtcgccatcaccctcgtctcgacgccacgcaacgtggccagcctgcggcgagccacgtcggcaggacatgactcctttctattacacgagctgccgttcgtgccggccgaccatggcctcccggcgggctgggagtcctccgacggcgtcccccacaatcgcttcccggacttcctcgaggccttggaggtgctccagccggccttcgacgacttcgtcgccggcgccaccgccgccggcgacgtcgctgtctgcgtcgtctccgacccgttcttggcgtggacggtgaccgtcgcgcggcgccgcgggtgcgcccacgccttcttcgtgtcgtgcggcgcgttcggcagcgccgtcgtgcactcgctctggagccacctccccattcgccccgacgaggccggccggatcctcctaccggagtaccccgacgtggtcatccacaggtcgcaggtgtccagcaacgtgctccacccgcccacggccgtgaagcaccgcgtcgaggcgttcttcgggcggcagatacagctggggtacaagacggacgcgctgctcatcaacaccgtggaggagttcgagcccaccgggctcgccatgctccggcgaaccttcaggctcccggtaattccaatcggcccactcgtgcgcgcctccaccaaaacaacctcgccggagacggacgccaccgccggcgccatcaccagttttctcgactcccaccctccgtcgtcggtgctctacgtatcgttcgggtcacagttctccatccaagcagagcacatggcggagctggccgccgcactggaggccaccggccggccgttcgtctgggccgtgaagccgccggacgggcacaacataaacggcgagatccagccgaagtggcttcccgacggattcgaggagagggtgacggcgaccaagaaaggcctcctcctccatggatgggcgccgcaggtggggatcctggcgcatcactccacaggagcgttcctgagccactgcgggtggaactcggtgctggagagcatgacgcacggcgtgccgatcatcgggtggccgctcgccggcgatcagtactacaacgccaagatgctcgacgaggagtggggggtgtgcctccgcgtggagggggcacggggggacatggacatgagtgccattattgtggacaaagcgacgctggttgccgtggtggagacggtgatgtctccaacagcgaaggcggccgagatgcggcagcgggcgagagcgatcaaggagatcatggaagctgcacgggagggtggacatggctcgtcggcaaatcaggcattggaggagttcttcaaaacaatgaagctgaacggctgaagttggaacaaaatccaaggttacttatttactatgctagccgctgtgttattctgaatcatttgttattacttaccacatccacaatgttgcatgtaaaatgatcttaaggaataaagtaatatatttgttttacctctatcattgggagagtagccatgaagataatatttttaagggtaaccttgagcttaaagttataccataagaaatacaaaagtattttatacatttgcaacatatatagtatctttgaaatcataggtgaatagagttttttttttcttaattagtgggttccaccttaagatcgagaagaaaccatacatattgttgcatgtgttatggcattatttagtaatgaagatatattgtgagatgacatgtgtgtatgatggtaaaattttcgccaattaggatagaaggctcaccatcatctgaaattattttatcagaaccacaaatgataaaaataatattaaatgctcataaaaaagatataatgacaataatgtttattttaatcagggatttctgcgtatatagttttaaggcatattttgctataggacatcgtgactttgtggttttaactccaggacaccgcacaaagtcacttttagggaaaaacactctcaaaaacgtggttatttgccagcggacaacgcacccattaaaataataatttccggttgaagaggagagagaaactacatgaaggctgcgttctttcttcttaggaacagtgattacggaaaacggagcgatccattagcatatgattaattaagtatctgctattcttttttaaaaaaatggactaatatgatttttttaagtaactttcgtatagaaactttttacagaaaaatgcaccgtttagtagtttgaaaagcgtgctaacggaaaacgagaacgactatcctgaaaagaacgcagccgaaatgtcaaaaatatcctcggacccacatgtcagctccttatctctcttctctccctctccctctccctctccctctcccctcccctcaccgacagcaagcagcagcggcagcatgcagcagtagcagcggcggcagcggcagcagcagtcggcagcggcggcagcaacagcagcggcagcaagcagcacagcagtagcatcggcagtagcagcagcggcagcaagcagcagtggcagcggcggcagcaacagcagcggcagcaagcagcacagcagtagcatcggcagcggcagcagcggcagcggcaatcgcggcagtaagcagcagcggcagcagaagcagaagcacgcttcacgctatattcagcgggatttgcacggattggttagagtgccagaaaaataagagatgaaatccgcttcgaatccacgcaatattcaacgggatttgctccgatttttgaggggaaagaaagagaaggataaggggaagaaatcccctcaatcaatgtttgaacgagcaacgggatcggccgaatttagagcgggaggcggtggtgtggcgtacgggcacgagagctggaggttgaagatgtagcccgagggacagaaattagactttagatgtgcagggtaatttggtccggtcccgtcaaaatgtgggcccgctcaagcctagtcagcacgaatacactaaacaaatgggtgcggtgtcctctggcaaatagctatgttttgggagtgtcttcccccaaaactcatttcgtgcggtgtcctggagctaattccacgaagtagcagtgtcctgtagcaaaatttgcctagttttaataatctcttgaaatgctcacatttgcagaaaaggggagatatccaatggaaaataaattaaaaatatatctgaattttaacaaatacatggccattccatccaagccaaacaaacacatattccatccaaacaaacatatggccaacgggttgaatttgcggaaacgggttgtatagaattttaacaaacacatagccaacgggttatatatgttccatccaagccaataattttaagtaaaactagttggatgcccgcgcgttgcaatgagaaaatttgcatgtacccatttgaaatcatcacttaaattatcataagtataaatcacaccatgtcatctgctacctcatggtaggattcttttcgtgaaattgctgtatgtacgataacttgttgcgattttggtacgatccagttatgcatgataattgactcggccagaaagtgcgaggcaaagaggcgtcgtgcttgcacattattctacaacaatacgctcgccctcctaagcatgtgcagtgcacatttccacaacatatatacactagataatatataaacttgtaaaatttggaaatattgtcatatacaaattcatggcccattgccaaaagactcgaaaataaaaacccaccaaaatctttataaattctatatacacaaacactttgatatataaagatctttacaagtagtgcatttgttatttccttaatacaaccattggcatgacaaaaatttatattccatagaaaaaataatttagttcagcctatcatggttccacactatgccaacttttatcatctaatccacattactctttcagaactcagatgttctatacaaatcagtcgattattgcttagcatattccaaaattgtattggtttcctaaaacatctatatgcaagcagagtacatcaactgcgtttatgggtccagatggcaaactgcatttgaaaagtggcagtatacataaattctgtcaaattctagtgtgcaattcatgaagcatttggcgatcaaatgccatcaaaccataccagatgcaaagcttaagcagtacattggccaatttgacttaaccacaaaagaacatgaagttaggatccgaacaaccagcagaagaaaagatttacaccaggtttttgactataaccaccagcccgcccaatgacctaaaaataggtgatattaacttttttagctaaattcactttttgttatgtgtactcatggtctgcaatttccagtgttcacgcttcaagttcaagttggcctttttagagcgaaatgattcctatcttatttctaagaataattcagaataaccacatctcttcaagctggacctgctgtttgctgccatacacctgtatggactggacagagttggaggcttggagtccaggagttgctcggcatcgacatcactgtctgtttgtgtcgcgcgcaaggatttgtggagaagaatcgggaagaatggggatagactggattatagtagatgaaataacaaggaacagtcctgaaccaaaacggcgcgacgctctccgtcgcactgagaaggcaggccgacgggcactaagataaatcttgacctaatgcctaattgactaaggataggatctcctccttatatagatggatgattcattaatctagtcctaacaaaccctaactctatctaatgggcctaggactcccggcccaaagcccgtgacattacttccctctttttgagcagcagcacacccggctagactcaaacggaacaccataccctaaactaaaactcttaagccttttacatctcggcttttatgaaaaacaaaaataaaaaacaattcatgcgcaggaggaccccaacctgagcctcctaaggagaggaaaagccccttccatgatccaaatcggaaggctcagaccaaaattccttggctcaaaatatgagaaagatcaacctttgcatcataggccaacgtggaaaccacctagcccaactaagagagggcagaaaccctatctcctttcctttcaggagaccacaccgctaggagcgacgcagccgtggtcgatccgccaacttcgcgaaccagcacgtggggccggcacgatctgcgccattgcgacacgtgaatgccacacccacccgtcgcgcctgcgaatcgcgccgcacgcacgtcgccaagctctgctccaaccatcactggtacgtgcgcctccacctgcggaaacaaagccgcatcgccggaaaatagcgcctgaaaaccaaacgcccgtaccgtgttgtatcgccgttgaagtggaaatcgccgccgttgagggcgccaacggcgatggcgccatcgccagtcccaacggcgaggtcgaggttgcgttgccactcccagacttggcgccgccggaagaggaaacatgagcacctcgccacgagtcacgccgcccccgcgtggttgcagcgtcaccgctaaatattgccgccatctgtgctgcttgaagacgcgccctcgcgaacgcaaggccaccgcatgccagtataatggttcggcctcctcaatgaaagccgccggcttggctgactgagccgccatggcccggagttgcgccgccaagtccatcatcttcttcgagatctcgacaaggccttcgctgatgttgggaaccgtagagatctcgggacccatgggcacagaaccaaagctctgataccaagttgtcacgtgcaaggatttgtggagaagaatagggaagaatggggatagattggattatagtagatgaaataacaaggaacggttctgaaccaaaacggcgcgacgctctccgtcgcactgagaaggcagaccgacgggcactaagataaattttgatctaatacctaattgacctaggataggatctcctccttatatagatggatgactcattaatctagtcctaacaaaccctaactctatctaatgggcctaggactcccggcccaaagcccatgacagtttgattaaatatatagtcaatagtgtgtattgacatgtatgcaatgaagtttattgatctcaaagatccaagttatcttttaaaaattccatgagtccatggcccaaaaggtgactgtgctcttggaaaataataaatagagatattctaaaccatgggattaacagtatatgagatgcctaaaggtttaactgaaattatttatgttcattctggatcatatgaaaaggtcaacatggcttaagtgaatttttattcttcaaagtatatgagaagatataagcatatataatcattgtgcgctgacaaatcttaaaatttgacatcagacacactctgtaggggaaacaaagagaaattggtttaaacttctctgtaggggaaggggccgagaggatggctggcttaatgctgcgaattggataatttgtggtaaatgccagtacaactgcaaactacctttcatgagatataaacaaccatttagcttttgcgtggttcgtcgcccaactttcttttgtgtttctcataacccctaggaaggctgttgggataatgtgaaaagaaaaaagtccacattgtaaaaaccagtaaagccaatcatagcgtcttcagtgctctgaaaatatcaacaaaagcattaaagcagatcaccagctaacacgttaaaaccctagtcatcatgcaaaccaggacaggtttatatggaccattcgcaagaaagtcagaggagcatatatatagacaaggtagagtaaaccttaatgagtgaagatatatagcctagccatgtgacgatccgtttttttcttcataacctcagactctaaaagtcctacagtattagtcaatcaatttaccgtacaataatgtgcttgctgcaatccttccgaatttaataaaggaatcgaactatcagagtttgaagtcaaacgataaaaatagtatcagtgcttg

SEQ ID NO: 37712 - DNA, 820 bp, Oryza sativa
gggaagcgtgaacgggggccattgccatctctactccccaccctctcgttcatcctgtccacccagagccattgccacacacacacaccgacaggtgccctcgtgcttcctctcctttcagacaaagcaaaaaattaatttccttccagtggagaacctcgaagtcaaagaacaacgtgttcaccatgcccagcgatggcaacctccgcatcgtcctcttcccgttcccggcgcagggccacttctccgccttcctctccctcgctgcccacctccacgacgcccagcccacggccgacatctccatcgtctccaccccgcgcaacgtggaaggcctccgccgccggtccagctcccagacgcggtacctccggttccacgccctgccgttcgtgcctgctgagcacggcctgcccggagacgccgagtcgaccgatgccgtgccgcccctccacttcatcacgctgttcgaggccaccgagtcgcgctcgctacaggacagcttcgacggcttcgtccgtgacttgatcgccgacgccggagcagacgctgccagggtctgcgtcatcgccgaccccttcctcgcgtggacgaccgacatcgcccgccggcgtggcgtcgcgcacgccatcttcgtgtcctgcggcgcgttcggcagcgtggtgtaccactcgctgtggaaccacctgccgcacctgcgtgcgcccggtgacgatgcgttctgcctcccggaccacccggaggttactgtccaccggtcgaagctttcgccgtacctactccacgccgacggcacggaccggtggtcggcccaacaccg

SEQ ID NO: 37713 - DNA, 746 bp, Oryza sativa
tgatggtaaaattttcgccaattaggataaaaggctcaccatcatctgaaattattttatcagaaccacaaatgataaaaataatattaaatgctcataaaaaagatataatgacaataatgtttattttaatcagggatttctgcgtatatagttttaaggcatattttgctataggacatcgtgactttgtggttttaactccaggacaccgcacaaagtcacttttagggaaaaacactctcaaaaacgtggttatttgccagcggacaacgcacccattaaaataataatttccggttgaagaggagagagaaactacatgaaggctgcgttctttcttcttaggaacagtgattacggaaaacggagcgatccattagcatatgattaattaagtatctgctattcttttttaaaaaaatggactaatatgatttttttaagtaactttcgtatagaaactttttacagaaaaatgcaccgtttagtagtttgaaaagcgtgctaacggaaaacgagaacgactatcctgaaaagaacgcagccgaaatgtcaaaaatatcctcggacccacatgtcagctccttatctctcttctcttcccttctttccccccccctttttttcctttcccccccctctttttcgcccttccctcccctaccgacagaagcagcagcggcagcatgcaacagtagcagcggcggcagcggcaacaagcagtcggcagcggcggcagcaac

SEQ ID NO: 37714 - DNA, 25513 bp, Oryza sativa
atcacacatacgtaaataatatcgtcatggtttattcagggaaaatcataactccatcagataatttgtgcagaacggcagaaccttattaaaaaaaggcatcagtgacaacaaaccaaacattttctgtcgaagaaactaaaatgatcggatataatactttacacgtgcattggggaagaaaacaatttgcacccataacccagtaatataagtttcatggtcgggattgtatactgcagacgtcgcaagaagagtcgagagggcggaacagcaggaggcggcgcaggcgcagatggcgcgctggcgccgtgattgtttccgtgccggacggagaatagtacgatgcttgctctgttttgataggatctgtttataagtttgttacgattagtttcctttcaattagcatccgtttgttacattttgtatacctatttaaggcaattaatcttagaataaaggcaagcaagatcaaagctatctcctcatctccagcttcctctgtttctcatctctttctgtcgctgtgtccatcacgggtcgccgatcattctcccccgatccgccacaacccatttggtgagctcaagcgcctcacgcagacgagcaccgtggtggcgtaccaggagtgttttctggcacttaccagtcgcatcccagaccccctcaccgagagtcagcaagtgcaacttttcatcgccggtcttcaggatgatatcagcatcgacgttgaactgcagaagcctgatgatctccaggacgccatgagactgcctcgggcgtacgagtggaaggccaacaaacccggcgcaccgccgcggagggtgtttgctcgcgctgcggccgccatcacaccggacccaccgccagctggtggctctaccgccgcagactccattccccgacagttccgtcgactctcaccggccgagctcgctgaactgcgaaagtggtgctcccggtggggaggataagataaggatgactttgagtttggataggtacgattattgcggattgactacgtaaggttccgcctgcaaaaatcatatttttttaggtggagcacttaagagttctgcctataaaaataaaggtattttggtctgcgtggaaaaattgattttcgtagatggacaacgaaatataaaaaggcatccaaatatctctttctcattgtaatgcaccaccaatagtgagctatcttgttgcgtaaatctgtctttatgatcctcatagctgaaaagaatctttcaactgatgctgttgccactggaaggatcaatgtaaacccaatgagtcaatacactaatggaaaagtcatgttctttctggactgaaccattttttcagcaatttttgcaagatcatggcagtcattgaattcaacacatctcctgatgttgagaataaaggtttgaagttgatttctcaacatcaaacagtcaactgtcataaaatcaacagcgtaaatctcaacaaatcgaacaaacttatgcatatcaaacttagagaaggagttgcttggattaagataagacatgcacaccaataaataaaaagaaacttaatgaaatctatgattaatatctcccataattacatctagagcaacattgaaaatatcaactcgataataatgaaggtaagtcaccttatgcttccaacgtgcagatttaccgttaactccgatgagatcatccatatttggcactccaattccatttgcctcacaaaagttttttacttggttgaaaagtagtgcccaaccattatccctcatgtcttagtagtcgtgctttcacatccacaatcagacccatagcttcaacaatgttttgatctctattttgcaaaagcaagtgatggctcacttgtgatacttccgtcccaaaataaaaacatcatttttaacctatcccacacgtaccaatacaaaatcagaaagactcgaatgccctctattttagcaaattccaatgcaattacaacattttaataaattcatatgcaattatcccccaccataataaataccaatgcatttatgtactaatttcgcaaactgtaatacaatgatttttcttcaaatataaagtctcttctgaaacaaataaaatggttaaaaaaaatataaggatccaatcaaaagctacacgtagtacaaaggacgagaaagtgcttgagctgcagtcacatccacgttatttattgttttgctaattacaacatgaatttcaataaagcaacgaaaccacagcgggcatgggctagcctagtaataagagcatgtccataagatgggatccgcaatattgtgttctttttgtctataatagatgctacaatatgtatggtttcttctcgaccttaaggtggagcccactaaaaaaaactctattcacctacaatttcaaaagctgctatatatattgcaaatgcataaaatacttttttatttcttatggtctaactttaagctcaaggttacccttagcaatattctcttcttagctactttcccaatgatagagataaaacaaatatattactttatccgttaaggttattttacatgcaacattgtggatgtgctaagtaataacaaatgattcgatgtagaacagatgtgcacacttatggccacgcacgaacttctcatcgcaattatagcgccattattaattaattatcaaaccaaaaaaaattaattatagcatcaaacttatggttaggaccttatacgtcgtcgcagcctcaaacttaacctcttcctcaggagggagaggtggttcactcggtttgccccatgaaataaagaaacattgcatcgccgtcaactacagtagtgcacatgcttttcatattttataatttgaaccatcgaaagcgtgtggttttagtgatgtagcaaagccaactaccaataaaggcccatgaaatttttggattgttggaaatttggtcataattcagcatattttaatccaaaatattaagacaataaacatagcatttgcaatatgagttgatcagtgatagtgctagttgtatacaatatgagcatacataaggtaaaataagcatcaacatttacagagtaacacaatgatgccattacgaagaatattaacaaacaaacatctaacggaatatggagaatagaaatataccccgagaacgtcccaccactggattttgaggcagtattgcctccgttgatgtcgttcacctccttgtctccaatctctgttgacatgttagcgaaggcgtcgatgctgcagcagcagtagtcgcgaagaacaggagcagtcgcacttaaagtgctccccaaaaacatgatcgcttgcctacccatgcaggttctcaagcggacggagtttcggaggcacctgctcgtccccgtacacctatgcgtgccggtgaacggaaaaagggaaggattctgtagcacaggaacagagggaggaacttcggaagtgtaagagacgttgggaagaacttctgttcatccttctggtcgctgcagagtatatatatgcgagcgcgagagtaatgttcgggatcatcaaccgatgatggttttatgggtggtgcatggcgtacaaatccatacgccgtgatgggggttcaaaagttgagatagagtggaggataaatgagcttatgtacgacaaataaatatgccgaacaaatttagggttttaagcgacagccacactcgaggatttttgtgtagaacgaaagtataaaaggagggaacacgagtcaaaaagatgaagcgggttttaattcattcgcaaggttccaagggttcggggaatgaaacgacattgcgacaaaaggaaaggattttgggatttcgattcgctttgcatcgaagcatttagcaaaaagggaagacgtcgattggaggacatcctttaggcggaacgatttaattgaggtaatccaacgattcaaggaagggacggggtattacaattgtctaggagagttgagaggacagagaaaggatttcgctctgtgaggcgattctgaaagaactactgggttcgagtatttcctgatattcgaacaattggttcgggaggggttcaattgagagggaggagtatcgaactgcggaattcgaatccgaaggaattatgacaagagttgagattcacaaggatggattaaccgagatctttggcacaaatcccttttggccaccaatttggtttgaaacaatccgtgtgttagaagtataatatgttagttagagataagagtcaaatacagatatagagataagatatatcctagagatagaatcctagagataagatagagtcctagatatagaatcctaaagataaatctacatttacttgtattatactctaagtatctatccctatgtactcctatatataccccatgagagagtcgatataatatatcagaaaacattagaatacaataaattagatttttccacatggtatcagagctctagagaccccgtcgctctattagtcttccgctcacgctgccctggggagatgacatctttttagtctccctggggcgcgcatccatcaaccaccgaaaaaaatttcatagattaagtaatgattagtattagattagatccttcgttagctagccacataaaagccatgatcctcgtgagcagaagcagcaagccagcaaccactacgcatgcatgcatttgcaatggtcggcggctggcggtcgccgagatcaacttcttccgccgcaacactcgtgtcttcgaacctacaccgacagtactgatcatcatcagctgtacaactgcgcaattgtcttcgccgacacaacatcgccgatggtcttcatcaacaagggaacacgccgccgccgctcgtccacaaggatggacatcccgcgtcctctaatagattaatctgcaagacgctttatcgacgacatcgaccgcgccctctacgacgacaacgaccgcgacaccgacgacggcatcgatcacgtcatctacgacgacaacgactacatcaatccggcatcaccattgtgatgaccgctacatggcgcgaaaggaccaaccgaagtggtggcctcatcgccaacgacgtcctctgacatatgcaagacgtcttcaatggcatcctctgacatctacaagatgcaagatgctaacaattgcagtttcgtctttacaccatggcgtaaatattttttctttcgccttcggctatttgcggctacatcaactaccatgattaccatgaccacgactactacatgatcggctacatcgacgaacgtctacaacgagaatcatctacagaaacttcagtcaaagcgtccgtgtcatcgctattgtccatgacacttccgctatgactgcgggagggaatagagaagagtcaagggacgacacagaaggggacgcaggcaccaggtggaggaccgtccatcagagatgcaatcgatgatggtgattcgaaggaggtgaagaaatagaagattttaaatccagtcgcaatcgttcgcttcgctcccgttacgactgagggggaatgttagaagtataatatgttagttagagataagagtcaaatacagatatagagataagattagccggcaaaaaggggcagctctgcggtggtgacaaattccacggtccagtgacggggtgaccagaatgaagctttggagagctgttttcgtggtgaggggttgtttcctcccgctttcctcatcacttggatcagggaggagtgtcgtctctagcttccagacgcgccgcggtgagacaacagcggcggcggcgctccggcgtttcctggccaaattggatggggtgatacggaccaggcggggctaggacggctcgggcgcggtggctcactgcttgagggccgggttctgtaggacggacggtcgagggcgatgtcacgtgtaaacatagtggcgcggcaacgggtggccgagcacgcggcatgatggtgcagctaccacgcacgacgtctaggcagtcagcacaatccttggtgccaagcactgggcttgctatggttttactatgggaagtccacggcgagaggactggccccaagttcccgcggaggcagcggaggcggcttggcgtgaagccgggctgatgcatgcggctggggcgtgcgagcgcagcgcacatgccaatttgacagcgccataagcgtagcggctgcgtcaacacaggaatagcggcacgtgggagaggagatggctggtgactcgttttctcaccgcgacagacgggaagcggcaaaccgaggttggtgatggaggccgagcggcgggccgcgggcggcaatgcggcatggttcggaccttatacaattaccggacacaaattaattatcagccaaaaggaagagaaattaattgtcaattatttttaaactggagaaagtagcatttgacgtcacatttatttatagaagctatcttcgtcgtcaggcgaccgagcaatcactatatatattcatttgaaactttccagctcgtcgcgcgagtgttcacggctgtggcgtctttgtgcacactcgctcgaactcgcggttcgtcctgggctcccggcggcaacagggcgatgcgttcgccaagcaggccaagggagaagactctagcctagctgggcctggtgaaaaggaaagaggaatgtgacctctgatgggctgggttggacctaacagatggtgggggaaagaacgaataagtctacttataatccctcatatctacacgagtttaattcatatccctaaaccaaatcttcaccaccaacttgaaaaaaccgttcaagtgacatcccttagtaggctcataccaagtatacatatacgtatcataataggacactccagattatgggtactagtcaccaacccgtgcgttgaacgggctaatattattgcacatccaaatctgcttgtttaatgtagaaacttcagtggagtgcccaattagtacaacaaaattaatgtaaatatgtattaacttaaactttagaattccaaattcagaagtactatttatgctcacattgaactctccatttgttatcgttattaacttaaatcgaaatattataatttaatataccgaaataccttagtgtgcagccttagttatacaaattattgctttaataatatcaagatatgaacaaattttccttagtctagtttagaatttgagaactaatatacccgatataacattagtttgcaggctcaactattatattttcataatttaacaacatatcagaattcgtatttttcccctttattcaattcaaagatttagaatttttatagcaagatattgtagattgttgtcttgatcgtagattatcataatctaataattccacaaattgtcttaataaatatcgtgtgataattagtttgatctcaatcataaatttttcatggtttaaaaattcctacaaatatatagttgaatttggtttgtacacagagtcatagttttcccatgacttgcatcatgttgtattttcacttttgcgtcatgttagtggccttaaatcctgtagacctaattaattaatattctctagggttagagttaatcatgggataaaaaaaattaaaaatagatatagtttaagataagcacgtcaagaaaatagaccaacggtataccactgtgcctcacgttaaattaaaaaagaagtctttttctcaatacattctactgctacaaatatgatgctcagatttttatgattagcttgtgagttcaaagcaagtgcctaatagattgaggatgtggtgcttacaatcgaacttcttaactgcaattagtcaaactgacagaaaacttttatgaattaattactgatatgcagtgaccacggatggacttatttggggcaagcaaactttgtaaatcaacatctcaatacataaaagttataatatgatcatataaggtaaataccaaaaattgttggcctgcttaccgggtcactgcatggatgagcttggctgcacgtcttccgtcgtgtcgcgatgcgatgatcggccttgcgagcagaacgtccaggcgggatgaaagaagtccgctcgtcaccatctccgggcggccatgccagcgagcggaactggagtgcaaagaaggaagtcctcacgtttacgagcaaacatacgtaataagggatgagatcgatacattaacatgtgcaaatctaaggttggatctaatctagatatgattggactttactgagcccacggtacataatatacggttagaatgctaatcgatggctatatatttctagttaacgtgagggctcgtagaaagtgtccaattagtataggtaggtatagatgtgtatagatgtgcaaatctaacgttggttctaatctagatgtgattgggctttacagagcccacggtacataatatacggtcaggatgctttaatctattgaatcgatggctatatatttatagttaacttgaggactcgtagaaagtattcaattagtataggtatagatagatagatagatagatagatagatagatagatagatagatagatagatagattatgacaccgttttacttgttgggaaagcagttaggcaatacccagcggtccatcctaatcgaacgcataccgtgcaagctgaccaatcctggtggcggtaaaaatattctgcacgctttgttgatggtttgaaacaaataactcaactcggaaaaaatattatgcaaaatttacaattgtttccctccaaaataacctaactttttgcgaatttgggtccacaaaacgtgtttgccctaaaaatattgaacaatattaaagggcaaagagtaaaatgtgtcgacattacgtgggcggcgtgttgtttgtctgatctctgatgacgaatagatatccgagctgaataaaaatgtcaccatagtatagaactccccataacttaagagttagtaggattgtcgacaaaagtaggaggccatgtccacaccgaagaagcacgttctcttccccttcacgagcaaaggccacatcgctggcttcctctccctcgctagccgcctccaccgcatcctcccgcacgccaccatcacgctcgtctccaccccgcgcaacgtcgccgctctccgcgccgccgccgccgcgccgttcctcgacttccacgcgctccgcttcgacccggcggaacacggccttccgcccggcggcgagtcccaggacgagatcttcccgccgctgctcatccccctctacgaggcgttcgagacgctccagccagccttcgacgacttcgtcgcgtcgaccgccgccgccgcagcgcgcgtcgtggtcatctccgacgtgttcgtcgcgtggacggtggaggttgcgcggcggcacgggtgcggccacgcgttctttgcctcgtgcggcgcgttcggcagcgccgtcacgcactccctcttcacccacctccctctgcgcccggaggagccgagcggacgtgtgtttctccctgagtaccccgaccgaccttgtcatccacaggtcgcaggtgcccaagtacatgctctaccagtacggcctgcccgctgccggtgcagcaaatgacggcagcggcggccgagcagacagacggttcttggaccggcagctagctcacggcaacaacaccgacgcggtgctggtcaatgccgtggcggagccggagccggccgggctcgccatgctgcggcgcacgctcagagtcctccccgtctggccaatcgggccgctctcgcgcgaccgccgcgacgcagccaccgagcccaccgacgacaccgtgctgcgctggatggacacgcagccgccgggatccgtgctgtacatctcgttcggcaccaacagcatgatacgacccgagcacatgctggagctcgccgcggcgctggagtcaagcgggcggtgcttcctctggaagatcaagccaccagagggcgatgtggccggcctcaacggcggcgcgacgacgccgtcgtcctacaatagatggttggcggaagggtttgaagagagggtgacggcgagcaagagaggcctgctggtcaggcggtgagcgccgcaggtgaggatctggcgcacccctcgacggccgcgttcttgagccactgcgggtggagctcggtgctggagagcatggcgcacggcgtgcctgtcatcgggtggctgctgacggcggagcagttccacaatgtgatggtgctcgagggtctcggggtgtgcgtggaggtggcgagggggaacacggacgagacggtcgtggagaggaggcgggtggcggaggtggtgaagatggtgatgggcgagacggcaaaggcggacgacatgaggcgccgggtgcaggaggtgcggacgatgatggtggatgcctggaaggaggagggagggtcttcctttgaggcgtctcaagcgttcttggaagcaatgaagctgaaatgaagtatgccattgtattgctgtaatcatgatggacttgttttatcttttttttcttccatgttattgtgttattatgtttcactcgattttcaataatgcaattcttatctacacatacatgtaaacattcataataatgtgattcttatctggacgtacatggaaacaatcatgtatgtaaacatttatttaacaaactagcactaattgtgccaatttcattgaatatagtagtaggaaaaaaagtatttacatgggtgcggaaaatagataaggttatatacaaatggaaactacatgaacatcctctttgcatctaccagagacaaggttcttgcttcctagtactttattttcacaaggagcaccatcagtgggagctcagtgtatcacaaggactctctttttttcctggatattgcatagaactttggttccaactcctttggttgtagcactatccccaatcttaactcgcatggcagccatgaacaggagtttatctatttcatcgcatagggtttccaaaccgatccacgctttcccgctgatttccattcttgccgaagccatatgaaacgtagggctcttgtgaatctctccagttgcaggaaccctaaacctccatttgaagttggcgagcaagttcttgctcagttcatcttgcatttcctgccggtgattcctgcccagaggaagcatttcctctgcttatctatcacctacagcctatagggaatctttttcctcttttaatatgctatgaggtgagaattgatttgactataagtccgttcttccagccatcccaggtccttcccttcccaacccaccatccccccttccccgatttgtcgaatagtggttgtaggtctgcttttctcaatttacccagcattaaaggtaagcccgggtatttcatcggaaaggacattctggcaatgtttgtgccctcaaggatgttttccaaatctagatagccacatctgattgttgctacctacgattcttggcagttttgtgggcttgtatgtcttgtttcttgggcttaataaagacggttgtgttgtccgcatagatagaaattcgtaggcgcaccgatctccccctcatcttacttatcatcttgggtagtaacttttgaaacaggttgattgccataatgaagaggaggggagagtgggggtctccttgtctaaggccgcaaccatgtcgcacctctcttctgggattccattaaggagtatcttgaagcaggaggttaattatgaggaagcctactatctagtctgtccaacactgcaagaagcccatttcctgcaaaagtgtcgtgaagacgtagtcccaacagactaagtcaaatgcttttgaaatatctagcttgaagagcatagggcacttgttttgatgatatctccaggccatattctgacatacataaagttgtcttggatgcttcgccctctaattaatgcactctgatttaccgagataaggaaatgcatgagaggttgtagaagtaaggcttgaaggttaaagaaaaccttggcgaaggtgtggatcagatttattggtcaagctatagaccgttattttgtctaccccatcttttttaggggatgatgatgatgtcatctaagttgaggaggttgaagtgtgcacatcaaatgttgtagagcgagttgaaagccactattatgtcaagtttgataatgccctagcataccttgtagaagttgccagtgaagttgtatgtcccaggcgctttgtcaatcgacaactattgaattgctttatgaatctcctccgtgaaaggttcagccaaggtgcttaggtctattagtgtaactcccaaggcttgccagttaagctcccactctctcggtgcatgacttcccataattaccgagaacggtccatgatcagattttaattccttttcctcgtgccactgtcaatccattgtttcctacaagacctaggatgcagttttttcttctaggagcatttgcttttagatggaaacacttagtgttcacatccccctcgcgaatggatgttattcgcgacacttgtcttttccttgctctttcaatatctgcttgccgcaacaattcatgctttagggccacgcgcatgtaccctaaactttgttttgggggaaatctgtcatattgttttatacacgatttcagaaaattcaaaacattagatccacccacttaattccatatatccggggcatggtataggtaatataactactagaagatctagttctggaccatgttagcttattgagatttagatgcatgtgggccagacttagggctagcactaatttgcatgtcaaaatcactcagtattggctggtcgacctaacattgttaaagaaatactgcttagttttagctgattcgcagtgaagtgaacaatgaaacgctggttaaggcatgaacaatggtatggtcagtgatataagtgtctggcagaagatgccatgtagaattttatagggttaatttgacccgttagatttatcttcttcctccatcctcccctattctctttttttcccatctgtccacttcttcttagcctcctccacacccatggcccgcgggggaggaaggccggccaactgcatggaaattggcctgtcgtcgcagcgggagcagctcgtgttgaccaacaactttgtcactcctgtgaccaagtatggactcctatgtagtctccctcttgtggtgccagtttgttgctcttgaggttgctcgcgagatctccttatgcatgctagtcttcgaattaatcggatgcgcgattctctgttggcgttggtggtgtagtagcatagcatcttcgtctatgcgttttgtgcagagagatggatgtggaggaggctgagaagtggttgagagagatgagaaaaaagataagaggggaggatgaaggaagaagatgaatctgatgggtggtttccacgtgcagatgcaggagaagatggaaaacatgatgttgttggcatggttccaattttgtaatatttgagtagcagagctacgtatagacgaattataatgacatttatctgaatagtcacatttgcaatggcacgaatcaaattaacccaatttataaggctaagttcttttgttgaggttcccaacacatcttcattgtattccacacacacgcttgtcaaattgctaaacgatgtgtttttttcaatttttttctacacggaagttgctttaaaaaaaatcatattattctatttttaaaagatgttaattagctaatacttaattaattatgtgccaatgagtcattttattttaagtgcgcgagagattagttcccaacacgaagtgccgaacacaatctaagatatgaagtgaagaaagatctgtatagagaatattgtcttccgtggattaactaacggtataatagacagtttaataccatccatattccatacatactaataccaataatgtacttgcctataggatcaaatcgacaagtattcaaatacatataaaatagccaaacatttgacatgttttgtatgtcttgtctatataatatctagatacgacgtgaaagtaatatatagacggtagccatctaaactgctattcacggtttcagatttatgtgtttaaatttgtgcacttcatagttcatccgggaatttaccgagctttgtaggcttgaccctatgacttatgactataatttcagctaggaacatgtccacaggcggatacacattcagttgtactgtgttgtgtgtgctttcgagcacacatattttttattttttatgttgtgttgtgctataaaatgtctcatccattcaaaatctattatattttgggactctcatgcgtctcaaatcctttatattttgacggagggagtttgtcattttcccttaaaaagcttcgatcgtttaacttgcatctatgtttaagtaggctcaaggatagaatcacttacttattagtagtaactaacaaactaaccatggtaatttgcacagtaaaacaacaacggtcaagactaggatcgccgagaaagctaacatgcaagagcgagtagtgcagccttatatgagttctgaagattaggaaatttggactcgaccaagggaatgaaatcccccctccccccccccccccccaaccacttccccggccaagcaaacgtctcactaaatgttttcggaattttccacctttgtataatttcaatcaaaataagtatgaaatttcaaataaaaaactttcaaaattcacgaaatcttggtggtttccaaaagtgtgaaccctgctcataacgtaaggaaacgattaaaggaactttatatgggggagcacttcttaattttgtccgcacaaaaatgttgcacgattatttaacttcatcttcttacagtgtcctgtggagatggaaattggagaggcaaaaggaatactagagttaaagttttgatatgccttcttcttattgatctaaaggaaaagaaatacgagcataatttcttcttcagcccgatcgagtcacaattttcagcaccaatattcttcgctacttgcactctcttgtttgatttccacgtcacgaggcatttcctcagtggatctttttgagggtctcccaacaggacgcttggcagtgttaaaggataccgattttttggttttgcatgtagtcttctcaagcttgcccttgttttttttaacctcgcttgatgaatctgataaatcatcagaggagtcaccatcttcagctatgaaaaaggaaaaagatatattgtcagtcatcatcaaattcaggaggaaaatgcaacataccacaaatacatatggattatggcaaacaatccgtagtactcagaatttttgtttttcttagggaaccagtcctcacaaatattttaggtcgataactgttaggcatgcatattaaggctgaggggttgtttggttgcatgccacaagttgccacgtctaaagttagtcatgccacagttttttagctattgtttggttcatgacacaactgtggctagccacacattttctctatatggccccacatgtcatacactagtatttttttgctaactttggctaagttgtggctagcattttgctagccacacattttgtggcagccacaccttgcctaatatggggtttggcaaagttagtaagcgaccaaacatcccctgagttcggatgggggagatgggaacccaactcctgcgcacggaaaacggagcagtccattaacacgtgattaattaagtatcagctaattttttttcaaaaatggattaatttgatttttttaagcaactttcgcatagaaactttttgcaaaaaacacaccgtttagcagtttgaaaagcgtgcgcgtggaaaatgagagagaggggatgggaaaaggtgcatgctaacgcagcctaagtaaaaaagaaatccatctattcatgtagttgcacttagtatatgcatgctatcatcgactagggcttgtttatcttattgtcaaaattaaccttatctttttttttggggaaaattaaccttatcaaattttaacattgccagatttttataatgttggatgtatttggtttgatgtcttttggaattccgaattatccggaacactaagtttttttaccctatcaaaataagttagtattgtcagccaagaacccatggcctattggtttttttgcccttgtcctgtacagcttattatatggccaatagcatcagaagtatttgaaagtgcatagcgaccagatttagaaataatatgacctaaaatatatttttttagcagcatttggccacatgataattaatttgatctgcccaacatgatcgttcaattgaaatttgcaatgtaaaatcattgtctagcacatactgccaccatgagacataacctattcaattctactgtataatttactcaaattgacacctttcctctgttaattacctactttggatattaatgcgtgcagaattctcatatgtatcagaggatatagatatgacaaataaataaaaagctgtataaattcaaaatacgttgcacagacgattattattgatgttacaaatattaaattttaatgctaaatatcttttctattttcagaattgtagcggtttagattacatcagtttcatcttgctaattttttatttagaattttagaattatattaatataatactaaattaaaattccaaggtgattacatcgttatgctattacaaaattgttttatttattatggactatgaaataaatatggcaaggttatgatcctcaaattcaaaagttgctttatataattgatatcagaataaatgactacatttaaacatgagcaactcagaaaggataaactattatttacaaaacataatataaacaacaacaaatagcttatatgaactttctctgggtttatacattgatgatttaagtctggatgatcccatacgatgtcttatatgaactttgatagtaaaaacatgaagcaatcaatgatagaatcaccagcgcatagaaaccaatgagcagcatataagaagagtaacttacacttatatgaactttcctcatcactgagtgacttttctgtaagcgatgagtttttggatttcaatgatcttctggatttccggttagtcctagctgcaaagtctagtcttttcttcagactttcatgctgtcatggataaaatcaacaaattagggtatgaaccctctacattaaacttagctttctcaccaaatgttgcatgtaataagtgctatagagcaatttatccatggaacatccaatcagattagattagtattatttttcattcattttttttagacacaaaattaattggaactagaccttaggtccgtaattcatgcgttaccataacagaggatgttgaattacaaaatcagtacatgccattagatttttaaataagtaaattataatatagcatatatgtttgagcttcaacaaataaaggcatatatataagctatcactagtgcaaaataaccgtggagttacatatatagcttattcatggagtggcatttttacagctataggatgaaaccagtatcatttgagcaattagagaaaaaaaatgtggtatattgacaattggccaagactgtagtagcatatacgagcaattagcctattcacgcattgaagggccaaagcccaagttgaaggtataacatgccctttcgttgtgttcatgcccagcgaatcaacaaaggatttagtctattcagtaatcctcaatctagtttacttatgcacaaaatttcctagtcgactaatttttctgaagaaagtaataacaccgaaatagatattgctgttcacatacatctatttttttttaaaaaaatgcaactataattttagttgtctttcttaatgtcctaagttaacttcgtaaatgctcaactaagcccaattttattataatagtagatgtacctcatatgctaccatacaaagcccgtaaactatgcatactccattttctttatatatcttatagaacatacattaaaattgttgtttcgttttgaaaaggaacctaaacttgacggatgaaagattttgaggaagagttaccagatctgcggacttctcaaaagagtagaggtcatgaacacttgtcctctgaataaatgcgcgtttaggtacttttccagtttgaacatagagcattgcagatttccttgtgcggaatgaataattattaacaggatccgtgaaatactgcacattcagcaagataattaaaaaactgaagtccatttgtaagtgaagaaaaatgattaagttatactccactacatatatataccgggtcttttctaattactccagtctttgtctttctaaatactacttccttcacccatccttctggcagtgaatgtggattaaattccacatttgcaagaatctaaaaacaagttcaatcattagtttcattcagaaaaatctatatattaatcattaaattctacaaattggtaaaataattaatagataagtgattagggcagatgttgcagcaagaagcacacgttgtctttggttcttgtgtcacattctccatttgtatcaaatccagtaatctcggacttattaatatatagcagtacatcctctttagaaaacagtcgaactccagctggtggataaacataaaactgcaaattgggcataattaaaggtgatcagaaaattttcactaacacgagaaaactattatattgtagaggaccttatattgtactcaaatgtaagatgatgtgtttatgatggaaaatatatttaaacccttgaagatatacaactaattatttcaacaatagttttctaaaagcgtcatcatagtttccagtcaatagaagcatcagcaattatgtgtacaggccaataatgcaaatggactgttacattttggcaatggcttttcagatttgccgttatattttctatactagtgaaacacccatgtgttgcaagggaattaaaattaatcactttgttactttataaaaagttaattgagaaaaatcatatttttatcaaaattcaatgtaatggatgttgctccatatgcctcatcgtttgatgtagagtggtagatgatggattcactaatttgaatttcaagtataagtgggtaggtgatggtggcgaatttaccaccactacagttgaggtcttctagtatagacataatttgtattaacgagggtacatgtccccctattttatagtacattcaaatgatccaccatgtcaagattttttactgtcacaccaaagacaagaataatacacagttggagagctcatttctgacctaattaatactacctactccctttctatcccaaaaaaaaaatctaattctaaggaagtatctgaaaatatataccttatccaaatacatccttaggatttgattttgttttttcgatggaggaagtgaagatggaaaatgataggtgggcctctatgggattttttttcccagccctggccagatataaaaaagtaagcgctatgtagttcaaaaccagttgagtttatatcaaggaataaaaaaccggtttacaaagagctgaggcatggttttgaagttatggagtgcttttaaaagtttacaggcgtaaaatgatgtttttcctttataatatgtcaagcttagatccttgttgaattccctatctcgcttctagcttattggattggcatcctagcactgtcatgaagaataatctaagatctgatgatgaatcactgcatttcaaactactaatgggcatagaacaattagaatacaactatattacaggacaaaataaaaggtaccttatacatcttgttcatgttctttccaccagctctaacctcgattatccagccttttggaagccattcatgtgtcatctgcatatatgtcatggtgggactcacatataccgaattattctatagacaaccaaaatcatgaatagcatattcatatatatatatatatatatatatatatatagaatcactcacaataagctggttatctgcagcacagttctttgattccaggaatcgctcatccatcccagagaaaaggtactgaagcacctctgacttcatggtgaaagtgagtcctgatataggagatgtgtagtactgcacacaaagatatttttgactaaatatcacaaatctcagggacgaaaataaagaatttatatttacagacaaaacttccacacacacatatatatcatccgtaaatctcttatgcatagttatatactatgaactttctagtaacaagatgcagtaaactcgcttttatcatacccggtagattgtgccatcgtcaccttggtagacctccattatccaaccatctggaagccatcctgggcgttcctcctcctcctccaaatcctctacatcttgctgaatctctttcttctcgtcatctgatatcactatcgatgttgatccggccacgcctaaacccttccaaacgcttggaccggccatgcctaatcctctccaaactctttctcctcccttcaccccctctctccctttctctccaacccacagagttgcttgtatataagaacggcaggatgggttgggcaacagatttagggtgctttatatatatgcagcgtacagaaaaatggctgccggccggcattaaatttgcacagctgcacgccagcaccttggaggatgtcatgtttacacctaaatatatggggtagtccagaaacagaaactgttcttttaattcgacaccttgcaaaattgtccatatcaacctaccataaagtgagtaaaattgcagcagtgcatattagtgataagtataacacttatcctgacttcgagttctagtcggcatcttcggaatggttacttactcagttctccgtaatggcattttctgaactgctaaacaatgaattctatgcaaaaattttatatattaattaatttttagagacagtttcataatagaatctcctgcactcaaaattcattgtttaaaatagacgtgagaacttataataaattttagtttttaacctatctcaaataaaaaaaatcagctagatctcttctgtgggcaataattttcatacaagtctgttctcatccaattccatataaaaagttttatatgcagaagttccataaaaatcaaataaaactattttttaattttgtaataatcaatactcgattaatcataaacaaatagctttgtctcgttcgcatgtcaaaaatatccaatcccaaatactggtttttcttatgtgcattgcatcctagttgccacaatcatgcatatgaattcacttagagcttaatggaaactcataaattgaaatctaacaggaactagtggcggacacacgatttcgacaatggaggtacgaagttacagagtacggactacgtagataatacaaaggaaactagatcgacgataaaaatgaactcaaatcactaataagcactcaatccaagcagcagacatgcatatatttggcaatgtatatcttaatcccaatacgcaacatgtagtgaataatttgtagtgaacaataaacaaatgtataatagaaaacacaactaaccattgcttcgttggaagtggcaccggcgatagatgtggcgacgacagggatgttgggctagggtcatgggaggcggcgagtggagctagtgtgccgactagaggagctaagtcgccatcgtgctgtggatctggagcggcatgcaagcgtgtcgtctcctgcccccgacgacttgttcgaccgccgccgccgctcatggcattgctcccgagtcccgactcctaaaccggtaagagaacaaataagaggggaggggaatagggtttagccggaaagggagatcgagatatgcgcacatgggcaagtgggccgccaattaggatggttggattgctattctccaaggcctataaatgattaatttggccgatataaattcatatagttatttatttgcaaaataatttgggaaacgactatacccccatgtccgcccctagcgggaaccccctcccctgccctatccaatcaattttaaaccgtagttttgcggcacaagatatttttgaggggcatttgaaacattgtaaaaattcgaatgacttatctagaagccagctagaaaacgttccacttttatggacaaagctaacccagtttaaatccatccaagttttctttttttattcaatgcccccttatctgtgttcacaatgcacaacacattccacagcctctctcactgaccagctggtccaaatgtccagggtggcctagctggatgctcaacacccttctcccacccacttgacatgtagtatgaattgtgaatgcagtgccttgcatattttgcatggagttattttattctataaacataatacacaagtatatctgtttccaacaaatctgcaccttaaatgctaaccggcaatgacagcacgcagccagatccgcacgatcgggtcaacctattgcgatcttgtccatgtgattttgggcctttccttttttacaaattgtttgatgggctctgagcctttcctttttttgcatattaatgtttgatgggcttcggacctttccttttttgcaaattatttgataggtttattgccatctggttttcctttattagcaaatctaccatattccttttccatagatttgatctggcctttcatttttattaggccttttttccagcctacatgtccaatatttctagaaatatagataaaaaaaattctatgataaactttatacgtataaattttgtatagaagactagtccggaaaagagtattctagcctaacacaagaggaaatgccatcgaccagggcagataaagcttgaaggttatgtcgttgagcgaggaatattctccaagaagatactgcggggaccagtccaaccacccctgcaaactggcgtcaggtccttcggaggaccacacaaatgtacaaccatacccataagatttctagctttagaggggtattttagtaatttcttatctacccttggaggtaggatcgtacatgtacctctgaaggctattaagccgttcccacgagatttgaaatatcaaaataccatacgacacacaggactttgctcttcgagctcatctcacttttatggtaggtgaggaaaatagtactttcccacctattcatgatttgtccgtgaccaagatcaggagagtttgcatgaagaatgacagatgtggtattttcagaacaaaaaagctatcacctgtggtgttaagcgaaataggaaaatttccgtggtattttttgaatttggcttctgaacggtgctatgaaccaaatttttctcaagacaagccgcccctagactcattaattaataagatgggagaaataattttacaaacttttatgctggctgcaccaaccaacagggggttaatttacactgatcatctctcctctgttaccttgacatacttgtttgaatggtgaaagcaaaatgtcataacacttgtacgaacactatttttacatacgggtgatacgcgaattgtacacgagtttagcgaatcgcatgtgatttagggtctacagaaatcagcaattacaaatgtggatttgcctctaccagagttggcatgtttcgaaacataacattagtgaatgaccatactataaagaaaatattttcagaaaatattgagctgaccatattagaaaatattgtaagtatcttacaaacttgagagaatctatttcataccattgagtttgtcacggttctacaatttaccatcgagtttatccacttctattatatgccatcaagtttgtaatttcttttacaattaaccattaccgttagttagtgtgccgtttgtgcttttgaaaagacaaaattgcccataacccatgcgacatgccctttgctcgttcttcacccgtgcagcaaactgtctccggctaggcggccctggcgttagcacgccaccaacttcgtgctcctcgacgtcatgctcgtttcgttcgccggcgagacgtggcgttccacgaagccagagaccccacgtacacgagcagggcgcaggtgcaacatgcatggcaggcggcagggtgactgaagaatgccaattcttcatttcttcgtgggctaacgcataacagcagtccggccggtactccggtaggcactaggcagtagccacccaagcccagcccccaaggctgtgggcatgcgtagcagccagcaagctagctgctctgcttctcagttcagggaatcagggttagttagctagtgaggtgctccgctccacctaagtctgtttaacatgttgttgcttttgttcttttatgtcaaaaaattcggtagcaacatattgtggattcatgcgaccaacaagaagcttagcagtggtggttagcagcagcaacgaaattgattcataactggtactgtagcagcagcagcgctactatggagtacttcctcgttctctcgaatcaaaagaggtgaacattcaataatctgttgtagaagaaatagtatgagagcatttgtgtcatttttgaaaatactaacttgacaaactgacagtgatggtaaatcatagaagaaagttgaaacatgatggcatatagtagaagtggacaaactcggtggtaaaatatagaaccataacaaactcaatggtatgaaatagattatactttgattgacctcaatcggagtgaaaacgaattttcagattttgaggattttcaaataataataataacattccacttgaagacttttaaagtttaatatattaattaatttttagagacagtttcttaatagaatctcatgcactcaacattcgttgtttaaaatagatgtgagaacttataagaaatttttagttcttaacctatcccaaataaaaaaatcagctagatctcttatgtgggcaataattttcatacaagtctgttctcatccaattccatataaaagttttatatgtagaagttccttaaaaatcaaataaatctattttttaagtttgtaaaaattaaaactcgattaatcatacacaaatagctcatctcgtttcgcatgtcaaaaaaatccaatcccaagtactggtttttcttatgtgcattgcatcctagttgccacaatcatgcatttgaattcacttagagcttaatggaaactcataaattgaaatctaacaggaactagtggcggacacacgattttgacaatgggggtacgaagttacagagtacggactacgtagataa

SEQ ID NO: 37715 - DNA, 3258 bp, Oryza sativa
tatttattgcaaaataatttggggaacaactgtacccccatgtccgcccctagcgggaaccccctccccagctctgtccaatcaattttaaaccgtagttttgcagcataagatattttgagaggcatttgaaacattctaaaaattccatgacttatctagaagccaaccggaaaatattccacttttatggacaaagctaacccagttcaaatccatccaagtttcctttttttattcaatgcccccttaagctctgttaatgcacaacacattccccggcctctctcactgaccagctggtccaaatgtccagggtggcctagttggaggcgtaacacctttctcccagccacttgccaagtagtgtgaagtgtgaatacggcgtcttgcatattttgcatggagttatttcattctataaacataatacacaagtatatctgtttccaacacatctgcaccttaaatgctaaccagcaatgacagcacgcagccaaatccgcacgatcgggtcaacctattgcgatgttgtccatgtgattttgggcctttccttttttgcaaattgtttgatgggctttgagcctttccttttttgcatattgtttgatgggcttcgggctttttcttttttgcaagttgtttgataggcttatggccatcttgttttcctttattaggagatctaccatctcccttttccatagatttgatctggtatctttcctttttattaggccattttttccagcccacatgtccaatatttctgaaaatatagataaaaaaattctatgataaactttacacatataaattttctatagaagaccagtctggaaaggagtattctagcttaccgcaagaggaaaataccatcaaccagggtggatgaagcctgaaggttatgtctgtcagggttacgggttaggcataccctctacccttcgatatacgttgcatatcgatatggcatatccacgcgcatgcggatatttcctgtttacagaaggaaagaatcctactcggacagaactgggtcgttgacgtatcgtatagggtctgatacctccaagttctacttggagacctccagatccgcgatataaaaaggacctcccggggagggctcaagacattaaatctcagagccaacacaaccaacgcagcctacgaagccggaatctgcgaggagccaagtcatcaagcgctagtcgaatcaacttgactacgatctcgtcggatccgacaagttccattgtcctctttgtaacctgtgttttccaccatataatcccatatcaactggattagggctattacctatcaacgggcctgaaccagtataattcttgtcttttaattgcttgatgtcgtactacgtagattcttgtaccaacgtaccctaataccctctatatccggtctacgggtatcacctgtcgacaatgtcatcgagcgagaaatattccccaagaagatactgcggggaccactccaaccactactgcaaactggcgtcaggtcctttggaggtccacacagttgtacaaccatacccataagatttctaactttagaggggtattttagtaatttctatataccattgaggtaggattgtacatgtacctccgaaggctatataagctgttcctgctagatttaagatatcaaaataccatacgacacacgggactttacccttcgagctcatctcacttttatggtaggcgaggaaaatagtactttcccgcctattcctgatttgtccatgagctaagatcacgacagtttgcatgaagaatgacagatgtggtattttcagaacaaaaatgatgtcacctgtggtgttacacgaaatagggtaattttcgtggtattttttgaatttggcttttgaatggtgctatgaaccaaatttttctcaagataaggccccccaatactcattaattaataagatgagagaaataattttacaaacttttatgctggctgcaccaaccaacatgggttatgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatggggtacccataatctccacagtagcccctgagaccttcacagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccaactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgttttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcatt

SEQ ID NO: 37716 - DNA, 14098 bp, Oryza sativa
  unsure (1)..(14098): unsure at all n locations
tagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagacgtcagtggtagtaaagatgccatcaatcaaatgtaataaagttgcataaccatggagacgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgatgaagtttcccatcaacgacagcagagtaggctatgttgaagaggcttgacaagatgttgatgaagatgatgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaaacaccagtcgacggcggcataaccagtcggcgacggaagatgatgatgtccatcagtagtggtagcggtataaaccagacgtagaggcgagggcactagtcaacagcagacgagatgaccggcggtgaagaagataaggccaatcaacactggtagaatcatgcagccatggaagtgcagaaactagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggtggcataataggccagccgtgcaggcggaaacaccagtcggcggcggcgaaggcaagccagtcggtgaagacgtagatgcccaacaacggcggtcataataggccagccgtgcaggcgaggacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggaggaaacaccagtcggcggcggacgaggcggccggtcggtgaagacgtagacgcccaacaacggtggcataataggccagccgtacaggcggaaataccagtcggcggcggtcgaggcggccagtcggtgaagatgtagacgcccaacaatggcggcataataagtcagccgtgcaggcggaaacaccagtcggcggtggcgaaggcaagccggtcggtgaagacgtaacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagatgcccaacaacggcggtcataataggccagccgtgcaggcgaggacaccagtcggctgcggcgaaggcaagccggtcggtgaagacgtagacgcccaacaacggcggcataaaggccagccgtgcaggcggaaacaccagtcggcggcggacgaggcggccggtcggtgaagacgtagtcgcccaacaacggtggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaacgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcacaagcaatcaagataaatattatgaaaattgtttaaaaaatacgatataacatctatagcccccgactcactattcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatagtgacaaaaacaccagtcggcgccagtggaaccaagccagtggtgaagtcgtagacgcccaacagcagcagcataataggctagccgtgtaggcagaaacaccagtcggcggcggcgaaggccagccggtcggcgaagacgtgaacgcccatgaacggtgatgtgaccaaccaaccgtataggcgaggacaccagtcggcgacgacggaggcaggccggcgatgaagtcgtagacgcccaacagcggcggcataataggccagccgtgtaggcggagacaccactcggcaagagtagtgccgcagcattacatgcaaacagcagaaaataccaagagattaatctgaaatttaaagatcaatctaataaacaacaataagttgaaagggaaaaaacccggcgaagtcggagattaaattgttgaactcgccgagattgatctccttgatcggactgactccgagacggagaaaattagtcattggtgttgcactgtgttgctaggactgatcaagcgatccatagctcgtcatgtataaagttatggatgtacatattgcccgtattctcggcagcagatggctgtttaattttgatcgatgtccggcaaacaaccacgtacagctcccgaatatatgcaaaacaagcgacaaagtttatcgttagcctgttattagcaagtagagagataatgactatatatggatcaatttgccctgtacgtatccagcaatattgaatgcatgtatggctggattaattaatccatgcatggcgattgaatcgatacgtcctgtacatctccagcgatctcgtctcgtgaactttcgtgcatgtcctgccagcccacgacttggattcgctacgagtggacggcttcgccttgcgtagctgcggcttaccatgcccaattgagcacgttgcgccagcatcaagcaatagagaataaaaagaagaatagcatcaagcagtgactagaattaatccaataaataacggattgggaagaaaaagctgatgacatcgaagattaaatctatcaagttcgccgagatcaatctccctgtcaggattggatcttggagcaacagtggtgccggtgattcctgagataagttccatcgcacttcttgatagataactcggcgttcccctacctggcgcgccaactgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatggggtacccataatctccacaggttaattttcactcatgctctctcctctgttaccttgacatacttgtttgaatggtgaaagcaaaatgccataacacttgtacgaacacttgtttttggttgcgtcagccgaagagcagcacacgccgcgccgccgagatgccgcgccctgcgcctataggtgccgctgtggtgtttttttccattttattttttttttcgtgtgtgaattgagggcaatttggtcatttttatgattataacggtgtgcaatagacggtaggttgacggcgatggtatttctgggagaaaaaggcttgtatgatggtatttcttgaaagttatctaggatcagggtgcttgtcgatggtattttatggattttctctcaaagttgtattaccatctcctatccaaggacatcactccaagcaaatacactcagattgcaggggttcccaactcctttacttcgtttttcgcactcacgcttttcaaactgctaaactgtgtgtttttttgtaaaaagttcttatacgaaagttgcttaaaaaatcttattaatctatttttgaaaaaaaaattagctcaaacttaattaatcacgcgttaagcgctatttcgttttgtgtcggaacacagcctaagatgcagatagtgggaatctaattggtgcaagtctagacaaactgggcaaactaacttttaggttctagtttatttttaactacagtttttcagattttgaaaaaaaaaactatttaagatatctttttattctataaaataggagtacgctgcagctaggccgtatacgaaattacgaacacaaacaggtagtacgaccttcaagggccaaggccacctcgccggcttcctcgccctcgcgcgcctcctccgccgcgacgccctcctgcccgacggcgacgtcgacgtcacgctcgtctgcaccccgcgcaacggcgccaccctccgcgcctccgacgacgacgacgacgacggcgcgtgctcttccgggatggccttccacgcgctatgccgttcgcgccggccgaccacggcgcggcctgccggacggctgcgagtcctccagcgacctcccgctccgggagttcatcacgctgctgttcgaggcgttcgagtcgctcgagcccgccttcgatggcttcctctccggcctggttgatcaggagggcaccaccgtctgcgtcgtcgccgacgggttcgtcgcatggacggtcggcgtggcgcggcggcgcgggtgcccgcgcacgcgttcctcgtgtcgtgcggcgcgctcggcacggccgtcctcgtcggagacaacgaccagcgaacacgacgccgtgctcagctggcttgacacgcagcggccggcgtcggtgctctacatatccttcggctcccagaactcgatacggctgcaccagacgacaaagagctcgcggcggcgctggagtccagcggccgtccgttcatctgggccatccgcccgccggtggggttcgacatgtatcaatggccagttccgcgacagtggtgcgggagggtccgagcagcgggcgcgcgccacgtcgttcacgggtgggcgccgcgggtgagcatcctcgcgcacgcatgacgcatccactggcgcgttcctgagccactgtgggtggaactcggtgctggagagcctgacatgcggcgtgctggtggtcggctggccgttgtcggtggtggaaagggtgatgggggacacggcggaggcggcggcacgggtgagggaggtcaagaaggtgatggagatggcgtgggcggagggcgagggagatggccattccccatttcatatcataagttattttaatttttttctagtcaaatttctttaaatttgatcgtgtttacaaaaattttagtaacatatatcataccaaattagtttcattaattacaatattaaatattttgatagtatgtttgttttgtgttaaaaatgttactatacttatcttgccatcttagtcgaattgtcaaatgtttttgttaggatacttgtcgttgtcgaatgttaagtgcatccgttgcttcctttcaaagtttgtatcaaacgatcttaatatatttccttggagaaaaaagtttaaaatgaaaatagaagttgatattgaaagttcctgacctcaatcgaggaatactccttcctgtcactataaatactttgttgctctgtttttctttccctccccctgttctgctctgttttccattccctctcctgactcctgttctgctctgtttttttattattgttagatcgagtcattcgcatggctgaagattctgtggtcaaaagcgtgaagttgagctcgatctgtgcaatctgtttgcacgagagcacgtcgcacgggacgatctgttgcgtctgggaatgcattcacgcaaaggagtcatgcatgcagggccaacgtgcgcatgttcttccgtttccaggaataacaggagtagaagaatgaaaattatgctagatgtatgcagcacccaaatccttgtttttttgtgtattgtttccaattctaataagtggtattagagcaaggcgatcgaccaccctaggagcaatgtctgctacggtgagtcgtcatcatgggtgttgcaacgacttcggcggccgtgaggacattgtcgagcgtgcgatcgattgagaagagcttggactcgatcgtctaccccattctcacgcgacccaactacaccaaatggtccatggtaaagcacattaacttgcctccgtaggacttttgtggcaggtgtttgaggcaaggaccgatgaattccgcaatgactacaccgcgctcgttgccatcctccacgcggtcaccggagatgttgacgtcgctctcccttaagagctccatgagagaagcctaggaggtgattcgagcagtgtgcgtcgacattgagtgtctgaagaaggcaaatgctcaaaagcttgatcaaaactttgctgcgatcacctttaatgtgggaaggagcattgaggatttctccttacactcaccggtctcaccaatgagttgtgcatgcttggatatgacatcactgagaaggaggtggtgaagaagttgcaagtggtcccccagtaccttgaacaggtggcctctccatcaaaactcctctcaatcttgatctaagcataattgagcagcggaagaagttggagtctgcttctaccaggggcaacatcagcacccttcttcttatcgaagagaactgactcacatgcatttcaaagctccccaagcaggataaccaatggatggtggtcaactttggggcgcccaaccacatgtgaggaaaccagtccgcttcctccaaccttgatggctcactcatctagattgatgtggcacattcatcttcgactacaagactgagaagattgctccttcattggtgtctactacatccctagattgatgacaaacaccatgagtgtgggctacagggctagctcgacgagatcagatttgaggccctagtttgaggcggagtcatgcgtgtccgacgcagaaaggtatctccatgccaagattccaagcaccccgaaccagctatatatgctcgacctcaccattgcgcaacaggtgagccttctggaaggatgcccagaggtggtacacacactttagtcacctcaacttcccgatgtaatagaagctagccccagaaaggctttgaccaactctgcaacaggtgcctagctgacaagtagttagaatgttctcgaaacaaacatagaatagtgcaaaatgcatcctcaagttggtttgcggggacctttgcaaccaggccatgtctgtgatgcctagtggtaagaagttgtctctattgcttgtcaatgacttcagcaggttcatgcagattgagatcctcctgtcaaaggactatgtgctggtttcgatcaaacggatttgggcggcagcacaggcccaaaatggacacaatttgagctccctcttcactgagcatgggggagtttacatcggcaaactttacagagcactacactacaaccggagtttgatactaacccaacgcaccgtattcactgccaaaacggtgtgatagagcagtagaaccaatccattgttgcgtcatttgtagtatgctcaagaccaaggggctcctaggttatttctggggcagcaagaggattggaggaagaagaggaggcaagggtaatttcgtctggaatgacattatagcatagacacattaattgaaagtggtattttatcaaatcccttttaagtggcatttgcgtgaagcccacttctgaggatggcataatctcaagattctcatattgatcagcctgttaatacatcacttccatgatttcgtggggacttttccccaattaggccttgttcgtttaatcctcaccaatctcttcctgatggggattaaacggataaggctttacatggaaaacacacatactcacacacccgtgcaaacgcccataacatcgtttaggaaacatgtttctgctggccgagagcaagatcaaatgaagtaaatgagtaaggaccaaggaaagcaaacatctcttctccagcattgggtagttctcttgtaaccggcacgacctgcaagcattgtttgtgatatacttgttagataagaatagagaagatgggaaatcctcaattgccaattgagtgtgtggtaaatcctcaacttcagaactaaatttgattctcttacaggacaaataatctgttccaaaaatcagtaaagatgatatattattggtcaaaagagtatatagtttgagctacttggttattagaagcctatgaagaaacttcaacatgaataatccagtttcgtagtggagatcttttagggcttacatgggaagagtgaaatcccagcacatccacatggattgactggaatttcaggtctgccaagcaggtcctcaaggaatacaatcgaatataagaaatgccctttactatatccagtttataatgcatgaagcagaagtttttaataactgaagtaagtaactgcccttacattagtgggtttactgaatgaattttcgtctgacagatttttggatgtgagaatagtgattgttgatttccgcatattgaccaaagcttcaagaccagttgtggatactatgaggttcacagggttggacccaatgtttacaatctgcacaagaatatctgtaaatcagtatgaggttttaaacacattcttccgacagtagaaaccatatctgcgtgagattttattgaaatatgccaatgttcaagattgtggtccatatgtaaactgggccatttcagtaattatagaatcaaactactcaggccatgaagaaattggaaactattggttttaccttcactctcaagaagctactgttactggctttccaggttattgcagaagctgctaatgaattagaatacatggagttgattgtcactggatgcagcacagcaccactcgattcgcggaaaattgtctgcatccagtaactaggacttccatactgtttccatgagttgaagacgacagcagctgggttccacctgattggattaattcagatacagttatagtggaaggttaacaacacaagaaatgtagaaatcataaggccatcgatactgacgagagatcattatcattcatgaagagcggtgcatagctggccatctgaacaacatcactgcaaagaacaagtaaatagccatctcaatagtcaacagagtgatctttgcgatagtaatataatttataggataaattccttatatgccactggcaatagagaatataaccatgtggtgaagaaatttgtgtgtgcatgtggggaatagatcgatcacctattcttctccagtccagtgaggaaagcagcctcagccagtgaggcaagaagagttcctctacctacaccattacttgaaacagcatactcactgacaaaggcctgcactcagaccatattcagaaatatatttactgtcaaagtgtcaaggcatctataatgatgtaaatgagcaagagaactattgtaaataaacctgcactgaaatcatagtactgcaaaggcatctaggttgatgtaagcaataaagataaccaatgcaggttacaagcttctcaaaacctgttttttttttacttgtaatatttttgctttttttttttttgcattctaaactgtttggatataatgacaagatttaattgaacaaaaaaacttattgctgagggagtacagactataccgtaatagcttgtacacatgaaaatagcatagtacattatggtacaaattacttaggcttctcatattcctgactttcctttgttttcagagtaatagataaagaaaaagaaaacaaaaactaactaaatcaatccatctaataaagatccataaagatatgaaaacggacgcatacctttgtcccattccgaggcgtgctgtcaaatttgttcctcatagaaaacaaagtattagaatccccgtagacctgaaaagaacatatattatcatattttcagaaaatccaagaatattaacagcaataaataagagaacagattttgaacattaacaacaggaattacaagaatgttgtggtttacatggaagtcatatatgtcagcaggatggtcaagtggtttagatgaaccatcacagtttgagatgatttgaatgtctggataagcctctcttatagcacgatggaacttgaggtaattacctgttcaagagaattgaagaatacctacagtttaagtggactttgtgcagtgccacagaattatgatgacatagagctactcaaaatcaacaaaacaaacttgtttaaattaggagaacaagggcagaatgcagataaaaatagagtaagaataaattgcattgtatttttttatgaagatccatgtgagaaaattattgaattaattctacaaaaaaaaattcttgtattgatgttttttttgcaaaatatgcccaatcataaaaataggtgtttatattttgtgtttaaaaactacaggaaaaggttgagtaacttatctgcttataccaaaattatttatgtttcctttttcttgacaaagaatgagcttaatccttgtatacataaacataatcaacttgtagtgggaaatagatttaatccataagaaactaactgatatatttaccatggtaaaatttttttgtacagtcttcgtttccaattgtaacatatttgactggaaatggttcaggatgccccattgcaactctaagagagccccatgttgagttggtacttccccttgcaaattctaggctgtccagtatatcctggagaaaagacaataacaaaagatatgagcctcagttataacttatccaagtctggggaaaatatgggcaacgtgtggtgagataattagttgttactaacttttatccataaaaatgaacaaatttagaaaaaaaattgtaagtaatccattaataattttgggaaaaaaacaatctgaacttaacccaaggtgttgtatcaatttgtgcagtacatgtaaataaaccaaagaaccatcttaataatgtcccaatattgattatgatggataaacatctaccatcatttgagcagacccatcatatatataatagctgtctcagaaaggattgagcaacaaaatttctatttctaatccttgatatatgtacaggaaaagtgagaattgctacttccaatgtatttacaaatggaattcattcactgcatcaagatatgtctatgctggtataaaaatgaattgggagctcaaaacatgcctttacaaatggagcaatagccgtggtattaatctcctcattgtggctgaaacctgacatttaagaggcaaaattatttcaataaaggcagacggtagtggtgatcaaagatgcaataaacacaaaaataattaccattgttgaacacccagattggggcagcacccagatcctcagaaagcttagatgttcaattcaaaggaaaatatgattatggaataatcaagaaaatgtagagctgaaataatgccaattggtacctgaagaaactcataatatccaaggccatcatcagtccaataaccccagacatcaccaaagtgtccaggcctctcctcccacggaccaacagactcacgccacctgaatgcatttcttaaccactggccttcaacaaagcagcctcctggaatagttcccttcaatctagttaactgtccaaaatatgtctgatcaaatatgtgcaacgatggaaagaataattcacataccaggaaacctcatgaattgtggttttaaatccaaaagcattgatacaagttctttccggaaaccatgaccctgtacatacaaagaaatggaagttaaatatggaaataacctcatggcatacgtcataagcatgactactagaaagagatcaaactcaatggattaacaaacaaataaatacagacagaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37717 - DNA, 1531 bp, Oryza sativa
aagaggaataagaaagaaagggtagctagatcgatatgtttcttcttcaagagtgccactacacaaagacccaaaaagcttggaagaacaaggaagcaagcaacaacaaacctgttgaagatgatctacaggtttccctctcaatatgtgtgcaagatcagcaacttggaaaatctccctcctctccatagtcctatctatctatctatcagctgacctgttcatctgctccccttatataggagtagggagaggagtaggccagtcttaaagaaagggaggctctcatgtactctgaatcttatgacctaatatgtgtgaacagcaaccactaagtactggagataacctctttctctcccctctatatagccccccttctctctctctccacaaccctgaaacttctcattttccaagaaagtgtgactaattatcttcagaaacttcagaactgaatgtattgctttttttcccctcttctagcttttcatctcaagtagtaacacctcaaattaatcaaacacaagaaagagaaagaagacgcaaaaggtaaaaatctagcacagcaaaacgctcaaaagtctttggatttttcaagaaaataaaaggaaagcaggccaccccttgaaattaatttcttttcagctcaaattcctgacaaaagaaattctttacctggctgagtgacagtgccgatgaggatccgtacgctgcgccgttccggccgatcatcgacggcatatgcctcgccgggatcatcattatactcctatatctcaaaccctaattcttgcccttgcagctccttccatttccactcatgaacacgcgtatatgagtgtgtcccaaacccaaagaacacacaaagtgctagctctaaatatgtagggagatagaatgatagatagatagatatagatatatatatatatatcttgcttgccaagcaacgcaaacgcaagtagaaacagatctagcacacaagctagcccaacgaaccttgctgcagagaggagacagccagccagtgagatccaagacaagaactacatgcaaatatagaactcttatctctgctttgctgtctctcctacctgcacaaaagaagatgtttcaccgggtgcaaacaacaaactgcaaggttcagagggctagcgagagctagagatcacacggcaagagatcaaggtgagatcttctcgatcaggatcaggaggaggagaggaagaagaagaggagaagaaaaggggaacacaggtggaagagaatgtggagaggggggcgaaggagttattgccgcggagtgttgagagggtgcaatcgcatttatggagaaggcgtagtgtaattgctaggggagagaaagagatggaaggggagagagagagagagagagagagagagagactagtggtgcatggtttcaactttcaattccaatttttgtttttatattccctcaattgaggatatggagaaattagagtgtccttttttgacttattatttattaacacaatgtcaaatt

SEQ ID NO: 37718 - DNA, 674 bp, Oryza sativa
cccatgaattcagaaccccagagtccgcacatcctcaaatacaaagcacttccctagttagatgtaggttagacttcccgttcgagaaactttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaa

SEQ ID NO: 37719 - DNA, 921 bp, Oryza sativa
gtgcggcccaaagataagaacaaaagaaaacaggaaggcacacacgtatcgtcgtagtctacatatattttgttgactctcgatcgatactgatcagttactactaggttaatttatttgttttatatatagtacacacaaatacacaatcatagtattgtattttttgcaactttgtgattaattacatgcatgtataggaggaatgggtcaaaaagtatcctgtggaagaccagcttgctgctgtttcactatgcatgcaaactgatgcattttgactcgagtattttacttatatttttgggagtcgatcgatcagattttaaggagacaccatgcagggtgaagagatcgatgttttcactgctgtgccctgggtacgtactgttttcatgcctccacacgcctcatgcttgtttggtgtagtctttttcactctttctgcactggagtatatagcagcctttcttgctgagaaaaaaaaatttatgtgaaaaattactagcagaagaaacgtggcatgtactcgccatgtccacgaatataaatatgtttagggattttagcgtaaattaaggttacggtgaaattatttcaagatatcctcttaaagtatgggctcgccgatcccgattcgaaactcacccctcttaacaaaatttcaatacgagagccccttctctgatatccaacatttctttttatttcacgatgcccccggcctcccgagagttcactttatgccgtgtttagtttcaaaataattctttaaacttccaacttttctatcacatcaaaactttcctacacacctaaacttttaatttttccgtcacatcgtttcaatttcaaccaaacttccaattttaatgtgaactaaacacatccttaataagaaatatcatgcccagcgatgcaaac

SEQ ID NO: 37720 - DNA, 31646 bp, Oryza sativa
ctcctcgctggggtcatcctcctgccgccgctttgggtgcaagcgccgagcgccagctcgcgccttgaccgttcaatgccggttcccctctcccaaaccgacattgccgtccatttaagcccaagccctccccctccaaactccctcatttttcgcctccgcgccattgccgccctctgtttcgccgtcgccgatcgtcgttgcgcgtgtcggaggagctggcacgagcaaggacgcggaagaggactccggccgcaccctctccttcctcttccctggcccgaggccggagagtttactcccgcgccgtcggcctctcatcacagcgcccctcctcttctcggtgatgtctctctccgttcttcctcctcgctccatctccttcccctagctttcggtagtagcttgagtagccttcccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtggcctcgttgccgtttccctcttctcccgccgccggttgccgccgccgcaatccgccgccgtcgagcaacccccggcaaatccaagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctacctcccgccggcccgcgtggcggccacgtaggcgccacgtcggcgccagctcagcccagaccgggtcgggccgaccccggtcggtccctccgcgtgcgcgcattccaccgcaagccgtgaggctgcgcgtgggcccgccgcacctgcgtccgccgcggaccgcgcgcgtgcaccgcgttcctccctgcccgcgcgcgtgcgccgcgtgctccctccgcacggtgagccgagccgctgacaagcgggtcccacccggggccacgcgtggtgagcccggtccaccggactctctctcctccccccgcgcgcgcgcgcttgggccgtcttgggccggccggcccgttaagctcggccgagccgccccaaatctcttgggccgcaccctagccgcccgagaaaagtctatattccctccctcccttcttttctttttctttttcttttccaaaaaggatttaattaaatcctttttcctttagaccaaaaatccaataatcttagaaattcaatatcttcccaaccgtaactccgtttgactccgttcaacttccaaaattcatcaaatctcgagatctatctaatggcacgcttagaggtcattaatagggctttattttcgctgtttgttgagttgttccgtttcgcgtgtagtttcagagcccgaagacccgcagtgcgaggatttcgaggatcaagctccagatctcgagcaaggcaagccacctttgaacatcttgagcctataattgaaatttaattatattgcttgaaaaatattatgcattgataggaccgcacttaatcttttgccccatctgcaaggcagattggtggacctacctgacttgttgcatttgatccttccattgttaattgccataccatgtccccttgtaaccacccagttgcgcctcgatattcgtgcactcagtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgtaccggggaacgtaccgggtgtacggtttcccactctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttgaaaatgccttgtcatgaaagcttggaggtctcccgacgtggctgatccccacgggctgggtgatccgggttagtaatgtcgtgtgggtaaagtgtaccccctctgcagaggttaataaactgttcgaacagccgtgcccacggtcatgggcggatgtgaggtgattcctagcgtagttttgtttgactaccgcttgtgaaattgctgttgagaaaatgggttcgatgtttgaaaaatcagcagctgacgggatcagctaggcctgggtggccgtttgaaaagttgttggcccgggtggccgtttgaaaagttgttggcccttgaaaagctgttggccgggtgcaatcttgtttcaaatctaaagactgatacattgcacatactccgaccggacgagacgcactgtctcatccgtgtcgtttgagaagcactcatttagtcgtttttagaaaaaaaaaagggagttcaaataaaatcaattgcaaaaacaacagcctctccttgaagcctgcattaaacacttatttcccctggcttgctgagtacccacgtactcacccttgctctatataaataatccccccccagttgctgacgaagatgaagcggatcctgctgatgaggagttcttccaggagcaagccggctacgatgagttttagggtttcggcctagttcccaagtcgcgcctgtgatgattggtccaagtccgggcttccgctttccttttgtaatgcagttgtgagctcgggatctgtccgtagcccaacatgactgtactcctactctataataaagagacctctgttgctgtgatattctgtctccctgtgataccagcactgtttcctgggactggtatcgattaacaggttaatttggagcgtcacgggctagttccggtcgggactatttcggggcgtgacattcaccttcaccttcaatatcagttgagagttttgaatttgagttgaaaagtttgtaaaatttaagttgaatgttttgaattttgagatgaaagttttcaaattttatcaaatattttgaattttgaggtgaaagcttttaaatttgagctaaaagttttcaaacctgagttaagtttccaaatcttgacttgatttttttaaatttgaattgaaagtttcaaatctttagttgaaagttttcaagtccgagttgaaagttttcaaatccgacttgaacgttttcaaatcgagttgaaagtttttaaatccgagttgaaagttttcaagtttgaattgaaagttttcaaatctgagttgaaagtttttaaatttttacttaaaagtttccaaatctgagttaaaagtttctaaatcttgaattgaattttttcaaatattgactcctactcttagacgtgtgtggtagttaacggcaaaaaaagaagaagaaaaaaacaagaaagaaacacggcagttgtgcctaccgaaaaaaagaaaataaaaaagaaaaaagaagcgcgcagactcggtcgtaggaggacccgccacgtggcacgctcgcgacttggagaagtcgcgcatacgcgcgaattaggattcctgtaaacttatatatttgtattgttgacgttttaataggcaaggctgaacgttaagataggaaaaatctcaaagttaacttaaaactaacattcgaaatccttttttttttttgcgggcaacaagccaacaagactataaaatcagagtgccatagagtagtggccatagtgtaaaattaaagaactggtgtgcttaattagattactggttagcctctatgggcaattaagaaaaaatatgttgttttttctaagttattcattgtgtgattataatttaattctatatatatatatatatatatatatatatgatttaactaggtcatgctaagtatgtttccttaaagaataaatatgttgtttttttataagttattcattgtgtgattataatttaattcaagatatatatgatttaactaggtcaacatgaagctgttctatatattttctgactcaaattaggaacatcactgttccagtgggtgaccatatatatttattacgagaaaaagaaactaacctcttaatttaggatccagtatttgttcatgtaattaatttagtccacagatagatgttaacacatggtagcgtataagatagcacatattgatcccaaattagctgtccctgcctttcggattatttgatgttgacgagatacgacttctacaaatttaagataggattaattaattaccatcaattgtttcctggatatatatagcgtgactacatgagatggttccatattaagtggtacatgggagtatacacatcttgttcatatagcagggtcaaagtaattataacaggggtctccaaaaaataaagcttcttataacaaattaatatatagttataactgtgtaattacaaactgtctaaaattaatttcacattgtaaattatatggcagaaacattttttttttcaatttgcaacccaacagtacgtgctagctgtcccaaaaaaacaaggttgcttttcttgagctagcttagcactggctgtctctggctcatcatcagtggttcagtactatacaggaccccatattaatgaaataaataggcaacaggcaccccggccagaaaacatatttggactttagagagtgtcaaagttaacacaccagcaaagtcaatcgaacatgccaccatttatgaaacagaaaccataataataatgcatgatcaaacacataataatatacacctaccaaggtcaggaaaccattaatatttttccctttagcgtgttgtcacttatgatcttttaggtgtgttgccaacctggactcgtttgtctccttttgcatacggtttccgatccatcttacgtaggagtagtagccaaaattaaacatgtgcgtaaaaaaaaacttcaacttttgtacagaggctgcgtttagatctaaagtttgtttggatccaaacttcagtccttttccatcacatcaatatgtcatacacacgtaacttttcagtcacatcatctccaatttcaaccaaaatacaaactttgcgctgaactaaacacaaccagacatggatgaatgcttaattcggctgcttgtttcttttaacatatagtccgaccatcatatacatactggttattcgtgttctctgttctctgttctgtagtactagttaaaagttcaatagtttatgtgtacagtcttaagttaatttagtgttggcctaaactgcacgcgtaccataataattccaatatttctctgttgcatccttccaggtatcgagatgatgacggggctagtgatgacttgatcgatcccaggtttacttttgaacatatagattttacaggattctcatagaatcagtacattttattcgttaaaaggacacctgaaaattactgtttttgtttaaagggcgcgttgttcctttgttagtgatgcacgcagcacacgtatataccacaaatgttggaggagcgtggagctgatctcatgtcagcagagagatgcttcgattttcctctctttttgtcgctaccaatatactctaatcgtatgatctacggctgataaaccatgaaaatcatgaactagcaaccaataatttataaataaatcttttatatccacttattccgtcctaaaatataagaagttttggtaacatcatagtactacaaatctgtacaagctctttgtccaaattcgtattattaggatgtgtccaatccaattaaaactttttatatttgggatggatgaagtatattattagtgacttaaaaagcaattgctagaaaataaattactaacatagaaaaatatacaaagtttacataagattacaatttaaatataaattttagttaagactaatgaaccaacaatgagacgaatctatgcgaaaagaaggatgaaaatggagggagtacatgtagtagtactcctccagtagacagaagtgaacggatcggtcatcgatcgtcgatggtatggacggaacggtggatggatggttggagacgggagtacgtacgtaacgtacgtcgactccatccatgccagccattgccatgcccatgcgtcacacatgagatgagctggagatcgagctcatcagccgcgctttccatggcgtccctctctctctctccattgaatggtctctgagcaacaccgcgtgaggtggacaccaccaccactccagctccagcagagacgagagagaagatggaagagagaagggagggggccgcatttactacgttcatgcctccctcgcatcgccggcccaatgccgccacccaccgccgccgtgcaggcccaccccacgcgccgcggatgtgtctcacgcgcctgtggggcccacctgtcagggggtgacgacgacctggcaatatatgctcatatatcgaatcgatggatggatcgatcggcgcccttcatgccactgttttcgttctaagagatccgtcgtcgtcttctactagtagggcctgttaggtttacaaaactctcaaactatcggtagtgtcaaaacttaaatacgttctgttacgatagatttttggtaagataaaattgtatttggtataaaaaaccaaaattttttattagaatatagaaactaccaaattgaacattggcgatactaatgatttggctttaaaccaaaacaaccttgtctactatgtattcaagataacaagctattagtaggtcatgttttggctttaatcaaaaacagcctgtacttcccatcaactctctttttcgtcgcatctattggtaactgattatatatataatttttaaagagcccaaacaaaaccatggttacaattgtctgaattatgataccaatagactgaataaaaccaagtcgttccacttcatttcacctcaacgtatattcttgtaaagcaaacaagcgaacgacccatcatgtcgttcgtcgatcctaaatacatcatctgagcattaccgatagacggttaaaaataaatccccttctctaataggatttaagggatgaaaatattttcacctataagagagaatctaatttaaactcaaaaaaggtggaccacatatgaaacttccaaacaaaatcgctcttttcgtactcccgtgtgaaaactctccaggtgcgtgccaacttggcgattgggagcaaggctgtgtttagttcacatcaaaattgaaagtttggttgaaattggaacgatgtgatagaaaagttagaagtttgtgtgtgtaggaaaggtcgtgtttagtttcaaaataatttttcaaacttccaacttttccatcacatcaaaactttcctacacacacaaattttcaacttttccgtcacattgttctaatttcaaccaaacttctaattttggtgtgaactaaacatagcctttgatatgatgaaaaagttgaaagtaagaataaatttggaactaaacatggcacaagaggtgcttgcgacttgtggagagcagcatttaagaagaaaataaggactaaaattttaggattgggagtagtatacgataaattgtacacccgacggaacagctcccggactacgacacagctcccggactatgacagtccgtgtagtctgggagttggttccctgtaatttatcatatactactcccaaccctgataaggcttcgccgccaatgtcaccattgtcaatcaccaaaaaatgcccttaaaaattagccggcaaaaaaaaaagctcttcgtcacccaggctccacgagtccacggcaccggcgccgttggcttggctacagcactattctctttccgtgcaccagcaagcctgacagtggttcattaacatagagatcgatatataggaagatcacgtagaattacatgtacatgtctactgctcctatactagagtactactatagtagctggctatagggcgacatggtcaagttctgatccatatatggttgctgctgctgctgctgccttaatttgcctgccaatctcgtaacagatatgcaggtcaatcggcacggagcatgcatacgtgatgaactgatgactcggtcagtccatcgattgatcgatcacgattcactagcagccagtgcattgaccattattcactctcatttaatttcctcggtttttcatctgttgaatatgatcgatctgattgcgaggtgttgtggagtaattcattccccatatggagtatgtgtgtgcatttcgtcctcctcctgactcgctcaaagtgtagtagtaatagctatgcagttaaggattcaggagattggggcattgactggcttctgaaatggaggttgaagttgaacaatgagacttccagtgcgtaagacctgtaactgtaattcattaatacgagtaactggttagaagaggtcaaaacggccatctctcatgatcaatggctgaatgatgcctcactttctggactactatcataaatgcaaggaattgaattgaagtagaaactagaaagtgagtactggtattattacaagattgaacacttcaatttgttgtttagcaaatttgcacatccacaattgacaccaaggcaaattcatgtggtacagagtacttgaatactgtatcaaatgaacttttagcttagcatttgggaagccttacccttacgacgatggtcacctcaccagctcacctcaatctgccgctgcctgccgtgcaacaagaaccaagaaccaaccccgtcttcttccccatggagcacgacatgcatctgcatacatgcacagcaccctacactccaagtcagcaacgagctagtagtaccatctgcagaaaagctgctttttgggtggcaaattttgttggcgatacaatccaaagagctttgcggttgagcaggtgtggtagtggtggtactagaaccagtacaccacaccatctagaacctcagcccagccgaaagtgcttaccaatttgttgcaagatcagccagccagaaaaactactgcatgctgctcctctgcttctgcttcgatcccccatcatctcatctcgtggacggacgctgcctgccacgctccctgtcacaacattgcatcagtctcggggcatgcgttgcaagcaatggcccccatggccatgaggtcctcctgacccaagctgaagaactagacaagcgcacatttacattggcggggccgggtacagctacgccacgcccgtcgaaccggaggaggagggaggtctttgttttaggctttcttctaatcttccctgcagaacaaacaaaatgggaagaagagaaaaaaaaatagtatgagtgtgactttggtgtgtgtatttcagatattcatttatgaggagtcaactgctagctacccaactacgatgggttggtatcgccgtgtttagttccaaaatatttcttcaaacttctaaattttccatcatatcaaaattttcctacacacataaactttcaacttttccgtcacatcgttccaatttcaaccaaacttccaattttagcgtgaactaaacacagcatatgtctagtaggagtggttcttgacattcttgtgatcataattgggatagtagtatgtactccatcaaattgtcaagctgaagtgaaaggatgtggatgttacagtcagtttgtcacagtaaaaacaagagaaaattcagggatttttctctaaaaacaatggctgcaccctacctacctaactttggttcaggtcctaacatgggcgtatttccttttttttttaatgctagagctatcgcctccttttctgaaatgaaaaggggaaaaaattgaaattttaggtgagacgactttcaagtatacaataactaataaggtcttaggagccatcaaatctcattacgacggtttggataaaactcaacaagccatatgaaagctggaggccacatgcgcagatatggctgagctgtctataaccttataggactacctttgacaagaatcaggaaaccttctatactgaattcttttggtgtacctgttcacaaccaaatttggtaatttcggcatcgggaaagaagattagatcgaagcaaagtcggaggcggagatcgagttcggaaacagagcaggaatcagctggagtccagatcggctacgattaggatcagctgggtctgagtcaggctaggcaagccgatgcaaccgattccgacaatgcgacttgatgtatgacatcgggttgaattgaggtgcttcaaggtgattgccgcacatggatagagtcctgagaaggcaattgtgtctattaattagagtgttttatgtaatttccttagagatatgcttgagcaaaagtctgccgtaaagacttatggtatcttagagtttgttagagatagttgtcatgtccgttatggacatatcttgtaattttcgggtataaatagacccgagccctatgtaacttttaacacacacgctcaatacaatctcggcgcatcgccacctttttgctttaattttatttcaacgagttcttgctttcgggttgagctgcatcggtttcgatcttcaacaagaggtaaaacttgttatgatgaattatgttctcgagattagtgcttccatctttatgatactctaatcttgtctatgtaattcgtcaagttattatatatcttacataatcttcgacaatatcgtcatctaacctacaatcggctaacatctgttaacagaaggcagccgatttggttaaatagcgacgttgacctagattatataagatatctaccactctatgaaacttccagcggcttgattgtctagatattgttcttcttttcatacttaatgctgcatcagccgaatttgatctcttaagtcgtgcttagaatatcaatctctagcatgtactctggttgccgattagggtagtgtcggagtttcagccgatcttacctgatttaactactttttatcctatatgcttgattgacatgttaaatctgccctttatgttaagatcttgctgcatttaagtatattaggcttttgtctagtatattctacttgctttaatatcttaatatagagtggtatcggagtattagccgatacaggctagatctatttgatcggctatgctatgaatgtatatagtctcattattaatatatatttcgatttaagtgatttatattgtctcggcatggcgaccgatctattccaatcacttgatttaagtatatatcgatacaaagattatatattgtcaatatctgcagccgatcgagtagatttagtcccttcttatttattaatgactgccgatcgatgtatatatgacatcggctcaaagataaatgatatgtcatcggcacctagccgatcggctatcatttatagatttaaatgcggtttctttgcttctatttcttgttgattacaggatcaaatcaactggcacgctcatacattcgaaggcgagctttggacctgcactggagttaagcagatctcccaggcctcgtgttttctgtcaacagtaccacaactttaaggagaaactgatgctgaaatccaagaaaatatagtaagcaaagaaatactattaccaaggcatctaaaaaaggtaaccaattgacttgcatacctgtttaggtatgagctgagaagtgattgccggtgttttgctataagtttttcactgtaccctttcctttattcctgctcagtaagggccactcctttccttcgatttatgcagaactctttccaacatccctgtcgaaaaacacaagccaatataacggacatgagcaacatcattgactatgcatctatgcatcagaaaattgcattctgcagagaaaatcggaagtgcaaactgatgggtgagctgctggagcctggaagaacccgagcaaggaatgtaaatactagctaattgacgtcagtacccatcaatcagtattcagtaataatccagaggattggctagatatacaatcgactcagctagtagtttgcatgaccagctgagctacctgtagcccatacagcagactcagcatgcatacatgtaatatataaaaaaggtacacaaaggaaaaaaaggcagagtgtttcttttgacaaatgtaacaatcagcgtactctttgatatatataaaaaaaacaatcagagtaactcatgcacatgagaaagaacgtattcacgtacatggtacagtgcaaggaaaataagcaactgtttatgataaagaaagtgagtgcccccttttaaggaaagttttaatggttaaaatacctatatgcatcgctttcttcttttcaatttttcatatatttgtcaaccacacttcaatatcataattatctctgttaagcaatttccttttcccgagttaaaattttgctctggtacatgtatgattgataaggacattttcgaagagaaaaaagagaaataattagcggtagtgtacttcaaataatttgaataatttagacagaccactctcagggtttcgatggatatccacattgagggctgaaaacgtgttctatgaattcaattctctcaaacctacctatgaataccaaagaacacaatctatgtactcctagggtccagaactgtctactatataaagcaacctatttatacacaatcttgcctccttcaattgtctaaaacttagaaatgttaatttaaaacaacctaaattaaacaatttcatctccttaaattggctggcatgtactaatgttactttgttttctctatttttccggtttattacaggcaaacttaaagtagttggtcccattatttttccaagcatcaagggaaaattccagatgagcatttgcttaagtctgtgatacactaggcatgacaaacttttagaaagagaaatctctaaccaaccgcagaattacaccataatgatggtgatatccaatcttcaggagcaaccaacttgctccactggataagtttctttctttcaagaattgaagtagtctatgatgtagcacaattattaatcgagaaagtgaaactagcgtttgttttcttcatagcatcttcctttccatcggagaatccgtggatataacacatgacaagtatctccatatcattggtgaacatctttctttcgttatgatggactacagcagatgtggctaccttccctgcctaacatggccgttgtggaccccacaaataggaaccgtattaatcttaatatttacttacaagtttctcttactttgtatatagacagaatcctctagcttgcttgtgccaaaatgaaactgtacacaaaaggattgtagcaaacatggaaaaaaggacccaaaaaaaaaaactaacatcatgtaagcttagcaccatatgtttttaaaatgaactttgattaaaagtgcttgtcatttaagcaacctgatgaatgaatgcaagcactgtttccaagtcatacaaattatactaataatgcccattgacattgacatgtgggactcggccttgtattattgtgcttgttgaagtataagtgccgattccaaagttttatgatgtactaattatgtaaacatcaggccttaaagcagagtggtattgacatctgagtgcaagcagttattatagtatgccctagagagaggacgtactggcagcgctacattatggcttatgccccatgtctcagtcctagacttttggggaaatcaagcacttcactgcaccttttcacattagtatgggtattaataaggccttgtgtgtgtgtgtgcgttatatttgttcctttaaggaatgatataggatttgaatctgtgattaaatgtttgatgtggccaactacaacagtctttaaggaaagagtgcaaacaagaggcaggcatggtgaacaatttcacctggcaatatttataagggttgggcacttggcccatgcatattctcttaagcacaaccaggcaaacagagaagaagttccccttttaggccatcctttaaagctaaatcagcatgatgcttgaattctagcaaacattagttttaatgtcataaatatactctaggtatcattgtcatattccttctactccagtgtttaataaaaaccagcccatccataactccaaatactgtttcagctctcggaaaagaaagagctaagctgccaattaattgggagctttatctgaatggcatatcatacctttccagtttaatagtggtagtcttccatgatgacaatttaatgcaagtagtttatacacacatgtgaagctacaagtagtaagctgaacttgggagtaagctgcaaacctgttagagcttgtctatatttggatcttcaggcctccttctcaatgcaattagttgtctttctccttccatcacaattattaaacatttaaacataactaaggtttatgtgctggaaaacagtagtaattgcaggaacaaaccaaatatatctcctaagatatgaagagataactaatggaacaattatctttgaaaataagaggactgataaaccaaaagatcatctttgaaaatgagtggacggatataccagtctctcaagtctccacatccaatacttttttcataaagttattctacctatttcaggcaatttatctatactctcagtcttcccacatccaatagccctttagttaatagaatagcattttgacaattaatgctacgtaatgtgtcaaaccatcctaaatattctgtttgacctcaacaagttaccacccttcttggttcttgtagaatgcaaaccggaggcttctctctgcaattgaaaaacatgggatttataaagtgaagagaaaacaaagttcaccaacgcgatagagggcaatcacaatcttatgtcagatgacaacatgagcatttcaacacaactgtattgaaccagatggccaagatcctaattgaattccaccacggatcagtaattttcatttagaaaaaaataacaagttatctcagatctgggctagacctgatcgtttgcaatataaagataattttcgaccgtgatccattgcgcacatattccacgctagcatcctctagattgggcctgaagagaaggtaacaaccaaacaaaatacagcaaaagaacagtgcgcatttatgtagtattggtggcttggtgctggactgggaagtggctttataccttgtcttgaatagtgggccagctacttccagcatggggtcagatagcacctccaatggtccctggggacttattagtggagcattcagtgctcccttgttacagcctgcacctgtgtagtaccagagttaacacagagtcacagaccagcctagtatactgaatgtaaactatcccagaccattcgacttgctatcagcaagatgatgttactcaaagagtatcaggtggaaataaaattttaacttcattttagctattgctcccaaataatatatgtttttccctgtacaaagagataccattgcaagagagggagatatgcatatctctcttgaaaatctaccttttattagtctagagggaacaacatggttggagaatggaaacacttacaatggttatactgatcttacatatttccgtatacaaaataatgcagaaattatttgtacatctaagaaaaaaatatgatggtttgcccagaatgatagattactgatgataataaagctagtagcttgcagaaatttgaagctagcaggtaaatactaatacatgaaagttcagagtaggaactagaatttgagtagtcatagatggacatacgagattgctactgcacattactttccatattcaacttaaggcgaatgtgactggttagtgcaatgatcttctatttcacattacagcgaagagaaaatcagtgtgaaagatccagtctactcttcaagttcaaaatagtgcttgatcatactttgcatctgaaatcaatgtgaacatcagtttaggtttataagttagaagtatacaagcataatagaattaatgaattatacaaggacaaaaggaaaacttcgatactgttgccagaaaaatgtagaagaatggaatgtgctacacataacgcaaaagattgccacctgaaatagttttaaaacagtacagagcacagaaaatttaatttcagcatatggcatacagaggtcagaagtgttcataaaatcaacaaagcaagctacttccccaagaacatctgaggcctatatttatgaacacaacaggttagaatcttttacagcaggaatgagtgaatgagagtataaaacaacacaacactattgcacatcattacacccatgcgtgcaaaatgtgatgccatattcgtaacaagccataagttagagattcagaagaccacgataggatcttttcatattcataccaaacatttgagacttccattagatggcaaatttctagataaaccaacatacttgctcaattctacaggggcatcctaacttaaattcatgagaattgcacacaaataagtaaattcaaataggaaagacagctgttatgttttcagtaaaagcagggccatcatgccttttgtccaaaaattcaaataggaaggagaaacaccagccggaaaatgtataccaggcagaataattagttaatgtagatcagacatggttgagttgtatattgcactagccagcacagaccctaaaaatgaactaacagtaagccatttgaaactattgtgcttgtaaacaaaaatatatgtaagatgtaccattgtacacaaatttcagacaaacataactatatgtacataatctacattagtcaatacatgagattcaggaatgtttcaatttgaatgtgtacagcgaaattactcttaaaccagcaataggttacctgattcagtcaatatttccttcagacaaaattggtcagcatttcctccacctgatctccccccacttgaaacttctcgagtgaatacacaactcatgatcaaatactcttcaatttctacattgattagggaacagaataacccaccaccagcatatacatgtgaatgcaccaaattcaatgtatgttatgttagcaaaaaggaaccggcatacatattcaaatggtgagtgcattgttaatttccgaaagaaagtgtcacaaaactgaaccatcaagaagttgttccaacggatttcatatgaatggagatgaattagaatcatacagctgaattcttgaccccacatcaacgcacaagatcaaccaaagttttcctccgagggaaccgttgcgggagccggagcgacatggcatcctcaatctcgatgggcaaatgcgtggcgacgaacacgatcccacccttcttgcggtgctccgctatgatgtactccagcagcttgacaccctcggcatccagcgcgacggacggctcgtccaggagccagatcgggcgatcgatggcgagcagcctggcgagctggagcctcttcctctggcccatggagagcatcctcgccttctcgttcatgagcctgccgagccccatgagctcgatggccggggccgacttgccgtgcttcccctcgaggagctcgaaccactgcacgttctcgagcacggtgagcttctccttgacggcgtccttgagcgacatccagttgagctgaagcttgtactgctggaacacgcccggggaggtgatgtcgtggccgttccagaggacctcccccgccgaggggcgcgagaagccggcgagcatccgcaggaaggtgctcttgccggagccgttggcgccggtgagcaccagcgccgtcccgtcgtggacgctgacgttgatgtcgcggagcaccgcctgcgcgttccgcatgcaggagacgccgttgaggaggagccgcggcggcgggggcttcagcggcgccatttcagccccgcgcgcgcgcgggctcggcgccgcggtggtggggggcgggaggattggtggcttggtgcgccgcgcgacggcggcggcggcggcggcgcgcggagacgacgaagtgggggggagtgtcgtggtgagtggtttactgggcctttttttctacgaggatttaatgggctttagccaatcatgggccgtggggatccgaatgggctcgccggtttgaggccgtgacctggcccgcgttcccattcttttttcttaatgtatattttactttgagctatcttgtgttaccgatgtttttcttaatgttttgagctgtcatttaaccaatatttttattttaggccagataatattatctatgttttactttggatcacctgactctcttctcaagcatatgaacaaccttgtgtacgccatctcttactcgtcaataaactccctcggatgtatgtagaccgtttttttatgtatgacaaaattgatgtagattgtctaaatatcacaaaggtaaaattatcatgtccaaaataaaaataatagttaattaaaaggtggttcaaagtgaaacatcgataataaaagattgtcaaaacgtgatatatatactttttttcttcttttttgaatccttgattttttttcccaacccttttttttaccagggaaatttaactgtggactgaaactgcattggtggcgtttgtatctgtagcatttgatgcgaaccccagaaagtattcttatagtgatcgtcaagacggaggatccatatttcggccttgtttagttcgcgaaaaaagtaatttttaagcgtcacatcggacatttgaccgaatatcggaaggagtttttgacacgaatgagaaaacaaatttcataactcgcctagaaaccgcgagacgaatttattaagcctaattaatccaccattagcatatgtgggttactgtagtacttatgactaatcatggactaattaggcttaaaagattcgtctcgcgatttttcatgcaaactgtacaattagttttttattttatctatatttaatgttctacggtatccaaagattagatgtgatgtttttgaaaaaaaaaatagcaactaaacaaggccttccacagttccacttgcataggttgagcacagggggttgagaaatgagaattcacactggtagcttaactgtagatttttttaattccttatgagtttcttttcttggcaagttgacattcattaccgtgatgactgatgagttttggttggcgatgatgcgacacttcgtcttgggctgactcaactactggacgaccaagctagctattgtccatcccatcaccatatatataaaatcgctaagttgggtataaataaaatctctctcttcctacctctttcatttctaacaaaaacaattttacttagggcctttttttgtcacatcggacgtttgaccggatatcggaaggggtttttggatacgaatgaaaaaactaatttcataacttgcctagaaacagcgagaataatcttttgagcctaattaatccgtcattaatacatgtgggctactgtagcacttatggctaattatgaactaattagattcaaaagattcgtctcgcgattttttccctaactgtgtaattagtttttaaatttatctacatttaatactccatgcatattttcaaagattcgatgtgatgtttttgagaaaaagtttttagaactaaacagggccttagcaaattctatattgagcagttgagccatatcggcatatccacgatgatcctctttgttgtcgcgcgttcgttagcaagtcatgtcgttgtcgctgagatctagaatctccattcgtccacgagaacgtcagccagcgcttcatcgatcaacacatggcttgatgctaataggctgcatcaaaaattaaccaaaataagattatttctttttagaaacacaacacgcgcacacccacccatatgaacgcacgtacacctaaatctataagtgcatgcattctggagcggtatatcttaaaattgataaagtgatggactcctcgctatcgataggtatatatgacgtacagctaatttcttgatagacaccaccagttgcactaaatataactaaatgttgtgtatgtatatgcttgtgagaaaaacgagcacacgcgctgagtttttctaaatctctaatcaatggttgaggctacgccgggtgtgctgcaagattgttaaattggtagctactggctatgaacactaggctactgtagctaggtacttagacgatggagttaattatacgaatcatcaactacgtattcacgcattgacccggccagccgttcatctgtctggattgcgcgccgcgcgcgaccaactaactcaggatccgatagatacgcgcgagatgacgtcacctaggagcgatgcctacctcattgactgacatgtgggccccaccccctgcattgcccacatgacacctcacacagaacagagtgatgagctgtacacacttgtctgtaatggtcgatgtgatttaattttcagttcgattttggtttttgaattttttgatttgaccacttgcttattgttattggctgcattataacagttgcatgctactagctgcatggattaatcctttgttaagcaaaccatgcaagcatatgcagattgtatatattatcagttcatcacaccgccgtatcatcatctatcacacctcagaaaagcttgcttgagttgtttcagagataaaaatctagttaaactatggtttccgcgagatacggtctttgcatgcatgcatgcatattggccgtccctctgcttaagatcgtgtcatttcgtgtgaaatttgtgatcatccacatgatcggattaggtagagacgactctgattacgtgcctgatatgagcaatggaccacggcccgatttggtctttggcgcccgatcgcccggcatgatcagaatggatcggctagagaaaatgcagcgtatcttaatccctctgaatcctgattcgtcttctcttcagtagttcagtactactgctgcatcctccattgcaagggaacttttcgccattattgctccggaattcgtcaaaaaaagctcaggactactgcaagtctgcaactgggatagctagctgttcatcagtagaaattgcaaatggaaatatattattagcactgtatttgtatttttcagttcagattttcttttcataagataaggcaagagcaatgcttttttgtatgttatactccttccattccaaaatataagacacaaccacccttaacacaaataccaagaaataattatcatcacctcatagtttggattaacctaataaatagaatgcatgcacctaataaaattagagattttgatgatggaggattcaaataataatattttagtgtaaaagatgtgctagttaatgacatgcatgcatgcataccttatattatgaaacaactttaaaaattagtcgtgccttataattatggaattaagggagtattatgttcagttcagttaagatttaaggctaagaagaggccaagactactactacatgcaacttttcgccattattactcgcgaagtcgtcaaaagcttagtactggaacaggggtagctagctgttcatccgtagaagttagatgcaaatggagataatatattattagtgtactgcattttcagttccgatagattttcttctgaaagaaaggcaggagctttaatttgcattttatatattatattcagttcagttcagatttaaggctaagaattggccaagagtacagtgaattggtaagagagaagctgcaattagcagtaggtgaagtggagctctcactggggatcattggatggtgtatgtcccaaccgcctcggcctaatcaccagcacaatataaaaaccatcatcaccataataatcatacttgtatactactgtagaataattctccatcgcaagaattaaacaattgcaacgagaagattcccatagagctagcattagtttttccaatgctggcctgcctcagtctctgacagacagttcattctcttgtgtatcatatccattctctgcattcttgcagctatatataaacacaccatcatccagctctagctacacactgctactgctgcatattgctaggcacaaattcagagagagagacaggtcgagctagaaagaatcacacatggagaacaacacatctcattactcttcttgcattagcccagcagctgagacgtcgtccatgtcagctggagagagcagctgggcgatgcacattgcgaacttcttggcatcaccgtacaacagccaggagatgtgccaggaaccagtgatctctggcagcagcagcttctcctctggcttctcttcttcgtttgctacttcctatgacgacgcatcgttcatcacgtcggagatgatgtgtgacgacgacgatgacgatgattccttgcaggacactgcctgttcttctgcagctgcccctaaggttagaaaagattctgcctgtatgcctgttcatctgttcatctcttcttgttgttcaaaacaacattacatatataacctgcatttcttacatagctaccatctgttgttttacagttaactagcaacttgaacaatgttgatatgaagtcaatggcaacaatggaggctaaagatatcaacatcacacagctggtaagtttctgaaacagtttctctatattttctttctttgttcagaacccaattatatgtatccatgtatgtttccttacaagtttacttaacattgcaggccaagtattttgtcgatgccagttcacgacagccggcggctgaagtgcttcaagaaacagtcagtgttgataacaacaacgacaagtccttgtatgaatgtaatgagctgaggaagaaagggctctgcttggtccctctctccatgttgataaattacctcggatgattgattgtactgttaatgtgtactgtcagtattcagtttaattaatcgtatacaacgatagtgttcatatatcactctcttgtgtcagctgatgatcagaaacctaattcctatcatgctgttgagctgtctgatcgtaccactcgcttagaaaaataagtattcaactattggagaacaataaacaagtaggaagagataatctagctagtgcatacgccagtgaggaaatttaatttgtacgcatagcttcagttctttctaagtattcaattgttaaaaatttccaagtttaggcaaactttcagtacaattcatttatctatgtgacagggtagtcatttatctatgtgttactgcataccttaattatgtcatcgtaatacttagtaaattttcacgctgcattcattcttctgaagtacaggtattgacctgtaaatctattactagaagatagcaacttagtacctgcagagtgttaagtgcaatgttaaattctcaaactttaataactaagtataatcattaatcaactagttcagtcagtttacattctatcaatagttaaatgagtgcccttgcacctctgcaaacgtcagtgatgtgatcgctcactaggtagaagcaggctgtaatacttgttaatacaagaagctaatctttttttagtgaccagaaagtgccacttgcctctgcttattcagtcagaataagtacaaggggcatctctctgaccttcccaaaatacctaaacagcatgtaccaattgtctgcttgaataatttcagttcagtagaatatatacatgttgcaggggtagcaggtagcttatttatatcacaacataagaaaattcccatgtgccatcacaaggatgcagctagcatctagtggaccttgaattcttgacaattctaagcacatccatggatcccttctaagtagtacaaactgtagcattttacaggacataggatgtaggcatgtgattctcattcaactggtttgaatttgtttctttaaataatggaattcattaactggtttgaattttcaggagcatttccaattgtactgtatatagttagttttgaagacttccaaacatcatattgaccatgttctattttgtcgggtcggctgaacgattaggccggccaaatttcattaagattgagtggagatattgaacatgttcttttcgggctcttctagaacgctgaaaattttccgtctcctaccggaaatgaactgattaaggcaaaaggttctcacgaagttcatgtgaaattccttgctctgaagatagaatatggagcatagcatgttgccttactaatcatatatgatatgtataggcccagttgtttatactttatacatcagattagttgtctagaaaaggtcacacttatgttagtatttagtagtaacttgcagactattttctttccatgaagatcctatctccgactctgctaggaaaatctcttttcatagtgtggataagttttgctctttaaacaatgccacttgacatgtctgactgttatccatattccttaatccttagtactgactttaatgtactaaacttttttatgacaacttggcagctgtaaaagtactagtataaagatttatcaaaaagttcttttaggttaccttgccatttcaagacatttgtgacaaagaccagtggagaaatggagtaaaaagtgcctgcagtatgaatcaggtattactcttttgttgccgggttggccaaaggattaggccgatcaaatgctattaagatatattactctttttgatattgaagaaaaaatgtacttttaagatataccctcagttttttaatatacgacgttgttgacttttgttacaacatttaaccattagtcttattcgaaaattttgtatacatcttaaaagttataagtaatgcttaatggtacttaagtgataaatcaagccacaacagaagaaaaaatatttagttaattttttttaataaaacgaatggtcaaacatgatgtaaaaagtcaacagcgttatgtacttaaaaaacggaggtagtatatttcgaagtatgaatcaggtattactctttgagatattgaagaacaaaatgtactatactgctatttaggatacatttggaggttggaattatctggcacaagaatcttctctagctaagaatattttgcagccagtcaaggctagctgcgttagggaatagtacaagtacaagaaatggagtaaaaattgcctagagtctgaatcaggtatttaagaacaaaatatactatttaagatatatttcgaagtctgaatcaggtatcactctgagatattgaagaacaaaacgtactatttaagacatatttcgaggtaggaaccatctggcacacgaatctgctctagctaagaatattttgcagtcagtcaaggctagctgggttagggaacagcacaagtactatacaatttctgaaaatgatcactgcaacaaacttagtaccatctacacacattaacaccgatttgatattgaccttcagggatcgtactaaacttaagaattcagcaatggcagacctgtgacaatgtcaacctcctactcatcattcatcagcgtcagagcgaaaggtgcacctaaaatcctttctgttcttggttcactcggcaacaaaccgaaatgatgatccagctataaacagaccagaagtaggacggattcagagaattcagggacgaacggcatcttatccaaccaaaagcatctcggtgttcatcagttcatcggctccggaagagacaagcagagactatagctaggctggggcttggaacataactgcatattaaccatgtgtataaattaaaacagtggagctgatataaaaactgtccaccattggtaggaatcttgtactgcattgtttgaacgaatcttagtctctggttggcttgctcaacttgttctttagcgtcagggaatacgcatggctggaggctggagagccggcgctgagattccacactggcaattgtgatatcagtttatccagaaggcaacatgattgtttttgcaggcttttccaagtgtcttagttctttttagtcactcccctgttcatcccatcacaagtaacttttattagtttcaggcaaattaatgctagaagcccggcgaaaaaaaaataatgctagaagatataatactccatgtgtttttaaatgtatgacgctattgacttttgaatatgacgtttgatcattcatctcattcaaaaaatataaatataaaaaaatattagtcatatttagagtgtctttaataataaaataatgataattttagtttaaaacacaaaataaatgatacttacatacacccttcataaaaaaacaatttataaggtaaatctttggtttattttctagaatgaaatgagtagcttttttttataaaacaaatagtcaaatgaaatatccaaaaatcaacaatgtcataaatttaaaagcagaggtaatacctctcaataactcttaaaattggtgggagaacttttttttcactaaaaaaaacttctctttttctagaagagaaaaatatgtggtcacctgacagtaatccggccaggcaggacagactacagagtagtgcagaggcaattggggcctactcatcgaaatccctatccttgaacatcaaattaacttctctggttagtcacaatcaaacacacaaacggcgatcacattccaatttctccgtacgatcgccgattaatctgcactccaaactccaaacccatttacatgtacagttggcgcaaagcagagagcactgaacagacaacgatgtacagcactctctgcgcaagtagcagtagcacacccggaaattcgatcagtgctgcacttcacgttgcagagttgcagttttgatcttgcgacgcattggcgtcggaagcaggcgccatggtggaatcgcagctgggtctcgccgaagaagaagaagaaggcaccgggcagtcgctcgtggacctccgcttccgcctcgtcttcctcgccgccggcgggcgtggtatgtcaggaggcggcgccgcttcttgctgctgcaggctggtgttctctgacggcgtggcgaaggacgacgagtctcgaggctggtcgaaatctgtcccaacagtggaagcagatcagcatgtgagtgccaagaagacattaggatcgacatggccgattgctgatgctgtccaagaactgcattgttgcagcagtgtttaactgaatatgttgagtgatcatgcaaaatttcagtcgttccgtggccattagcatgcttgtttgttgtctgtcagacagcagtttgtgacaatgggaatctaatctacggtgtttgtgccttgggaaggatctatttatgcatgagtggacaatggacatcatgttcttatcaaatccgaatcctgtcctgccatatgagttcaacaagaaaatttctgctagtttattagctagaccacgtctcgagctcactccgtattgcagtattaaactatgcatgatacagtgtattgttcttggttaaacattgttttctctgaacttcctcacacttacttaactcgtaataaatttcgattctcgtgattctaaccatcaatcacataatgattgaagaggattaccagaggcttacatgtttttatcattcatcaagttttctttcaaaaggttcagtaatcatgtgtacacacaatccattgcctggcaaaagatgctgctggtagttaggaaatcagaagtgtggatttgttttatcggagtgttccctgcaactccggatcccagatcaagaacatgcagacgtgcccatgattctaggattaaactagagtaacttgccaagtttgcatgcttatccatacatgccactcataagacagaccaaagcctttcccaaagaagccacaatcatatgaagcaatcgcaccaacacagaaaatcttccactctgaagaacaagtaattcttgccataccttgagaagcccaagaggtccctgcagatggtgcaaagttgcccaaagacagaagttcagacgatgccctgatgtcattcatctaaagaacagatgagagaaatcagacaatttgaaacaagaagatgattgtatcatttcactgaaattcaggtacatttacccagcttggagaagcattccctgtcaggccatcccaaccgatgtgcgcgacatgcttcacgtctgtcggactaccaatctgcatctcatgctccttcactactgcaaaaaccattcagagaatgcaagaaagaagaccgtcagtagaaaatgagagatgtcagcaagcaagaaaggagattagatgcagaggagcatgaaaagcccaaaacattgtactattgtactgaccaaagatctgagagatgaccttgagtcccttgaagatccctttcatcttgtacgccattgggatgttccttacaaacacgctcttcagaaacaataagaacacaaaaaagaaatcttacaagcaaaggcaagcaatatgcagaagtttcgaaggctttttcatccctgacaaagatgtgttaaccagatattgtgattatgtgcagaatgaaatatccctgacaaagatgtatcattctgacaaggatgatatagctagagggtagttgatgatgttgatgcccctcctcagttgtttctattgaaagcttcttgcaccacacatccttctctgaagatggtgcaatgctaacttcgcaatcccggcggatgatgtcaatactctggccgattggtggcttgcaacaagacgttgttttcggacgagctacatgtcggatttcgacagtgcattcatgctaatttgctggttgatttggaaggaacgtaatgcaagaatatttcagcatgtgtccaagttaccggagcaactagcggaggatataagagaggaaattgctgtattttttttagagaagggttttttttttacccgacctctacaaccaactgtatatatactgccattgaaatagggaatctagctccataaacaacccaatctgaaatttgctcatatggagatttgaactcaggattttggggtactactcaagtcactgtaaccactaggctatatgcaggtcactgcaattactgtatggagagtggctgggatcttttcccaatttggcgagtgatcacggtggataggtctcgaggatttgccccggctattttcttttctttctctttcgttcttagctggaccggggatctttcccgaactggcacgacatcgtagtattgtcgtttgtaacaatttattatttttctccctcaaatcttaatgaaagtggtcggccgacccggcaaaaaagaaggctgtattttgtccggacttccaaatatttcagcaggaatcacataaagcggtaagaggttactatatactccctccgtcccacaaaaaataaacctaagactgaatgtgatatatcctagtccgtcctgattcattgtactaggatatgtcacatccaatcctagattttttttagacagagggagtatgttgtactactacagcagtgaccatgaatgtcaactaaatagttatgattttttttttaaaaaaattgacaagatagattcatgtgcaattaatatatcatttcacaaaatgcaagttcaaatttgacttctgcgggttgtaacaaaatttgttatttttttacaacctttacaagttgaatttgaaattgcattaattcatgcctaatataaatttgttaatagactctacctttttacaagtctaatataaattctatgtattaattcatgtcattagagactataacaaagatgacagaaagaactgtaccaatgaaccaattggccgatactgatatagtgggatagatgcagattcgatgattaatgtatacattggctggaggtccttccgcacctccgtgtgtgcaataggatgacgacgcttttgtgcggcgagagagcagcacctgccctaaagagggatggggaaaagagggaagaatgtgagagagatgaggaagaagagttggtcgatgacatatgtggggctcatgtaggtcccattaaccacgtcaggcaaaaccatgcgatatattgccctgagacctcaagtacaccggttttgcaagttaagaaacgtgttacacctgatattgcggttgaatgatgcaattcaaacttagcgtaaagctgagggaactaagaaacgtgttacacctgatattgcttcttttttttttttgaaatcgcttcctattttattctccacacacacgcatgatttgttttacgatatttaacaaattcaatctttcgccttcaaatatgagttgagagttttgaatttcagttgaaagtttcttaaatttaacttaaatgttttgaattttgagacggaagttttcaaatttaagtcgaatgtgaaaatttttaattctgagttaaaagttttcaaacatgtgttaagttttcaaattttgacttgattttttaaaattttgagttgaaagtttcaaatcttcagttgaaagttttcaagtctgaattgaaagttttcaaatccgagttgaaaattttctaaattgaaagtttttaaatccgagttgaaaagtttttaaatcttgacttgaaattttttaatcttagttaaaaatttcaaaaaatcttaagttgaaagttttaaatgttgagtccccctacacggtgcggtaatcagcagcgggaaaaaaaaaaagcaaaaagaagcgccacatctgcgcgggaccctccattggcggcgtctgcgcccgcggcggatatgcgcgaggcccgttttgaaactcgacaacagggtgcagggtgcccgatcgagtcggtttccaacgcgatgagcgatcgagtcggtttttatcccgagttgctgcgggagctgttgctaggcgcccagcgctctccgatcgtcatgcacttctatttattcgtggcacctagtgctagctagatagtgatcttgcttcgtctaatctttagtacgtactcctacatatagtagctgtggatggatatgtcgcggccggtggtaatgtacaaaagaagacgtgcgataatgccacggcgagcgaaacgagggaggaggcagcactgctcctcctccttgtcgttgttgtagcgcccgttccgtcgtggcgcctagcgggaaaattatctcttaaaaaccctaattgcgaaatttgtttccttgcttgttgtctagtgcccgtgccatctcatgatctcaatccccgatctatcgtcgagttcatctccgaatccaattccttctaaa

SEQ ID NO: 37721 - DNA, 50391 bp, Oryza sativa
gattcctagcgtagttatgtttgactactgcttgtgaaattgctgctgagaaactgggttctatgtttggaaaacctgcagtgatgggatcagctaggcccgggtggccgtttaaaagttgttggcccgggtggccgtttgaaaggtgttggcccgggtggccgtttaaaaagcttttggccgggtgccaaccttgtttcaaaatctaaagactgatacattgcacatactccgaccggacgagacgcactgcctcatccgtgtcgtttgagaagcactcacttagttgcttttagaaaagagttcaaataaaaccaatcgcaaaaacaaacagcctttccttgaagcttgcattaaacacttaattcccatggcttgctgagtacccccgtactcacccttgctctatataaatatccccccccagttgctgaagaagatgaagcagatcctgctgatgaggagttcttccaggagcaagccggctacgatgagttttagggtttcggcctagttcccaagtcgcgcctgtgattgtttggtccaagtcctggcttccgctttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttagtttggagcgtcacgggttagttccggtcgggactagctcggggcgtgacaagagatggtatcagagcacaggcttggccctagggcgaaacccgacgcttaggacgaccctaaggatactagattcaaaactacttgcgaaaagctaaggtttctctcttcttctttcttttcaatagtttgtttctaaaatggttactgatcctttcttcctctttcaaaattgtagatggcagtgaacgccagtttcagttcccacggttttggtgagggtcaccacgtcgcccagcttcgtgacctcgcccgtttccttggcttctcgtgtcccgagtacacggggtactccgtggaccgtgttccccctcactgtgagctctctgtgtacctttaccctcgtggaggtatacacggagttggccttcgcccccaccacttcactgtggccaggcccactctccagatcgcgtaccaggacctctcctggactgcgcttcgccgcctggcccacgactacggccaccgtctcggaggctccgccttccggcagcttccacgtcttccttctggccacgcagacgccagatacccttgtccgtacagcgagtctcagccagtgctgactcgcatggtcgagctttcggaggctcaggccactcagcacgacctactccttgaggcttaccgctcccttgcccgccgctacgccgccttggaggcccgtctggccgaggagggtgtcacctcagttgacactatctcttgggactcaggccgtctctgccacgccagccacctgtcctcccacagctcccgcggctctgctcgcactcccagtggcccgcgctcccccagctcgcgtgcgccgtactcaccagtgtactccccctacccacacccagttagcccttcctacacccccggacacactccagtcgcttcctcccgccgtggcccacgctttatccgcactgcgcggaagcgtgttgttggttcttccaccgtgttccgtttccgccacccagctcccccaccgccagcggcccgtgctgctgccggccctcgacaggtcccgccggtcccttcgcgccagccgatcgacgtttcttcgactgaggagccgaccacaggaggcagccaggccgacgaggagtagaggaggcagtcttcagcagccgtccgtgtgttaggcccttttgttccgccgccaactcttttggagtcgtggcgaggtagtgcgtgtgtgtgtttgatgtgggtgttgtttggtagtctggttctcctaggaggtgtgcgcacagtcaagctcggcgtagctctgtgacttgtccacacccgttgtatcaggtgtttttacgatttgaaaaaatccagtttatgcctagtgtgtgctatctgagttgctatttgctttgctccttgccctcctaagtgcttatctgactcttaccccgcccttttctgggagtttagatggctagccgcccccgtcgtacagctcgtgcaccagtccgctttggttttgaagatggtagagttgaagcagaagcaaatcacgaaccagctaatgagcattctcaccacagcaaccgttcgcaccgtactgtttcccgcaacgcagaggttgagcaacctcgccgcagcagccgctcgcatcgcacagtttcccgtgaagcagagttggagcagtctcaccgctctcaccgcactgccagtcacaattctggagaagaacgcctcccttccccacctcatgtggaaaacaacatgcaacacataatggcagttcagacacagatcttgcaaggtctaaccacagccatagccagctttcagcataatgcgcatggaaatggccaccctcacgtgggcaacaatagatccaagctgacagactttctgaggtcacgtccaccagagttctctcagaccatcgagcccgtcgaggctgacgattggttgaaagatgtggatagaaaactcaacttagtgcagtgtactcctgttgagaagacgctctacgcctctcaccagctaagaggacctgccgcagattggtgggagaattactgcaatgcacatcctgaacccactaacattgcttgggatgagttcgctacggctttccgtgtagctcatgtgcctgaaagcactattgacatgaagaaagaagaatttaacagactcaagcaaggccacagcagtgtcaatgagtacctaagtcagttcaacaagttggctcggtacgcccctgaggaagtagacaccgataagaaaaagatcaggaaattcttgaaaggaatcgcagttggaatgagactccagttgcttgctcatgacttccccacttttcaacatatgatcaacaaagcacttctacttgaggatgccagaaaagaggccaccgaagaatacaagaaacgcaagtctaaccatcagggaaattcttcccgaggcgcacctcgccctcgctacggtcagcccatgcaataccatcagtcggtcactcaggctaaccgccagtcaagctacgcccctcgtcctcagatgaaccgtccggcacctccgccacagcagcgtgcccctagtggcaacactgcgccaaacagtgttacctccttcaagtcaccacagggaccgtcagcagttcagtgtttccggtgcaaccagatgggtcactatgctagacagtgtcctcagaatcctaccaacaccagcccaggacatgctaatggcagcactgccagaactcctactccagcggcagctcagtctcgtcctagctctcaagcaagtggacaaggttctcgtgcttccaaccactttggtcgaggacgtgtgaatcacattcaagctgaaaccgctcaggatgctccagacgttgtgatgggtatgttctctgtcaactccgtacccgcaatagtcctgtttgattcgggagcttcccattctttcatatcgcaagcttttgtgaaaagaaatggttggaaaacccaaaatttgcgtgtaccaatgatagtacattcccctggaaggaatataagggcaactcaaatatgcccggaagttaaccttagaattgaggaagttaacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtctgtgaatatcccgacgtatttccggaagaattaacaagaatgccaccagaccgagagattgagttcgccatagaactggcaccaggcacagctccaattgcaaaaagaccctaccgaatggccgctaatgagttagcagaagttaaaagacaaatcgaagaactggaaagtaaaggttatgtgcgacctagctcatccccttggggagccccagtgcttctggttaagaaaaaggatggctctgagagaatggtaattgactatagagccctgaatgaagtaactataaagaacaagtacccgttgcctcggattgacgacttattcgatcaacttaaaggagcaagagtcttctcaaaaattgacttgaggtcaggttaccaccaactgaaaatcagatctgaagatattccgaagaccgctttctcgacgcgttatggtctatatgagttcacagtaatgtccttcggactcaccaatgctccagcattcttcatgaacttaatgaacaaaatctttatggaatacctggaccagtttgtagtggtattcatcgatgacatcctgatatactctaagaatgaggaagaacatgctgaacacctgaggctgataatggaaaagctcagagatcatcaactattcgctaaattctcgaaatgcgaattctggttggaccgagtagcttttcttggtcacgtgatctcctccaacggtgtcgaagtagatcccagcaaagttgaagctgtacttgcgtggaacccgcccaagaatgtgtcggagattcgcagcttcctcggcttagctggatattatcgaagattcattgaaggattctctaagctagccagacctatgaccgagctgttaaagaaggaaaagaaatttcaatggtccacagcctgtgaagacagctttcaagaaatgaagaaaagattgaccactgccccagttctcaccttgccagatatccgaaaagacttcgagatcttctgtgatgcatcaagacagggcttaggatgtgtcctaatgcaagaacgaaaggttgtggcctatgcatccaggcagctcaggcctcatgaagtcaattaccccacccatgatctcgagttggcagccgtgattcatgctcttaagatctggaggcactacttaatagggaacagatgcgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaaggcctattgcaatatagctcaaatacggcctgaccaagatcacctgtgcagagaattggagaagttaaggctgaccgtggtgcagtcaggtgtccctgccagcttgacagtacagcctaccctagagtcgcaaatccgggaggctcagaaagacgacgaagggataaaagaattaataaaaagaatacaggagaagaaagacaccaatttctccatagacgatcaaggcacaatttggtgcggtccacgcatctgtgtaccggccaagaaggagttaagaaatctcatcctaaaggaagctcatgagtccgcttactccattcatccaggaagtacgaagatgtaccaagatatcaaggcatacttttggtgggctggaatgaagcgagatgtcgcagaatacgtagccttgtgtgacatttgccaaagagtcaaggcagaacaccaaaggccagctggactgctacaacccctaccgattcccgagtggaaatgggaagagatcggaatggatttcatcaccggtttgccaagaacccccagcggatacgactccatttgggtaatcgtggaccgactcacgaagtcagcacatttcgtgccagtgaagaccacctatgatggaaagaaactagcagaactctacatgactcatgtcgtatgtagatttggctgtcccaagaaaatagtgtcggatcgaggcactcagttcacctcaaggttctggaagcaattgcatgaagcactcggaactgatctgaattttagtacggcctaccacccgcagaccgatggtcagacagaaagagtaaaccagatcctagaagacatgctgcgagcatgtgccttggatttcgaaggcacttgggatcgttgtttgccgtatgccgagttctcatacaacaacagttatcaggccagcattcagatgtcgccgaatgaggcaatgttcggaagaaggtgccgcactcccttgtgctggaatgaggtgggcgaagccttggtattcggtcctgacatactcaagtcagcagaagaacaagttaagctgatacgagaacgtttgaggacagcacagaaccgtcagaagaattacgctgacaatcggaggcgtgaccttgagttcgaaaaaggagatcatgtgtacctacgggtatcaccactccgaggaatgagaaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagttaaagaaatgtcttcgagttccagaagagcaagttcccctaggtaatatcgagctggaaaagaatctgacctacaaggaaagaccgatcaaggttcttgaagaagcagaacgtcagactcgaaggaagacaatcaagttctacaaagtccaatggagcaatcattctgaagatgaagcaacctgggaacgagaagatcttctccgcgccgagtttccggagctgctcccttaggtgctgaatctcggggacgagattcttgttaggggggttggtctgtagcgcccgttccgtcgtggcgcctagcgggaaaattatctcttaaaaaccctaattgcgaaatttgtttccttgcttgttgtctagtgcccgtgccatctcatgatctcaatccccgatctatcgtcgagttcatctccgaatccaattccttctaaatcaaaatccctccgcaaagtctagtttacctcccccaaggtcgatgggccgaaactcgctcggcccatctccctctccctccccggcccactctcccgagagctctctctctctctctctctctctctctcccccggcgcgctctcccccccccccggttcagcatcgcccgcacgctgctcgcgcgccgccccgagcgccccccctcgctctccgtctccccatccctcgctgccgctccccgcgggccgttgctcgcgcgcgcccgcgtggatgccgcccggtcccgctgccctgccgcctgcagcctgcagccgctcggccccgcagccagcgcgcgtgccgagccgcgccgcaccatccgccgcgccttcccgttgcgagccgcgcgcgcgtggccgaccgcccggtcgccgccgccgtcagcctctgcgcacgcctgtcgccggtgtcgccgctccgctccaagacgttccccccgtcatcgccgtcgtcatcacccggccccgccactccgcgcgcaagccgccaagggacggaggcagcgccccctccctctgccgcgtcgccccgctcccctcctcctttttcccgaaccggcaaaggggcaagccccctttctcccctcctttttcccctttacctctccgccggcgtcatcctccctgtcgccaatttggccgctagccgagcgccagctcgcgctcttgaccgcgcaagtcggttccccaaaccgacattgccgcctccttaaacccccggcctccccttctccttccctccccattttcgcctcctccactgccgtctctgttttcgccgtcgccgatcgtcgccgcgcgtgtcggaggagccggcacgagcaaggacgccgaagaggactccggccgcgcctcttcttcctcttccccggcccgaggccggagagatcactcccgcgccgtcggcctctcgtcacagcgcctctcctttccgcggtgatgtttcgcttcgttctccctcctcgctccgtctcccccccttagacttcggttttagctcgagtagacctcccgtagttggccggcgccgccccgaccgatgccgttgctcgccatgtgctcgccgccgtcgccgcccgagttccgtagcacccgcacgtcgccagcctccctcggcgtgttccctccaaatccgacgctagcatcgagttcccgtggccgcgtagatgctcccaccgccgggaatcggcccctcgtgacctcgtcgccgtttccctctcctcccgccgccggttgtcgccgccgcgattcgccgccgtcaagctccctccggtgaatccgagccgttggctcgcctccccgcgtcccgtgcaaccacccggtgtactcgctgtcgcttgtatcgccgtggctcgctccgccgatcgccgccgccgcccgccgtccgtttcggctgggccttcgtctaccttccgccgacccgcgtggctgccacgtaggcgccacgtcggcgccacctcggccgcgaccagataagccgacccggccagccgctccctccgtttctccccgtgcgcgtggtccgcggtaagccgtgaggctgcacgtgggcccgccgcctccgccctcaccgcgagccgcgcgcatgcgccgcgcctcccctccccaaaccctagcacgccgcgtgcaccccgctcacggtgagccgagccgccgacaagcgggtcccacccgggaccgcgcgtggtgagcccggtccaccggccctctctctcctccctcccgcgcgcgcgcgcgcgcttgggccgccttgggccggccggcccatttagcttggccggtccgctccatttcccttgggccgcgccctagccgtccgaggaaagtctagattccctcccttcatcatttctttttcctttttccaaaaaaggatttaattaaatcctttttcctttagaccaaaaatccaataatcttagaaattcaatatctttccaaccataactccgcttgactccgttcaacttccaaaatttcccaaatctcgagatctatccaatggcacgcttagaggtcattaatagggctttattttcgccgtttgttgagttgttccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcacacttaatctgttgtcccgtctgcaaggcagattggcggacctacctaacttgttgcaattgatccttccgttgaaaattgctacaccatgtccccttgtaaccacccagatgcgcctcgataatcgtgcactctgtgcgaatatcgacggtcgccttcaaacttaaaatttgagtaacaacttgggtaaaactggagttttacaaaagacttggaaaacccgacacttgggtcggtgcttgtgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgagaaactgggttctatgtttggaaaacctgcagctgatgggatcagctaggcccgggtggccgtttaaaagttgttggcccgggtggccgtttgaaaggtgttggcccgggtggccgtttaaaaagcttttggccgggtgccaaccttgtttcaaaatctaaagactgatacattgcacatactccgaccggacgagacgcactgcctcatccgtgtcgtttgagaagcactcacttagttgcttttagaaaagagttcaaataaaaccaatcgcaaaaacaaacagcctttccttgaagcttgcattaaacacttaattcccatggcttgctgagtacccccgtactcacccttgctctatataaatatccccccccagttgctgaagaagatgaagcagatcctgctgatgaggagttcttccaggagcaagccggctacgatgagttttagggtttcggcctagttcccaagtcgcgcctgtgattgtttggtccaagtcctggcttccgctttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttagtttggagcgtcacgggttagttccggtcgggactagctcggggcgtgacagttgtggtgtgacctccccgacgacctgctccgcgacgtcctgcagaggctccccgccctgggagaccgcctccgcttcgccgccgtgtgccgagcatggcgagccgccgagcgttcgcactacccgcgccccgccgtcccgtggctcgtggcccctggccactgcgtcagcctccacgacgccgccatccaccgcgtctgcagcctccacggcggcgccaccgacgtcgtctgccggggctcgttcgacaactggctggcgatggtgcccacgtcgtcgcctcctccctaccagcccttcctcctcaaccctttcaccatggcgaccgtgaagctgccgatgtggaccaacccagagaccatcaccaaggtcgtcatgtccgcatcccccgccgccgccgacggcgacggcggcggcggcatcacggtagctgcgatcgcccgcgccgacccgatcgaggttcgtggcgcggctaggcaagatcttcgtctgccacctcccggggaggaagaagaagaaacatcatcccgatgatgatgataatgcttggtcggacattagcagggtgttctacatccaagacatcgtgttcttggaagggaagctgtacgccgtcaccgaagcggaggagatcttcgccttcgacgacgcggacatcgagcactactcgcacttgcccagcgaccagtggcggtggacgcatgtcgacaagcaggcgccggcgtttggccgcaccgagttctacctggttgcctgccacacgatggggaaggttctagtagtttccagagacttcggcagagcccgcgtccccgacaccggtggcggccgcgccgcggcgcgctaccacacatctagattcaaggtgtacgtggtcgaggagcacgactcgagacgtggggatcctggcgaaagaagacgcggctgacgagaatccccaggctgcgtggccacgcgctcttcatcggcgacgcttcttgccaagcgttcgatgtcacgtcgtccggcgccggcggcaagatcaccgagaatcagatttggtacgtcgacgacgagaggaacatggtggtcaccgtcgccgccggtgatggtccggtgatcagctcctcctgggcattgcggtcggtgcaatcgtacgacatgcggaccagctgcttccgtagataccagcaaaaaccccataagccgtcgtcgccatgggagtgcatcatgctgcagctagcgctacctgggcgtcgaagccagcatggtgccaccgccggtgacggagttcggagccacgctgctgctatgggaggtcatcaacggcatgggagcaaccaaagagccaacctactattacagcgctagccgccgccgccgtcgtacgacgtcgacgacgaccacggaggccgatgatgatggcgccgccgactaccatgccgtaaccgtgagtgtcaacgttctcaaccgcgattgcttgcgtttcacgcaggtcgggtcgtcggtgcaggaggcgaagcagatggcggcatgggaggccgtcacgttcctacggagccgattccggagcgtgctcgacgacagcccgtggagctcaataccacattatcatagccacgtaagtgagatagagtacgacgaagattttgacgacgacttcgactacgctgatctctgaaattattgacttgtttgtatcaccaacaaatttgttcagagcgatattttcagtatttaatttttttttgtcaccagtaaaaatcatctgtgtcacaagttgcaaagtgcagagcatcacaaggataagtacgtattcagagaacagtaagcaaacaagatatacttaaaatcatccattgacaccaatacggaaaagaagtatgaggcttaacatgatcaacctgacgactgcaagccattacggcagacacgacacactgctaaactgaaccagaacctatactaatcaaaactgataattaagaacctatactaaaacccaagtgatatacgatctctctggacttagaatccgtggaccttgatgttgtccttgcggaccatgccggccttggcgaggaagtcggagacgctgttgcggtggtcgccctgcagctggatgatcttgccgagctccttgtcctccaccacgttgccgttgcagcagagctcccgcttgaggtcgcggagcaccttggcgtagttgtactcgccgccgatcccctgcacggtggtcagcgtcttccgcccattgcgctgctgcacgcggacgtgcacgtagtcgccgccggcgccgcggccgcggcggcgtcctccccctccgcgtccgcgaacgcgtcgaacgtccccgccggcaggccgaactcctccggcgccccggacatcaacttgctgccgctgttcccgccgccctccgccgcctgatcctcctcgccgcggcgggggacaaggtacttgttcttggacgccgcgcggcccttgacgtactttcccttcttgctcgccggctgcggcggcggcggcgctgggacgacggcgacggcgacggcgacggcctcctcctcctcgtcggacgacgaggcggcggcccacagcgcggacaactgcggcggcggcggcgacaccttggtgaccttgttgctgctcgccaacttcgacgacggcgacacggcggcagcggcgggtttcttggctctggggatcgttgcgctcgagatcgccggaggattcgtgttcttcgcgttcgttttttgcattgcacgaatcagggggcgcctcctcgcgtgtatttatgaggggacgcgaaaggttcaagccgaggagtccaagtcgtacgtggagtccacgtcggataagttgttagacgtggcgtgatctcggccgtccgacggcgcatctacggtccccactacccaggtcgcgagtagaatcctcctcgtacgccgctgccaaacttggctctcacggtttctatccgggtacgtcggcgacacggaactgacggaagtaccaaaattgcacgcgcagaaggaagattggtagccaaggaaatcatgtcggttgcaaattctgctaatgtttccttccaggttacggccacatacggtaaaaagtgtttacatggtactccatacatttcaggttacgagtcaaactattttaaattagactaattttatagaaaaaatataataatatttttaatccaagaaaaatatattatgaaaatttattcaattactatgctgttgttataaatattactatttttttctataaatttggttaaacttaaaatactttgactttgaccaaaatcaaaaacatcttgggcctattcaatttgatgtcattttcaaccttaccaaattttggtaaagttacaaaaaaaaatggctacatttagtttgctgctaaattttggtaactatataaaaaatcctgccaaaattttggtaagttgccaaaattttggcatccaaattttggtaaggttttttttgcatcaaagtgaacagttcccttataacttgaaacggaagaagtacaattgagtgacacgttttgcagagaaaatttaataacaggttagacgcatcaaataccaaccaagtaatctttaatttccagaatgatgcattcatagagagacaagattacttgaactgaaaaaacatcagcaacatatggggtcaagtactcgaggtaatgttcaacttcaaatacaaagaacaaaaacttcaccatccattcatttatctccagaaaaaaaaaatcagccaacgtggctgtaattattggcacagcaaaaggagccccaggtaaaaatctgtacacagattacagcttcaaggagggattttgactagggcttacaatacagcaagtgatattacattcctctgtgatgttccacaccatatgttgcagcttgcaacaaggcgtctctacatggctaacttataacagaactgcctataaggatgtctaggtaatgtgagaaagtttacacaaaacagcagaaaccaatgatgttacagtagtcaagcagaggagaagaagaccaaacagcaggctcataaagcccttccacccgtattcttggcaaatgatggaggatgaacaaatgaaagggcagcaaagtaatcgctctgaatacttaacaatgctgatagtcgataaattaccatgcacgaagttgtccacagaaacaattttcccttgttatcatctgagggctctcactcagatcaatgggtataaataattgtgttagttctgacctcctgaattctgataacatgcagtcttcaaagaactaatgtcttgggcaaaatcacaacatttgcaaccttggagtttctctgcattggtcttttgatgtctgatctgtacaattcctgtataacatcatggtgctgatctaatttggcaatcaactccttagatcccctggcctcatttaattggcggtgctaggccttgcgccttcatcatgcaatggtattttgggggtgctcttgcgcccacttgcatacaaagctcaatgaccgcaggtgcatgaccataatagtctctcccagcgtcgaccagaaccggtggatcatgaggtcgctggtgccaaacaatctttggaggaactaggtcatccacatcggctttcttccacttgtgtttaccacgccagccctcgaacttgaataccccacacattctggccttgtgccctgacagcccaacatgcacttcagagcaacgctcacacactttggatgggtaaaccaataggagttttgtcacacctaatctaagcctttcccatgcttctattgtcctctgacctatgaatctaagctcttctggcaaaaaagcagcaggtttttcatcattttctctgactattgcagatgacgtgccactcctatgccaaacttcatcaggtatatctgcacctgcctgatggcagagctcgagtaccgctgggacacgagggaaatcaaacctctggtcatgttttatctcatcctggaacgtgttttccaggtggaaggattcaacagggataaggatgtcattcaagcatcctggaccccatttatgcggctggttcttgatcatacgcttgaaaccatgacaggattgcatctcatgccctacagctccaatatgaacttcgggacaaaaccttcagtgagaatagaaacacaaggtgttagaaagattcaataatattttaggacaggaatcaagaaaatgatatcaaacatgcacatcagagagagctgctcttaacttggcatggcaagaaaagcaatcatggctatatgcaatcaaggtacacaataacaacggtaatctatagaagactggtaatcttgtaatgttgccccatttctggatgttctggaacatttttagtgcatgcctaaattgaagttgatctactacaaataaaacacttgtttagccatactatcttccccaagtgttaagacaaacagacaaatacataaaaattccacatttctcgcccttacttgcatgaatgtatgggaacaacttgaagcagcgtcgagacacctttggtgacaatctctctagccttgactacctcctccgctactggaatcatgcgcttgattggatactcctttgcccggttctttatcctcttgaggatcataggccgaagctgcttccagtccaccctcgaagagtacagcctctgattcataaccgagccacacagctccgagcaaatgtagcccccgactctccgccgcatcaacgccattgccacacacacgcacacacagcagagcacgcctgcaagttcaaatcttgcattagcgcaagaaacgaaccccacccaaccccatatcgacagaggatgtgaagaacaggtaaatcacgcagaagaacccatctctgatagcagctatcgattagaacaacgaatccatattgggtccgtgggaaatacttactgcacaggaaggggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatattcgttaagaccctcactggcaagaccatcaccttggaggttgagttctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcactctggaggttgagtcctctgacaccatcgacaacgtgaaggccaagatccaggataaggagggcatccctccagaccagcagcgcctcatcttcgccggcaagcagctcgaggatggccgcacccttgccgactataacatccagaaggagtccaccctgcaccttgtcctgcgcctccgtggtggtctctgagcgtgtgctgtggtgcagcattggacttcattatacctatgccgctcgtctgtcatatcatcgtgtcatggttgtgttgtgttctggtttagagtccctaagttgtgttgatactattatccatactagtacaatttgcttcactgtgcatcggtaccaatcgatgatattatcattctacttctgttaatgtttctgagatgtttgatccgagatgagattctgtttgtgcattgctcacatggtcgtaaccggccactgttgcgcgtgcctgttgatcaatctgtttgcgcttgacggtttctgatgcttggaattggggtgtcgatgttggtttggttatctatcctggtatgtttgttgatttcatgcgcatttcagtctttacggcttctgatgcttggaattctaatggtgttggttgatttcacaattgggctggtgcggtttggtgcctaaaaaaaatgggagtacctatacatctttcgaaagattttgatgatcgtatcacacagattttgatgatcgtatcacacagatttttaatctttgaattaaaatccgatagatataataaaaagtaaaaagtaattaagaaacaccataatggacactaaattaccatatcctcgagaaaaagaccaaatccaataaaaaagaaaaagaccaaatccaatacaaaatttaaaatttacatgcgaagattcaaaaattacagtgtaacttacaaaagttacaatgtaagtttcataaattacactgtaacttacaagaaaatgcactgtaaatttaagtgagaaaatcgagtgagagataagaaaaaatctttcgagtgagatatagcaaaattgaaaaaaaattggtttgggcccaaaaatggttgagggcccattcggccattccccaatcccaaccatcgcgtcctactccagccgccgctgccacccacgtccgtcggcgccatggccgccgccaaggagctccttcgccggctccagcgaccagcgtccctgcgcggctgcagttcaactgtttttggtgtcgtcccctctgtcctatctctttctgcttcttctcttcagcctaaaaaatttggtcattcccttttgtctgctttccaatctgcaaaagcacataattttttcttcatctccattttttcttcttctccatttaatctttcttctatgctattgaatcataacggtacgtttaatttatccaatcaccttttttttcacactttgattttcatgtgctagatggataactgatggtggtatgactgaatttgattcttcagaaggcctttattggatttatggattgaagccaactttgtatagttcagttttctagcccttttgcatgaaaaatatatttgcagctgctcatttctactgccggttagtagaactgaatctaaatatattcagatttttgctcctggtgtgtttcgtgctcatattattggattgccaaaccctgccataaattcatgaattcatgaattgttgagtctcgggagatcaaaattgctccgaggagggagaaaagcgcgcgcgaatggcgctcctaatgggggcgaaacccaccgccccattatactcctccctgctccagtgctgcatcagctcctgcgcattccggcaaggcaagtccgtccacggcagggtcgccgccgcgtccgcctctcctccggacctgcacctgagcaccaagctcgtcatcttctacgcgcggttcggcgacgtcgccgccgcccgcaaggtgttcgatggaatgccgcacaggagcgtcgtgtcctggacggccatggtctccggctacgccaggaacgggcgcccgcgggaggcgctggagctgttcgcgctcatgcgcgcgtcgggcgcgcggccgaaccagttcacgtacgggagcgcggccagcgcgtgcgcgggggccgggtgcgccaggagcggggagcaggtgcacgcgtgcgctgccaaggggaggtttgcgggcgacatgttcgtgcagagcgccctcatggacatgcacatgaggtgcgggtccgtggaggatgcgcggcagctgttcgcggagatggggaagaaggatgtggtgtcctggaatgccctgatcagggggtttgtggaacgcgggcatgacggtgatgcgcttggattattctcttcaatgctgaaagaaggtatgccgtccctccttttgctttaacaatcttgagcatttttcctgtaatcatgctgcctattatgtcctagcatgaaattgcaaggtagtttttgctgatggtattggcactaaaattgaaagtgctttcttttttttacatcaaaataattgacagcgatgattcctgaccattacacgcttggaagtgctctaaaagcatgtggaatagtcggtgttgctgtcaatgttgagctaattcacagttgcatcatcaaattgggttactgggatgaaaaggttgtcatcggatcacttatcaactcttacgcaaaatgtcggagtatgagcagcgcaagagtgatatatgattccatctctgaaccagatctcgtgtcatcaaccgcactgatcagtgggtacaccatggatagaaactacagtgaagatgcaatggagctcttctgtaaaattcatcggaagggtttatggattgatggtgttctattaagctcagtgctttgcctttgtgcaagcgttgcttctgcaagatttgggacacaaattcatgcatatatgtgcaagaagcagcctatgggtgatattgcattggacaatgctctggttgatatgtatgcaaaggcaggagaattttcagatgccaagcgtgcttttgatgaaatgccctatcggaatgtgatttcttggacgtcacttattactgcctgtggaagaaacggttctggagaagatgctgtgactctttttaataggatggtggaagatggtgttaggccaaacgatgtgacattcctttctcttctatctgcatgtggtcattgtggtttgacaaacaaagggatggagtactttacttccatgatgagcaggtatggtattgatccaagagctgagcattacagctctgctattgaccttcttgctcgtggaggccagttagaagatgcatggaaacttgtccagaagacaaacttaaaacccaactcatcaatgctgggtgcaatgcttggagcctgtaaattgcatggaaacatgcttcttggagaaactgcagccaagaacctttttagtatagatcctgggagttctgtaaactatgctgttcttgcaaacatgtatgcagaatgtagtctatgggaggatgcacagaggacgagagaagtaatagatgaaacaacagatggaaaggaagttggtttcagtgtcatctgaatatgacagaaacttttccactgcaagaaatttgtatcacagtttttagccactgatagatgcatcagatgaacctcaaattctgggccactttgacaagccgcaacacacttcagagttcagactccagagttaaccaatttctgcctgttcagttaaacagtgaatagctcatgacctattgacctatcacaaattcacctgccatcatgttcgttcagtgtaagttttttgttcatctgacttctgtgggttactttccttgataaataattttctgaattgttactgtgctttaaatcttaattagtcccataattgtttaggactgtagatgtgtttttgcaagtcacataacgttgattagacagaataattatgggatattaacccttctcttttaaaagcaattttgatgtcctataagaatatcgtagaaaacatttattaagtattaactagactgtgagttgctgctgaacatgactaaaggggttggcattttttttcttatgtgcatgaacaagtcatgaggtaaaaattggagtactgtttaattcctatggaaaaggtcgaacttgtcaatgtccaccattgttgaacaacttcatggtcaaaactgtcctgcactcccttgctgtttgagtgaagcacacattttgagctaggtcaactaaaaatttctttacctgctgtgaatgtcttagacttgaattcttgaacaaccaaaagacatcacttttcagttactccaagagtaattgaatacattgcccaagccatgtggtagtgaacacttaaaccattgttatctcctgtggtgcaggattttgacaataggggtgaagatgtaatgatgcactagtagatagtatggaatattgatagagaaaattccatgattccattacaacagacagaaaaaaaaaacctgcattgattttttatagggcatctttaaatttcaaaatgtcaaattatgtatattttgaccagcaattaatcaaattaatataattaatatatatttaatgtgaaatttgtgcccatagattcatatttcaaagtgcgttcacaaaatattggctttatagctattaagaatataattctgagaaatcaatggccaatgtttaatcttgaatttttgttttcaaattaaaatatgccctataaagaccaatggaatctaaaaaaataaagaaaaataaagtttgacatgtattacatacaaaatttttaacactttgggattcttatctaagtgcacattgtatacgtacatgtaatcctatatatttggtgttttttcaagttttaggggtgcatctgtacccccacgcactatggtgtccaccattggttctgttcactactcctgacttgttttcaccttttttttattattattctctggagagctcagcggaaggttatcttgagcccagcagttatttattaacttaaaggctgcaactaatatctgaccaatggaccgattttctcagtatgatagggattcactgaaggtttacttacacaaactcttgcattttttattcaaacatagagaatctttttccataacttgcacatcatgttctcatctttcttagagtgtttatatgcttgatcaaacctaaatttgcttcaaaatgaagtatctgcacattgcctgagatgcttctgcacccgtttggcattcaataattagctagcagtgatcatgttgattctcttctaacttttctcccttgatttgcttcattgacacgagcacaactgtcatgcaacctttttttttctcaacttaatttcaaaggaagaagattgatttcatcaaacaatgggttgttgctttgatattatttactttaactgactggtgccagttaagaaattattatgggcagttcctttagtgttcagatgcaatcccaagagaaactagcagtgataatgtcatagcgaggcaaccatattatattccctggttcccttaaatactaacaaaacaggaaatggattgtttttctttcttttccactttgcatgaacatacacaatttcctctggaacaaacgacaacggataaactgatatattatctcatatctttgaatccttctgaacttctttaccagaataaattcaacccatataatatttaaaataaaaaattagaacagctagagagtattaccttttagcaacatgtcgtgacctattcatcaatacaagagcctgtattactcacaagtgcacaagccacgaaggatgaccaccaccaactaattatgcaatattaccaggtaatactatctagatgcctgatccaagacttgcgtattcttcaattgaagtacatgcacacaactcatagggcttgtaaaatctcgatctccaagtcttagaccatctgcttgttgcattaggaaaaataaaatgaagctgtgggaaatggtttatgtcacttgtttactatagtacaacctaagcaactgagctataaagcaggctgcaagttataatttgcctcaacaatcatagaaggcaactctttcatcataggcagtggttccacagtagtcatgcacaacatgccttacagactcctcttcggatttgtcctttctcttgtcctacagttctccttagtattatccaatccaccagggctaaacattggcttttaccaatacacatgtccaaaagcagaggtcattgttcgtgatgagatgaccaagatcatatcccgagttccaagtctcgcaggccctctacttcgcatgcatttccatgattgttttgtgaatgtatgcatactgcttaccatgctctgagctgttttgattttgaattgagtttatcctactaagctatgtgcctctatgtgttttgcagggttgcgatggctctatacttctggatagcacaccaggatcaccatctgagaaggaatcaataccaaacctcagtctgcgaggttttggcacaatagaccgtgtcaaagctaagctggagcaagcctgccctggagttgtgtcctgtgctgatatccttgctctggtagccagagatgttgtcttcttggtaagaactagcttccatgttcattaatcttagttcattctttagttagaaaagttagtatagtttggctaagtggtgagaattggctgttttaggccgacaatagtggaaaaccacacagtttgattttcaccatattctacgtggctattggatttcttgctgcttacagtaactagaactatagttgagaaaagtccctattcttcccttgtgcaacagaccaaagggcctcactgggaagttccaactgggcggagggatgggacaagatcagtgaaggatgatgctgtgaacaacctccctccccccttcttcgatgccacgcggaacttgtatcaattcttcatcccaaagggccttgacgcaaaggatcaggtggttctgctaggtatatactattcttcactaacttcaatgtttaatcttcatagactagctccctagatgatttatactgtacttactgaaagttgcaactctcggttctgttgcctgtgctccttttaaacactctgctgatcccgatatatcccagtagcattctccaataaaggtgatcacttatttaattactatacaacttgttaataaaggaaggtatcatatgcgcataccaagtcaacaaaatgggaagtacaaaactatgtggttcttagttctaatcacatggcacagtacagaaccaagccaggagaccaagaccactttatcctcaaacacagcatagctctttattcgagtggtcaaaacatcgtttcctgttcagcaccatactcatttgtgcacttgcaaaattcatggttttaaatagcgggttaagatatttagcgattgaccttctcaaacagctatagcgaacttaatggagctatagtggctaagactcttctcaaacagctatagccagagattcaaaaccatggcaaaattgcaatccaaacttgtttaattaccaagaactcatcacaaatgtgcatatgcaatttgagaagtgacacattgttcacaggtgggcacactcttggaacctcccattgttcatccttcgccagccggctgtacaacttcagcggcatgatgatggccgacccgacgctggacaagtactacgtgccgaggctgaagagcaagtgccagcccggcgacaagacgacgctggtggagatggacccggggagcttcaggacgttcgacaccagctactacaggcacatcgccaggggcagggcgctcttcacctccgacgagacgctcatgctcgaccctttcaccaggggctacatcctccgccaggcgggcgtcgccggctacccggcggagttcttcgccgacttcgcggcgtccatggtgaagatggggaacatgcaggtgctcaccggcgcccagggggagatcaggaagcactgtgcctttgtgaattaggctgcaaatatatatacaaccgctgaactgcatttgtctgaagtgttagctgtttgatattccttggtatatgtagaattattgtgaaatatgttttgttatgcctttgtttgtattatgatgtacaatcaaagtaaactatttgcttcattcaaggaaataaaatgttgcgtaatgccttcggtgttacatgtttgataagtactgtgatgtaatgtaccgctatccagcaactgtatgattttgggtgttaagtgttactgattgaaatggagaaatcaaaaaacgaattgggctaattatgattctgcattatagcagtatcgacaagcaagaagtcatgtcggctgcagaagaaacttgaggccgaaatatgctcgctggccatttggtcagaaaagtttactttgtgaagtggatattcatggagtgaccctagccaggggggaagaagcataccaagtcattaagctagctccacatggtgtgtacatacggtggcatatctactcggtcaacttctcaaacttaagtctcgcttcttcatcactttccagccttgcgccatactatcaacatctgcagtaacaacagaacttttacatctacctgtatagtagtattaatttactggccttaattgaaatagaaacatgtatttgctagatttgaactgtctgaaaattttcacccaaaattgtacattgctaagcctaaaattatagtgctacgtgtaatttaagttcatttgaactacattttttttttgtaaatggttttgatttatgcttatccaagtttgaacattttttccggtaattttgtaatattaattgcaaatttatttcatgtttatgttagaaaaaatgttgtttaaacttttatctatgaaagaagagtcatttttaaataaataatagaggattgatgagagccattgaaatatatatcatccaagggtgagaaacccgctttaaatttttgaaaaatttagttgcccgaaatcttaacactccttattgcacacctccagtatttaatagaaattgagtgatatattttactgtcgggctctatttctctccacgtatgttaggcgagcgcacttagatcccaaatgatggaggcaactctcgggcaggttgggcggccatctgcactacgaattaccatcgatgtttgtaaactagttgatctttgaaaacactattagctgcaatgattgcaatttcgggacgaatttttggaaatttcggtaatttcgcccccaccagcaagcacatatatctcctgaaattttcagtttttttctcttttttttgtgaatttggtaaaagtttattcaaattcatccaaagtacatcaaattttcaaaaaaaaatcggcctaaaaataccgaaatttcggtgatttcggttctttagccccaccggcaaaagcccctgtttcaaaattgcaaaccctgattagccgtgccactagcttccatgtaatcaaacacaaatattttactaatatgaaatctattatattattaaagaaatagaaaaggaagcctccacgttcgctctcatggcctagaaattctcacattaatcgaagaaaaagaaaaggcagagtccatatagaaatataatttagaaatagttgaaattcggaattaaaaaataaggaatattagaagtggagactagagtccatatagaaatataatttagaaatagttgaaattcggaattaaaaaaataaggaatattagaagaggagactagagtccatacagaaatacaattaggaaataactgaaattcagaattaaaaaaggaatagaagtagagcatagagtccatatagaaataatataatttcgtaattaaaaataagaaatattagaagtacagtatagagtctatatagaaatacaattaggaaataatagaaattcggaattaaaaataaggaatattagaagtagagtatagagtccatataaaaatacaattaagaaaataatagaaattaggaattaaaaaatatggaatattagaagtagagtatagagtccatataggaatttaaaactaactaaaattcggaataaacataataaaattaaaagtagagtttagagttcgtataaaaatacaatttacaaataactaaaatttgaaattaaaaaaatatgggaagaagagtctaaagttaatataagattacaatttagaagtacctgaaattcgaaattaaaaattaaagaatattaaaagatgagtttaaagtccacatagaaatacaattataaataataaaagttcagaattaaaaataaataatattgaaagaagagcctagagtccatataggaatataatttacaaataactaaaatttgatattaaaaataattaataactaacacatatataaaatacaatatgaatattatacattagtagttttgtaaaggtagtacaaaatttaaaattatgtagtcattttaatatatttgaataatacattgagaaaacatatatgctattatatgacagaaaatataatgatgctagccgcgcaatatgcgtgggccaccatgctagttttcaaataaaataagtaggagattagagaaccaaaacacgaagaaaaccggccactgctaccccttttgttccttgctatctcctcaaagaatcgcccatgtacgcgcaacaaaagaaacccaaaaaccaacttgccatgcaacctctacgtatgtacacgcgtacacacctccttaacctctcccgaattccatcttctccggcgatgctttgccgcccatgctttgctgcaccaacgagctccatcccatcgtcgtcgaagctcgccggccgccgcacacgtatatataatacgccgccatgtcgtcgcagccgccgacggccaccgcgggcttcatcgccggcggccgcatccggcgcccgctgccgagggagcggccgcacctgacgcgctgcaccaagcttctctgctcgtggttcctctccctcctcctcgtcgccggcgtgctcctcttcgtcgtctacctcgtcgtccgcccccaccggccgcggttccacgtcgccgcgttcaccgccgccggcgtccagtccggcggcggcccggtggcgctctccggccagctgacgatccacaacccgaaccacgacctcgccttcttcttcggccgggtgtacatgtcggtgcagtaccgcggcgacggcgaggtggtcgtcgacgggaaggacctcaccggcgggccgctgtacgagccgccgaggggcacgtcggcggtcgggttcgagggcgtcgccgtgccggccggcgccgccacggacatgatggcgagggacgctgccgccgccgcggcgggcggcggcggcggcggcgtggcgttcacggtgaaggtccggtcgaggatacgggtgcgcgtggcgttctgggggtcgcactggcacccggtgcacgccacctgcgacgtcgtggtcgggcccgacggccagctgctgccggagttccagcagaagcgatgcggcatcgacttcttctagcttaatttagctagctacttagctactcctccgtcccattttaagtacaattatgagttttcatgctcaattttaatatttcgtcttatttgaaaaaaaatatgataattatttttttatgagataataaaacatgaataatactttattcataacttatgtttttaatttttttaaaaaaaattaaataagaagaatgattaaagttgagtgtggaaaattatggctgcacttcaaatgatacgaagggagtagaaattaaattttagcattagcatgtagaattatttacattaatggaacatgtggtaaatcgatgggtttttggaactatccattcctgacggcgatgcggcggaggagcgcgtcggggagcctcatcgacggaaggctccccggcgtggaggaggatagaggcccagaaaatagccttgtgggctgtgtacatgggcctacaattccggcccatgtaaaaagaaggctcagttgtgtctgaccaatgggccagccccctcccagacatggcatgctatgctagccagaggctagagcccatcgcaagctaaatgaaaagtcaagtttgaattttcaaatttaattttgaagttgatttttaaatatgttcaacataattttttttcagtattagtttttaagttgttataaaaacacatatatacaaattttacctataaattaatttttattctctaataaactatgagggttatgctgttcagctgttgggcctttaaacaacatttacctttacgggatagtgctgaatagtgggccacatcctaaattcggtccattaggaccagacagcaacacgcattgcctacgtaccctcaaacaattcagataagcaggtaaacaaggctgcacataacacagattaattgctcataacagaggatatttgcaacattctcgtcgtacaactcctagttcctacttgacctaaggctctgggctgacctgaactttggctaaacaacggcatacatctgcactacaccaggcaaatgcatggggtgatgggagtaacatttatatgcatacacatctcgactgaaatgaagtttaacagctcccaaatgcttgatacaccatgttggggctcgatcatcagagcggttatccttggtcagaagcaccatcatacactgcctgaaatcttccaccggcgaaagctgcatgcaacccatctcaacagttcactgcagcataccatttttcaagcaattgcacatgaatagattggatgaggatataccagaactgcattgatttaataagtgaaatttcaacagcgaccttcttttgtcatgtaagagcatatagcaaaaagatgtgaggaatcaagttcctaatgagatatcatcatgattatatggacacaaactataacgcacaaacttattaagtgatccaaagcatgcaatcacagaacaagatattcatgattgccaatgggatcaaaatgtttcaattacaaattacaagcatgatctaaaacatcctaaagtgatgtagctgctaagattgcacatgaacatgtaagattctaatatgtacttccatataaagttactaacattgtaggctttggtttctgacattcatctgatcatatagtatggttccaaacttccaatacaggaaaacaaggaaacaagattctggtaataagaaaacatggactaaatcacagtgtgttcacactaccaaaatcacaaagataggatggagctgagtagcaatttatagaatcttaccagttttatctcatccaatctcgagtacaaacaagtgcctcgattgttctgatgtttaatgtactctggtgctttggaattactggtccactgctactgaatgctgcttcagattgaacagcagatgctggcatggctaagatgtcccgtgcaatagttgcaagtgttgggtacttagtactatgagtcatccaccagtttaaaatatcaaaatcatcctttctaggaactaaaccatcttcaaggtaatcatcaagctccgaagatagctgacgacttgcttgttcatggagatgctgatcccaatcttccaacgaatcattatcatctgcacacaaagcttcactgtttgaaacaacatcacttgcctgattcaaagaatggcagtattcattgaagagttcccggactgtttcacgtattacagataggtagcttgccgaatctgttccaaaagctcgtttcagacgaaactcaatgaaactgaatttgaatctagggtctagcacaacaggtatggccaaccacaaatatgaattttgccaatactcattgaatgcttcctgcatcaccatagccactgtagctatttctctgtgatcatttaatgcttcttcttgcaaaactgtcctgactttccatatctcgttaaaatatatatttgctgtcggagagctagggctggaaataacttcaatgacacgataaattgtcctcaaaatcttgcaaacggactcagcagtttttgtatcttctggggacaccctttcttcagaaggaaatgacttcttgaaatgcaaaagcacttcaagtctaaaataaagtttgtgccaccacttagcatcttcttgtggacactttagacccgtctgtgaaataacttccagaagctgctgctgggtcaatgacactaaaaaatccattactatgtcaccaacaagacgaagtatatctgcttgcactttgaaaacaatactgttaaggacatagtccacacaggcaacattgaatagcgtccctccaataggaaggcacttcttctctataagcatttcctttagcaatgaagtattggtgtcacccctaacttcaccaacagaagtcaagcttaaaagcttctgatcaagattccaatctctaatggcatccaatatgacattatatgatccgctctcagactctgggacacaggcttccatacaatgtatcatcctttccaaatcagcaggcgcggaccaaaacattccaaattttattattatcctatgaactttccagtcttcatcaatataatgtgctgtcaaacagaggtaatttactgttgtctcaggtccatcaggagtccagatgcttgctgacagagagacacgtcgggaaaaatgtgcaattttaccctttatattttccttttccttctgaaatagtgtcaagcaatgttcttccatagcattgcgagagactaaattgaccacagggttgagtttctttacaaatctcatcatttcttcgtgctccacaattgacaaaggataaccatgcaaagctatcatcccgactaggtctggatcagatgtttcctgaccagctggagtggtcacaaatgaggtcctctgtttcatcaggcttgtataatctggagtcggcacggaatgctctgctggtaccactcgaatgggcttaggggtcgagtcaccagagctacttgccctcagaagcttgctagagtattctgcgatctgaaccttcccatttgtcaaggcaggtgagagctcatcttgcaccctggacttcaaactaggcacgctagaaggataaaataaacccttctgatgaatttggccccctccacgtccacgtcgtcctgcacaggttataagatgtcgactcagatggcttctccccccgaacttattcgcactgaggcgcttctggcagtgaatgcaatctgcagcctggagtttcccctcaatatagacaggtgtaaactccttccacacctttgacgtgaatctgttaccgctgggtgttaccgagtttatatcactaagcgtctctgtaataacatcattgaccggatcgtggggtgaaactggatcgttctcattcaccaaaactgtgcatataaaatatggaaacgttatttatattcctgaggtaaatcgcctttataaaggaatatctacatctcaagatcctaaaccacaccaatgttaacttatctacactattgagtaatgaatgaacccagaataggcaagaatggtataccgcatgggaagtaggaatccttctgtcgcctctgcgccgcttcctccttgccagggcagattttctgatgccgccatagatggcttgtgccgttggaatctttgcagctgaggcgattatggcagtagagacactccgcaaactgaaccttcccattcagaaagatgggcttgtactcctcccaaaccttggaccttttcttgtgcctgtaccggaacgggctgtgcactccatcaaatgccacatccactttcatgctgttatcctcctcatgctcctctccaggaacaggatgctccatagtgttttggagtgaatcatgatccattcatgggcggatctaacatggggcatggggggttcagttcaacacccccaaactttttgggaacaaacaaacatcaaggttaagccaaatttctgcaacagaagctagggttaacgcaaattcgataaaaaaaaagagagagggagagatgggaaagaggatgtgctaaccaggatgcggcggaagcagcaggatgctcgctcgcgggatggatggggggatcggcgcaggcggcggcggcggcggcgaaggatgtggatgcggcggaagcagcaggacgagcggcagcgccgcctctgctcgctcgcggggcggatggggatcggcgcaggcggcggcggcggattgcctctctaaacccgaccggtgttcgaaccggtgaatgaatccaccgattcaccggttcaaccatcggttcaataataaaataataaaattatatattttattgagagaattttggtttaataatcaacataaaatatatatttgtttcgttttctaaaaccattatagcaactaacctaaatagtcaggtgcgcacgcatgtatgcaaatagaggtagcaacgagcccaactattttgattagaaaatttgagggttaggtctaaaatacgatgcgttcattttttatacatttttggtatgaaaatatttaagggttatgtaaggttgtgaaagaacccatgggccttgaccgtggggggttcaatccctacgccaccccaattttccttcggttatgtagtaaaccatctgggtttaaatgatttttctcaagtcagttatatcttcggactaggcattggttttggtttatttggttaaacccttggttcagttcgatttttacaactagactattgagatgccactctttttggatgaaattacaaaaaatgtcattgaagagtaaatctttacatattgccaatttagcatatgtaggacatgtcacattgccaatatggaggggcatgaaaatgacccatttgccttcgtgtatattgagtatgccgataaaatacacctatatacaaacatatatctaggtccaataggtttattgtacttcaaatatttttgttacaaatttatcccctcatatcttgttctcattactaaaatttttgcacgggataaatccatacaaaaaattgaaacatgacaaaaataaaggttcactgctgatattagtactaagtgagatatcagaggaaaaacttgctcctctttttcatactataagtcgttttgacttttttacaaactttttaagtttgatttaatttttaagaaaatttagtaatatataaaagactaaattagttttattaaatctagcatttagtatattttgatagtatgtttggtgttgaaaatgctactatatttttttcctacaaatttggttaaacttaaataagtttaactaagataaaaatcaaaacgacttataatataaaacaatataaaacagagagtatattggtagtacatatgttctttttgaaaattatttatgtatacatattttggtcgcaaaacacccagtccaccagtagaaagatggtgtatgtgacaacagcaaaactttgcatatgatactacatgagtcacatacagatgacaaaaatgttattcctaatgactgcacttgaagttttgaacacagtgctacatgtgacattccagctacaaaattttatatttgctgcgtgtcagctcattattccagaatccacctgtatacaccccaaggaacataaagatgtacacaaaaagaataatgaagaggaagtacagcattagccacttccaagttttggactgcacgaacctatacacaaaaaactatgtgcaacttagatcaaagttctcaattttgtcaccaaggattgcatgctctctagcttgtcattcaattgcctgatgtcttcggcgcatttctgatcctccacaccgctcgcctgggaaacgagggctgtacatttggccttggattctaagatttcgatttgtaatgaagcaactgttgattccagtaactctttcgttcctgcatctgtagttgagtgcagattaggagtcctaggagtacctatgctgccaaaactgttctgcctgctcaacttcctaggtgaaaaagtattgtcgattcctccgcttcctgggacatcacaatttcataagataatctaaaattgttttgagaaaatgaagtaggtaagcattttccaaaaaagaatcagttttaacagcataaattgtacgagggaatataaaaatacagtaacataaacaagaaagaaaagcaatggcatataaccaaataatagtgattgctgcataatttgctgaagcacaaagcatcagatcaaaataactcccaggtggcatttgttgacagtatacaccaaggcaaaaacccccgatgaaaaatttggagacagttttgtcttatctaggattgttttttcgacttgggcataaaaaaccgtaactagatctcctctttgcagcatttaatgacccaacaaaggagttagataaagaacactctatttcatattataaatcgtttaacttttttcatagtcaaacttctttaagtttgaccaagtttatagaaaaatataatagtattttcaacacaaaacaaacatattatcaaaatatattcaatgttagatttaatgaaactaatttgatatttgaaactaattttttctataaatttggtcaaacttaacaaagtttgactatagaaaaagtcaaacgacttataatacgaaacagaaggagtagctgatagcagtgtattactagtaaaaattcatagcaaaccaaaaaggagcaaaagaaggggaaaagtccaaaacacagggtagcatggcatctacaagaaaataaatcagggtacatgtagggaacacatacctaggttcctgagttgttctatagtcccctggccaagagacttatcaagcttaaggagacggagaattccagcagtgatcctccccattgcatcagcttcagatctacaaagcatggtgagatgctctaattcttcttttgttgcaactgcctcaatctgccgagtcaaacaaacagaactagttcaggaagcagttgttaatttccgagaggtttggacaaatattcagaagatgttcataccggttcttttacagaaaacttgacattatccattgtccacttgggaccttcaatctcatcttcgcaaatgaccatggtcgcttcaacatcgacaccttggtcaccaatgctacttgtgttatcaaaaacactgcctgtttgaagattatttgatgttgcatttccaattagttgatctctcaggcaaggttttattgcctgtaaaccttcaattccagcctgcaagtgcagcatagtgtctcagaattgaactggataaaaaataaaagtgccacatagaaatgcaaaagtatgaaaataatccactacataccgtaaaacgttctattggaagggcccttttgtgaatcaccttctccgcagatccaggccgatcactacttctgcctgacacatgtagattcgtgaatgtggtatgccaacatttctcttctctactgatatgatcactgccatgaggcgataaccaatctcctacttcttctgtgccttcaagggcgaagagccagtttcgtagctcaattgacacatcaagatcatctggcacctccaggtcaaacttcgaattgtagtcattgtctttggaattgggcattccatctgcaattcaaggggaacggggaagaatccatgaataatacaaggaaaaacagcaaaaatatctcgcaactgagcagaagcaatcaacatgcatgcttaccaacaaaatttccagcatgaattaacaaattaaatggcaaagacagaaaattcactaccttccttgtcggtgaggtgagatggcgagaatagtttcgcaagtggaccagaggataaatctttcagagtcctcaagagaccttcccctggaccaccatcaggcccaaggataccaaatcgatgcagcaaagattcagtataactcattccaccaccaagacgaacaccagataccttagctgatacactcaagctatggcactccatgtcccgcatgtcataaggcattacgtgagtgatgtctatgtcaataaatcgagcttctttagactggttcttattccggtggtcaacccaaaacacagctctcatattgggatgcccattttcatgcaacaaaatattaggttcaccagtaactgcagtgccattctcaccaaatatagcactttctccttccaaacaattaactgagacagttttccatgtcaagttagttgtaactgcaaaggcaccaccaagagtgcgatgagaaactttcaggtacagatcctcaccaccaaactgaaccaggggcaattgtaagtcatttgatgataaagattccaagaaattgagttggagactattcatagttaagctcactgctgtgtcactaggcagttttctctcacgtttgtcagctgatgtctttgtcgcagagcagttacctttgctaacctttgaaatccgttctccaacctggccaaaataagtgtagagacctaacacaaaaaacaactgctctactgaagtatggttgtaaactgttgaaaagcaacaccaatcctcacaacaccctctgggggtggcacaatcaacaaagggctaccatcagctgtaaccatagctgcctcaaaccggatgtcatccagctcaacacatttccacaaacttggagaggagcccctaactgttctctgttcattcgaagtgctagaggtttcaagtgagaggcttagatgagaagctcgagtagcccacttcctctgacttgcatcaacaggttggtacccccagagaaggaagcaagctggatctttgtcaaggtttagcaacagacacttttctgatggtgactcgcagaagtatagattttccacatgaagtcttgcccccataaatgatgattgcgggcaaacattcttagttccactgtacctcgtgatttcctcagcatctaatggaatagagagatcaaattctttaatataaaatgacatactgttgattgaagaatcaggcaatatggcactgcggttggccacaactccatcagccaagaatgaggcaattcttaagcaggattgctcctggagggttacctaggaatgagaaagtatgggcggtgtttagttaagcagaaaaaaagggtgagcattacttcactctcaatgttaaggagacacaccataagaggttcacatgtgatgacagtttttgaagcaaactttggaggtaatggggaaggagtgagctgaagacaatagagggaaaataaaggaattcctgacgtgaattccaattgctgattctcaaatggatggatttgaggacaaaaattttgacctggcaattcaataggaggcgttagacttgaccaattcatttatctcagcaaaggtatcataaagtcttaccaaagtcaggcacaggtggaggttcttgtggaacagattgcatagagggctgtatcaatgtgcatggtggacgagaaaatgtgtccctggagaaataacatgtcagtacatgaggatcgaacagaggttcttcaattgctttgatagctcaaacaaaaattctagcacaggtagaacacaaattcccttacttacgaaaagttaaactgtgaatgtatcctattttgcaccatatgcatcttttggtaacctagcaatgcactcaactaaattctgttgggcttaatgcatgtgatacttataggcatcaacaaaatgcactgaatttagtatgtattgtaactgagcaagtgaattacgatgaacttccaggtgcatataatctccagtaaaaaggactcaaggatgcacgtactacctccgccccctaatataaggaatattcactattttcatataacgtttgaccactcgtcttcttcaaaaaaatttgtgcaaatataaaaaacgaaaagttgtgcttaaagtactttggataataaagtaaatcacaaataaaataaataataattccaaaattttttgaataagacgagtgatcaaacagtgcaagcaaaatgtcaaaatcccttatattaggtgtcacgtcctgataaattcatcccgaaataaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaatttttacttgaattttcagagcaccggaaatatttattaagcaacaacaacaattaagaaagtttattaaaaagaaaactaaaaataatcctccttcctcctttgggccgagttcagcccaaagtctttctctcctccctcccttttcccttctctctcgggcctcctctcccctcggaccagctccctccccctcccttccttctcccgggccgcccctccctcctctccttcccggcccactccctcctctcgttgctccgtcctcgtcctttcggtgttgccccgtgcccgttgtgtggttgtcgaccccagtacccgtgtaccggtgtcggtagtcgttcgtgtgtgcgtgtggtgaccgtgttagtgtgcccgctcggtagccgcgtggtttccacgtgtgcagcccacgtggtgtctagtagagtccgtttgtcggccacttgcctcggttaacacacgaggtccgctttcgtcgacccgtggactgtctctgtgtacccggtccaccgtggtcccttaggttgacatgtggggtccgcatgtcagcagcgcagccttcttgtcttttccaggctagagcttacacatgttttatagttgcaaagcttaattataataatccgcaaatctccatataacagcattaaacttcggatgaccatgccttggccatacgaactccgaatcgacccgttcaagtctcttaatgtttgttataacctaaagaaccatgtgctttctttttatgtattgttattgcttctttacagggttgtagctttgcttgtgtgcttcgcgtagcttctgtcattccggaggtctccgaacacacacctccccctctattcaaacctcccaaaatggttttaggttgggctcgaggtgcatggttttcctaggagcacctcggccaccgtaaggaccagtcttcgggcctctattgcaaagcactactgtactaaccacatgtctaatgggtaaggcttaactcggtgctcagtctagtcctggcaagaggacacggatagagatggacgaaatcggggctcgatggacatctctagggcaaatgaaggctacacgggctgcggctcggtagtcgagatgtcatggcacagggccggtgttctgctgctaggggttcaatcctagcctacctatcccgggattctggccgtaggcgaggttgggtcggtgcttttgtcatggctaggatgggtaaaggggttatgtcacattctttatgacgggttccacggccatggaatgcggagtaaagatgtgtcttgtgggtaaagatgtacacctctgatcagagtataatctattcgaatagccgcgccctcgattatgggcaagcctagcaatgtacccaagttagtggtttaattcttaaaacttgcttaacaactaaaatgtggaatggttggcccggattggcttgggacgagctgggacccaggtcgggttgccagttcggtctgaatcatcgtacgccttgggttaaggcaggttcgtgtgggttcacggtcttgattaataatattgtgtatctctaggatcgtctttacaaaatagctttgagcaactaagtgtcttttaaatgctgtttactgcaaaacttaacccctatattattaccccttgtacccccttgcattaatcgtgcatctcccggtgtggcttgttgagtactgtagttgtactcatccttgctctatctttccccccttcagtaagagaagctttggagaagatgtcctaggtggagtcctggcttataccccagttgagcgcctgtgaagatggagccgtaggcccgctagtccgctgctgtttatttttgattgtcaggcctaaagtgcctttgtaataatgtaaatattattgatataataaagatgtgccttttgtatcatgtttgtgtggtgtaccccggcttttcctgagacggggattaatacactagcgtttgggaaaaggtaatttttctcggtcacgacattagggtacagagggagtaacatatagtacctcagaaagagcccggcaatctttatgcaagacaagtttcttgaaatccccccatcgggaacacttgccttcaacaaatttaaaaacgattgtcatgacatcagtacaataagataaattacataacctaaatcaatcatatcatcagcagatgacatcagtacaataaattggaaggtaaagaaatttacccgtgagaagaataaagactgcatcagaaattcaagctgaaactctgttgacaaaatggtttaaagtcagaatagaatagtaaacatagcatatttgaagttttccagagctggtacataccagcatccttaatgcagaggaatatatgatctacaataatggataccaaggaagatcctgcagcttctgcaagctggtcaaaaaagaaaagcagaaaagaaataaggacacaaagaaaaccaataaacatcctacttctgtactgcatgcaatgcagtgattaaaatgcatgatggaaaaggcaaacctgttgagcttttggatccacatcacccctgtttaggcacacagataccccggtcatgaaccgaagaaaagcccgcaaacctgaataaaatagcattcaagctcaaataccacttcaaacagcattcagaaagggaagggatcaagcatcatgaaaagtaaccaaataccaggttcacttaaggcaggacagagagcttcagtaatatgcagctgaacttcaagcccaacaggattgttttgctctgttcgtttgactgtgatctgatgttcaaagcaatgtgtaagccaagcacacaaagagggaagttcaagagaaactgaaaagaaaaacatcgagttccatatgatatgtcctgaagttcaaaagcactcacgttggcctccccagatattccttccaaaaatctttcaccaccaaaaaacattcgttttgcaccatcatcatctcgttttccatcttcactgctagaagagttaaaccgagcatccgtgaacatgtcaggatgaggtaacagatcaactgacagtgattgccattccaatttctgtgaatttgaaagaagaaatgtgtgtggtcataaatcctttcaagtgtagcatttctcagttcattatgtttccaatagaacagttttttttttaagaaatgtcaatagaacagttagcaacataaataaacattaatcttctggagagaaaaggagagtaccaaaccttaaaaatataaatgaatcctttattgttcgaaaaatcccttgcttctttcagatttacagcctatataaaaggcattctaatcaggtactgaagtgcaatcatttactatatttaatgctaatctaatttgcaagagtacctgccatttttcatttgtagtgtacagtacaagatcacgaaatgtgatagccgctagcggtggtgacctgaaaaggaaagatggaatgaatgttcctgtttgcagaaaaacattgcagggaaaagctacatcatgaaacagatattaataagagaaatgaacaagaactgagatatggagctaagccataagaaaaagggccaaaaatcattcaaacaaagatgaataccaagttgcgcctccttgatgacgtggaccaccatgtgtttctaatagaaggttcacaataccgacttggactgtcattccatctgcaatctaaccacggtatagcaaattaagccctatccatagttcaattttctgcacgtattttttttcaaaattgtatatattgtaataaaagagcagagaattgcttttcagaatatcagacaagatcacataagaatatagaagaattatcaaatcagatagcaaaataggtgcattggatgcaaccatcatggataactggaagtgacaatttttatttttagacagcatattgaattttttacagagtaaaagtttggaatgtgtttacgttgaacatcaaggtcaaagaaataaaccttatcagcatatccatatccgctgtttttagctggtgatggcgataaagcactgcaaaccaaaacaaaatgacagagaagactgaaatcagtaaatgactgtgctcattcaaccatatgagaccagagccagaagaatgaatttgcctgctagtgcttgaaagatcttcagaattgtccttctcaacaagaacgaggtcaagcttatcaatgttcaccacaattggttctacttgcacatttgacactgatggaagctgtagcaaggaaacgaaataagcttatcaccaaaagttgcaagtacccaatggctattcaataattgcctgaagctttgaggtcaatgctaatggagtatagattttaattttccaaatttacctgagatcaccacccaaccaaaacttgcaataaccagatgcgcaaggaataccaagggcagctttatttctctagatttttcacaggtatggccacatgataaaaattaatgggagtccaaatttcatggcattgtcaagacaggtacaaatagctgcttcctaatcatcattcacttagcctcccacacaaacgtttcaaacccagagctataatctatcacatgagagcgaaatcacaagttcatcacagatttctaccacgcagaggcgcaagtaaagtgcaaaacaatgctctcccgaaaatcatctaaatttggaaaccaaacaataagaaatctaacactaaatgcaccccttaagccttcagggggagaagccgggaagagtaagcacactgacatatacaaaggcaccgggtcagggctcccgccattaccgtgatctggagcttcccgactcgcgcggtctcgacggcgagcgacggaggcagcaccaggctcgcgtgcaacgcgtcgccattgatatctgcatcacccaaatcacgcccaaaaaaaaagttagcacccggaggcgaccaaattggcatcctcaaccggagaagcggatcccaaccgagattggagagctgcgcggtgcggccctgcagcttgaactggtcgcgggagaaggacttgagccagtacttgagcgtgtactccagcgcccgcgctatgatcgactccatccccgccttccccccgcccgcgcttttacaacgcccctcccctgaatgctccggtggctcttcgtgccgcgcgcgcggtggcggagggaggggacgccccttctcggtgtcggtggcggcgccgccgccggatcggaggtgagattccggcgagatggagaggtggaatggaagagaaggtgaaagaaaatgtggggccctcttttaggtctgagacttcctttcgccttaagccttttttatcttttttttttcttttgttttgttttttgcaaagctgtagtaatttgacaggttcagattcgcattgttttgtaaatgatgctcgtgagatcaatacccgtgtttaacttttattggttttaataatttgaagtacagtggacgtgtaaggcagtaaaacatgttaaaatctggacatgttaagacatgaccatttaactttaattagttttaatttgaagtatagtgagcgtgtaagttgctttaaaaatcatattaacttatttttaaaataacatgattaattaagtatttgttattgttttgaaatatgaattaatgtaagcaacttacgtatagaaactttttttaaaaaaatacatcgtttagtaatttgaaaatcgtgcacgtgaaaaatgagttggtaactctctcgaaagaacacagcattgttctctcctctattgtcttaagctttgtgttttcctctcctgttttaattctctccaactttagtcaagcgattggccatgatttttcctcgtttgctgttgtaacatcagtagaccgaaccgacgcttgcacaccttactgctcatcacagtttggttgtaccataatcccttttccacatggtaatccttttctaaatattataattaactcagtactgccctacaaaaaagtgatcaccaaaccatgttactacgctccaaactctcactggcgagtgtgcacaaaagttaaccgaaaccttcaataaaaagcaaattaattttgaagcaattacaacacatcacactctacattattcgcatactgtcaaatcgctggctataactagacgaagcttcatctcgtggtaaagctgctcgcctcgaaatccacaacatcatctccaactcctcctctcgatgatgattaggaacagaacagtccgggtaaacaaaaattatttacagcttaagacagtaattaattacctgagtatttttttactgacttactgtgactgtcgttgtgaggaaacacagatcgatagatcatagatctgaacttttgttccttccttcccagtgggagcccattcttggatgggaccaagaacaaccgtggcacgtgagaaagggagagagatctgcacggccagaacatcaaagtttattattctcactcacccaactcttcaagcagagaataaatcgcagagaatcacaatgattattaacttaacctatgccaaaggaaggtagcgagcgagtgatctatgcctgtccgtgtccctacatgtcacctcttttatgcagataaagtgaagattttcaataattctacgattaaggaccgtcaggttggtgatgccaggatactgcaactgcagcccatagcatctctgaagcctgaaatgagaagattgcagaattttgcaaatgcaactgattctctctgatcaattgaggagttcaaggtagcatgtaggccatcatatgatacaatgcatcatgtcaatccaatcaaatcatccagagtttcaggccagtgaatggccaagaaaagcgttctccagaattgagccaacagtcacctgcaccatcctgcagaaagccataataaaagcgaggaggaaggaacagagaaaaaacggctgtcatctttcagaccggagcatttgtccggtgtgttttcagaattcagacatgaattccggaggtcagaaagcaccagccccccatctgcttaattacttcgtccccaccgttccgatcttttaatttcatggagtcattagcacacttcccaagttgacatgctcgcttctccagccatgtgagctaaagcggtgtggagaagacaacctgacatgtgatctttcacatcttttttttgcaggtgttgttcttcggattaccgggtagtttgtccatgaactgtgttcagtgataaacttcttctggagttctggagattgtgaagtagttgatcctacattcggtgctcgagcaatagcaaattcgttccagctgaaaagtataaactcatgactactgatttctgaatattttgggtattcacctctgaactctgaagatattcagaacactagtgcttatcaggcctgaatttatagtgacaccactggcccatgatggcataaaaccatcatttggatcacactttgattaggccgtgcagccccaaccacaagtccaaaactgaccaagaaaactttgatgccgcatgcctaacaagtagagtgaaaggttttcctttttcttgactgatagaagagtcaaaagtttgtgagcaaaatccttctagtaacccaaatttcagtcagcggtgaacgcgtaattagagcatgagagggggacttaaatgaaccaagtgtccaagtgtgcaatttttaaggggaaaaattacggtagaattcagtaagtggcgatgacgaacggatgaaaaaaaaacatgagaataatatgacatcaataaactaaatatacatattttttcttaaagtttatcgctttaaaagttgtatattttttaacgataaactgtgctaaaattatggacagcaaagagcggtgagtgggagaggatgagcatcctgtccaccactcctaaaaaaccatttcggatcacgattttggcacggaatgccgacaaaatcggaaataagggttgaacagtccattctggtgttgtctgaatcgcgaaacagaaaattccgttcctaaaatcgaagagagacagcttcatcggacggccacggccccaccgccgccgcatcatccaccgtccgttcccgcggttaatcccccgccaaccaaaaagaggaaaaaaaaaagcgccaagccgaatcagctacagggctacagcttgagctaacgcgcgccactccacgctgtcgatgccgtgcatggccatggacgccgccgcggcagcgggcggcgagatgtcgcggcagaaggcgacggcgtcggctccgccgccgccggagctggacatggtggcgcgcgccgtgcagcggctggtggcgcggaacgacgcggtggaggcgctgagcggcggaggggaggcggcggcggggctaggagcaaggatggcggcgttcgaggcggctaggggcgcgccggcaccgcgcatcggcgtggcgcagtatatggagcgcgtgcaccggtacgccgggctggagcacgagtgctacgtggtggcgtacgagtacgtagacatggggagcaccgccgccccgccgccgccgtcgcctcccgcaacgtccaccgcctcctcctcgcctgcctcctcgtcgcctccaaggttctcgacgacttgtaagcataaatcatctcttcttaattaacctctaatttactcgttcgcaagtaaaatcttacacataa

SEQ ID NO: 37722 - DNA, 2566 bp, Oryza sativa
gtcttggagaagagagagagaatgagagatagaagagatagaagagagagataaactgacaggtggggcccacctattttttaataaataaattgctgactggaccgccagaccaaaacccccgcggatttgggtcgaggggggtaattcgtccggtttacatagttcagggtgaaaaatgtccggttttgtggttagggggggtaattcagacgactgctatagttcggagggtaattcgtactttttccttatttttttttaatggagtagactttgcaaggcatggaaatgaccgagggttatccatccttttcttgatgctcaatttaatcctttggccatcaggtcagtaggtggttgccctacgtacgtattcttctgatactgacatgcgtatgatcaatacagcttaacgtcatttttcgcgtcagtaatcgatcattagtgctagtaccatgtgtcatcattcgattagtagttagttgcatttattcagcgattagttgcttcttagttagtacttacactgtgacagtaacctagtagttgggaaatcttcttaccacttttatgtacatacactcgttttatgcctgtcactataaaaaattaaaacattttgataagatatatcaactataaacatacaatttaaaattcgacctacatatagaaataaaaaaattataaatatgacaataaaaaattatgtactattagcagtttagatgtgttgtttttctctatttgtatgtcagaactagaattttaatttgaatgtttctagagtgaaatgttatatgttgatatttttttaaaaaaaagagagtgactttttagttgcatgagcgtagttccactcgagtgaggaaaaaaaaacagtttctgaattagtggagtatactgtatacttcagttctgttgggttaattaccattcgcgcgcgtgtgtgcagccaccacaacaacgcgttcttcgcgcgcgtcggcggcgtgagcaacgcggagatgaacaggctggagctggagctcctcgccgtgctggacttcgaggtcatgctcagccaccgcgtctacgagctctaccgcgagcacctcgagaaggaggcgcggagggacggcggcggcggcgacatgctcgccggcgcgtcggccgccgccgccgccaaggcggggagaatggcggccgtctcgccgtccaagctgctggaacgcgcggcggtgaacggcgccgcgcagcacgacgactggaggagcctgggtacggcggcggcggcggaggcggcgaacggcgtgcggcggcacaggtcgtcgtcgtcgtcgcggtattccttcgattgctagtatagccagcgttgccaaagagcgcgttctgtgtgtatatatcaggttatcaacgagagtttttgaggctgtaaaaaaattaaagacggattaattacctgccaaagtgccaattagcaaatgtttgccatacacgaacattactcgttgcctgttcagcaattcagcaatgaaaatgaaaatctggaacaatcgtcgagtcgttgtagagttggttgtttgatggaatttcttttcatgcattaaacaacctaataccggatataacatattctaatattatgaatcatgttgatttttttagaacacggagaaaatatacatgaacacaccaccatcttgtgtaaaacggaaaaagaaactgtttttttccgttctttttccgtgtgtcaatgtgtcgtaaaaacaccatctaataacctcgcagagaaaaaaaccacagtacttcaatagtttgtacagaaaacatgatggatcaggctaagtttgttgaaatcaaggtctcaaagggaaaaaataaagaggaaatcatgtaaagctcataccgaggagtacaaaattagaccaaccatagaagaaaaccaactcatcaaatggccagtttagttccccgccaaaaaaaaattttacacatgtcacatcgaatgtttggacacatgcatagagtattaaatataaataaaaaaacaactaattacacagattgcgtgtaaaatgcgagacgaaacttttaagactaattgcgccatgatttgacaatgtgatgctacaataaacattttctaatgatggattaattaggcttaataaattcgtcttgcggtttatatacggattctttaatttattttgttattagattacgtttaatactttaaatgtgtatccgtatatccgatgtgacacgttcaaattttacgcgtaactaacacacccaaagtcatagttcgagcagttggttggttcaaccatgaagactgtgactgggagtaaaacaaaaaaaaaactgaaagacctattaccaaaaataaagacactcttcaaggacctaactgcaaaataaccgtctcctaccacgccgcaagcaaaaacaacgagcttccctctcctccgccctcattccctccgacatgtcgcagcccgccccctcgtagaagagacggcacaatttacacttcgccccctccaaatcttctcctcctcctcctcctcctcctcgc

SEQ ID NO: 37723 - DNA, 42070 bp, Oryza sativa
cggtgttatgataatctctaggttttcctcgctgtttaggaatatgtggtggtccgtggtgtaaaggtggcgcgccttgcttgattgtttgtggaaaaggctagtcttttttgtttggaactatattttatactgtgcccattctactattgtttagttgttattacatacatatgagttcgaagcatcgatttggtaattcgttcttagcagctgtacaagctagaagctgtagtaaatttttaggcgtggattcgcagttcgctaatgatatgtctcccttttgggaaatgtggtcgtatttgggtcattgtgatagttgagattttgatgtatcctttaggttagtaataggctaatagtgctgcgagaaatagttactatgtagaagtgttggttggccagaaagatgcaaacttttatgatggcttgctttatgtgatatcatcgaatgatctacttacctctatagtcagttaatgaatcactaaataattcgttaatggcatgttgtcgttttgtaagttctcttgactgtagtgttttacaacgctatttccaagaactcggtagtaatacaacgtgcagatcctaggctagtaatggatgcaagcacaggcatacacatgcgaacatgacatgtgcatgcacggcgaggtaaaccgatttctatgctcagaaatctgcgctacaacgtcattaaaacgactttaggtatcaaatcacgtgaaagcacttaaaagtgccgtagcgctcgaaaatcgaccttctgggccctatgttgcaacttgcaacagcatgagcattcatattattccacaaaagattgtacttggtgtcaatttttaatcccttgtatcagtcgttgttgtggtttggatgagtgaattggtgccattttttgtgatttctcacacacaaagtccgttttattaattcttgctacaagaattattgaattacttcaatcttctattttagaaacttcgctcatttactacacttgccgcaattacaatcacacttatctttgcctggaaactgttgagagctcctcaagagcaacctcggaggccacgtagacgcgttgctccatcacctagcaacaccagcagtagatcacggccaggtgctttgacctcaacggatgcttgttcatcttcagcagattcaagagcacaggaagcaatcaaccagcttttccagccagtaaacgtattgcctgtttccttttctgaatactgaaatgatgtatctgcttttaggatccttggactgatagtttgcttatattcttctccagctgactcttgagcagcttgttaggcataaactgagcgaaggacgaagggtattttgcaagcaactgctttcacacctttttttttcacgaaatttaaagttttgttataccaatgcatgtttctttcccatgtgtgaattataatgtttaggttacatgccggttacttggtgtgattttggaggaaacaactccagaggagctccaggtgagcaaaagcgctgctgcaaaaaaaatttcctgttttttgttaacgaatttaatttagcggaattatacttttttttcagaaccatgtcacagtgagaccttctgtcctggaggttcttctagaaattgcaaaattctgtgatgtctatctgatggagcgcattcttgacgatgaaagcggagtaagtaataaggaccatgcattttttctgttgcatttatgttttacgctttacaagtatgctcaagacttgatatgtcaatatatactgatatcggcatatgcacgcggaataaacagtaatcaatttaccattgatatcggaataatacgatgaatgaacaactacctggtctgctattttatttcattatgttcaggggttctttttttttttaaaaaaagaaaagcagaagagtatttttggaatcatcactatagacacactgcctagtacggaatttgaatgagctattatagcttgacatcagcacaactgaataatgttgcaggaaaagcgtgttatctgccctgagtgaagctggactttttacgaacagtggattgataaaggacaaggtaagccgcatgatgaggtcacttcagaaatataactgcttaatcgtttttttttcatttgggtatagccattggatgttcgcaatggaccttatgtaacatttcttcaaatggcaggttctcttctgtagtacagaaaatggccgcacctcttttgtgcggcaactggaacctgattggcacattgatactagtccagaaattgttcatcagctagctgtaagtcacaattttaacaatcaagtatcatacttatagaagcaggttttgagttgctatgctcccttgcagaggtttatcaaatatcaactacatatttctccacaacgagcagaaagagtagcatccaatgttttcagctctacaagcttggaacaattctttggaggccttgatcagagatgataatatgaggtagagcaggagagaatttattatttgacatgtgcatcggcgtgtttctcatgaaattgatagcagcacctgtatatcatcaccaaatttgacataaaacctgtatgctcaaccgaccggaagacatgacggactgaatatatgtactgcacaattctacacgccgttcctctaatttatactgtctatctctctgcaggtgagctccagcaaacaatggcatagcgagaactgagacgaacatcattgttcattttttttccttgaatgatggaactcgtttttcttgtaccatgtgtaaaagtcgtgtcatgttaaactggttctgcaactccccataagctatggaaagagatagcatctgtagcataatccatgtatcaattgtgttcctgtataaccgaaatacttaaaattgtcatccagttatttgttcggccattcatcccagaaatgtgttattttcacaaaaggaaaaatctcaactgaacagaaggaataaaaactttctgcagcatccaacattagcacagcaaaatccagcatccactcaaataagtacgtatcatatcattctttccgcatatcctatcctaacatttttggagttgtcaaaatctcaattgcatatcctagacaaaaaaaataaaataaatggagtcgtcaaaacttcaattgcatattccacaccaaaaaaataaatttcaggaacctccaaactgtggatcttgttcagttgggcttttcttcttggcacctagggcacgtacagatgaatccataatctgcaagctccgcctgcctctcctcgtaggagacatcctcatcgatgtaggatatggtaatctagaattttcacagttagtacttggcaaaacaacgttttcaatgttttcttttttcactggcagcacaagaaaaaaaatatttgagataagcgttaacagctcagtacctcatcgtccttcttgataggctccagagcaattatcactgcattaccatcagtatcctgcaacggtagttcaatggttttgtcggattgctgactggcaatttggtgtgaaaaatgagcgaatcaactggaagaaatatagattacctcatcccttttatatgctttagcatttggacaacatgaatgattcatacagctttgcaaaggaaagaatgccgtccctgccaacgagaaaattcacaagagaatgaacgaatactgctgggtaaatagaaaatgacattactgtggggggagataaacttgggaagaagctccacataccctcacaaggagctgcatagtcttcacctaaagcatctagaaatggccttgtaaccttttcagcttcctcctgggatatgttgcacttcagattaacaatgccacaagaaaagctaaggctaaccagtgaaaataccttctcatcatctggaagatcatcaatatgtatgaaatagtcttccactggagacggaacaaccaaaccactggaataaaagatggaaatatattgaggttattacatcaaatgcagtacagaacttatttctgttgatggaaagaaacaatgacagagtatgtaatgcacatatacaaatgaaaaataattagatttacttacagattgttcagctcaaacatgccaattaaatggccatacacgtcaagtgagaacactaggaaatgtcaaggtgaccgtttttttttacgtgagtcaatgaaacttgattacttgaatgtgaagggaagctacttatttatatatatgaactgatctagtatatgccaaaaaggatacagggtgcacactcagaatcaaaaatagcatccttgagaagctgcaatgactgcgaaacacagaagataatgatctgcccatcaatccattggtatgtgggacacttttcaatcaaaacaataaccacttcttgtgtgccatttttatattttaactgacgagctagtgaataaagcttcgtttcagagcacaatattgtgaatagaatacctatatagtttcaaaagaatgaaatatgtgacagcataattaccgtaagtgctagatccctaatttgctgcctaaatgtatcttcatcacaggaatcaacatcctcaggcaaagcaacagagtcccaccacctgcaacaagattttttttttttgggacatattagggtggaacaacaatgcaaacaactcaaaggatcttgtagagctagagcaaggtagtgaaagccacactgagctgaaaataacatcttgccaacaaatccaaaaaaagagaacaaaatatgcaaccatgcaacagagatcttattgactgttataaatgagaagagtggaaatatactagtaccattgaattattgatatacacttgatgaagaaactatcgattgtgcattaaaataacactgctggtagtgccatacgcgcagctactttatcagaggggatgaatagttgcatgcgaattcatgactttacctctttttgtagcccatcgaaagtggtttccatgcttccataagcaaagaaaagtttgattcatctgtgttattttgaaattcaggctgcgttttgagtttcttgtacctcagcagagtgaaagtgatagcctgacatgtaaaattgtatcgagctcatgcatcatgatcaggagatattaaattgactgcaattggtagcaataaggaaattgcaattgaatcttttgtttggggatgttcttgatatagctactaaaactcgtcttgtgcaatagtctgtcctggtgcattgataagtagattgctgacagccattagtgataacagtaccaactcaagtgtgatgcttgaatgctttttgtattagccatggacaatggcaaagttctagtatccccataaaacttttggagaatattagaatctgagatgagcacataacacgatgtttagtgcttagtacactaaacattaatctatatttctatcacataccttggcagcaacaagaaaaatatcattggaccctgaaaataaagattggtcagtagcagataacagactgacaacctcaatcacaatcatcactaatcaggaacaattgatctaggcatgctgcatttaatgaatagtgaacacaacataaattcgtaatgatggtatataatgatcactgcatactgcacttaccatttgcatgttctatgaatttctgaagagcagatctctgggatggttcagtcttagatccagtacacagcaaagagtgataagtttcccagtcggaatcagcacatgattggctaaacaaaaatgcagaatcaacaagttatgtttttaccccaagattacatttctatctaagacggcaagaacaagttacatgttctgataagataattaggttttaagttttaacacgaccgacaactataacctatgatggagaatgaattgatcaacaaaatatttatgcctcaaacaaaattcctaacatctttgggtgttgcagccaaaagaaagtgtgaactgtaaaatggttagtgactcaaacctgcagtagcgttcttcctcacatccacgacaaggaacaacttgaggcaaactaaaatggtctgtgaaaggcagtgacatgtcaccagtaataagtgatcctaagacctcttctggcaaagtactactgttttcctttgttgcaccagaagaactggcactcgatcccaaatcactctcatggcaatgcctcctattagtgcagtcactgcttgaaccaacgctttgccaatacaatcttcgtccaatctggaactctatagaaccaatgaagcgaaagcaataactgcacacagcgcaatcaatctgaaataaaacacaaaatggacaccacacttcagggaggagcagttcacacaaaaaatagaagggaacaaatacctaggatcacttcaaaagcagacgaaccttgttaagactgtgctgagcaccaaccaatatttgatccttcagaataaggtccccttctgcaaactccttgttcgcacaaacacctgcaagaaccaactggttaagtatcttggcttttacccgacaccaactttatacaagcactccaagtttgccggattgcattgcacaagatatataagtattcagtaaccagtacctttcccatgcttgctgctgaagttcactcttataccatcatgtttcctggactgtatgagcccattgtagtattcctgaaaacaaaagtagcatagctgtgtgtcagatgggagctacagatcgtcagcaatacatgaactaaagtaaccaaggaaggagaaaaaaagccataaaagatttactacaattttactggcttcaaggagacaattgtaactgcaacacagaaagaagccaagaacacaaaagattgtttctattctgtcgaattgatacctccatcgagctacattcactacacactaactgggatacccaaaaaagacaaacttaagattgtacttctgcaaataaaacattaaactacaccgttactgttgtaaactaaacaattcgcctctcatctcaccaatctaaaaaaaaccatccatgcggaccaaaaagaaatcctcctttctcagtaagataactgaaaccaatcatagtaagatatacccatcatagtatcacttccttataacgaaattcccgacaatgattacccaacctttctacagggaaaaacaataatcgcagcacaagcaattcccaagcagatagatttgagacccggaggatggatgggcaagggaaggaaaaagaaaacgtacctgcgcgggttggagaggaggggtggcgaggagctgggcgatttggggcgcgaactccctgtccaggtcacacgggcttgcgctgctcccacccatgccgccgccagcgcgagctgctgcctcttgcggctgcttcttccgccgccgctcgccgccgccgccgtggggtttggggggttttgttctcgagaccttgtctcgtacttgggggagaggtgtggatatgaacatacgtgttcgagctatgaaggcggaaacaagggaagtacgcctccttgttgaaaacggaaactgccatttttggttcaaattgacagccggtgtatgcataactgcacacacataaggaatatgtgaatgttacttgtaaactgcatacatatggtatatgtgaaattgcgattatcaactccagtcaactaacattgtcatcatatccctgatgcttatgcaagaattcccccaaaaagaatgctaaagcaattaaaccaccaccaagtacctaatccgtagtatagaatgtaattcatcctctagtactatgaatctgtatagaagtaggtaggatgtatcatattatattctatattgggttaagggagtatatgtactagcccagttccattccgagtttatgtgttcgtcaccatcaccatgtcaagtcaacatccagccttcaacctttgtaaccaagacgtgcatcgagattgcttgtgatgatcatttcaataatgcaacatacactgctaattactagtaatatttgtgagtgttagatacaccgaatacagcagaaaacaacttcctaggtccccaatgcacaatacataaacaatatacaaactttttcttttctttttgtttttttgagatggaacttaattatctaccacttgctgggtagctagtgagcgccagctcgatcgacaattctcattagatgcatagcagtatagcccatgtatatatatatctatgaatttagatatatcctatttctagatttatagttagaaattggattttttttttggagcgagtataatcgaattgctgaattgataccttgtcaactccttcgatccgatcaatcaaacctgccatagtcatagtgccgtgatcatatatgtatgaactcccccagatatgcgattaatccaactaactattgcctaaattacttgtatattagccatatcattggcataatgctgtcaacctcttagttagttggattgcaaattaaatgggacatggcacgagcaggtaactatacaaaattttcatcgtcatccacgatccaaccaccagctggtgcaaaaccagcagcttgatatataaattcaggcagtagctgcgccattgctggtattagctagcttctctgcagcctcttccattcctagctagcttgtgcaagagctcgcaacaatgtcgtcgtcgtcgtcgtcgttgaaggccttggtggcgttcatggccgtggccaccgtcgccgagctcgccgccggcagcaagacgtgggccatcaagtgggcctccggcgggaactacggcgactggtcgtccaagaacacggtcgccgtcggcgacagcgtcggtgagtgagcttctccattcctcctccgttcttggcatctggcaacaatggcgtctgagctgatcgatcggcgtgtgtaatgtggcgcagtgttcacgtacgggacgccgcacaccgtcgacgagctgtcggcggcggactacacggcgtgcagcttcgccgccccgctctcgtcggacgccggcggcagcaccaccgtcgtcttcgacaagcccgggacgaggtacttcgcctgttcgtccgggtcgcactgcagcatgggccagaaggtggccatcacggtctccaactcgacggcgccgccgtcgtcgtccaagggcggctcgtcgtcgtacggcgcggcggccggcggcggcgccgagctcgcctccaagctggtggtgggcctcgcagtcggcgccggcgccattcttgcgctctgaacatgaactcgatcgtctctgaattattggcagcatttccgtcgtttgagatctttgcgttgcggtgttcctatttgtgtaatgtgcagtggattcccttttgttatgatcttgttttttgtatgcatattttcttgaatgaatttagtagttatgcttgattacacaaaatcagaacttgtctaatgaaaattttacacagcatcgctagcacttcacaaatttgacttctacatattgtaaaaaaaatatcaaatttgaatttgcatgcttgtgcagtgaaatatcacatattaatccatcctgcaatgacagtttttttttacatttttttaataattatttaaataacatcgcaagaaacgaagggcatctccttaaagggcgaaaaagacttccccatcacaatcataggagtaacagtttgtactttgtaatgcattccatcagagaaccaacattaaaattagcatgccatatatatatacacacaaaaaaaggctgcttctgatgtaagacctcctaacatcccattccagcgacggcgaacataatctaattacaaaagctaactaaccctctctgtccaatgatcagagcaattcaaaagacatggcatcacccatggtgaggaacatcgggtgcataaattaatggtgctaaggctttgtcatcagctatagctgataggactatgtcagtcttgctacgacaaaattcaccagctagctccacaaaaggatcatgagctgccctcatattccgaatagatattggagatcatctatggtgagccgagttgcactgccgccaggtttgtcctcaccaaaagcagattggaccatctttctcttcttctcctggcaagagaacataaaagttgtgttgacaaaaatggagagtaaaaaagaaaacatgcacaagcatggtgacactgtctaaaatgaattgatcaccagtctagctccaaagcatgtccaattatttaacaacccttacaatcgagagaatcgaaaaaaaatgcatgaaattgcctacatgatttcagctactttgtaaaaaaggtaaacctcatattagtttcaagaaaaaaatacatgctaaccagtatacgcaagaatggaaaattttcattttgtagaaatgcatctttaactgatgaagttaaatatgttcagttcatatcctacatccagacgactaatgaagtgcataccatctaaaagaagaaaggctcatgcttttgaaatgaaaatgtaacagccaaaatgatacctgtagagctaaaatccgatcttccactgtgtctttgatagttaagcgggaaacggttacaggacgggtctgaccaattctgtgtgctctatcaactgcctggtcctcagcataagggttccaccatggatcaatcataatcacatggcaagcagctaccatgttgagaccaagatttccagccttaagtgacatgagcatcactctcacctgaagaatgaaatttagttatatttgttgaccatctacatgtaacatcaaaaaaaagaagatagagatgaagggcgtcagaaaagtacctctggatcagtgttgaattctctcactgctgcttctcttaagttgagagacattgcaccatcaagccttctgaattttatacggctgctatccagcgaaagctccagcaagtccagcaagccagtccactgggagaatactatcgccttagaaggggctacttcacttggacttgattccatagtatcactccaagttagagcaggtgtattcacgattgagttaagtatgtcagtggttgccctgatcttagaagatatgtaactgctttcacagattgatggagagccatctgcttctacagaactactagttgttgcaccagactccaatttatcagctatacaaaaccttaacactccaggtgaaaaaactgtttgagcgcttaatttcttcccacaagaaggggagggacagacattctcatcacttgttaagctcttatgcacacactgataacagaaaacatgaccacatgttgctacaacaacatcctcaggtgggtcctgcaaaacgcgcagaaatcaaattaccgtagttatcttagtatccatggagtaacaaacagttcagataaaattaaactactgattgtttaatcacacacacatgacagttcagataaaattaaaccactgattgtttaatcacacacacatgacaatcctgttctgatatccttattttgctttttcataaaagaaactattcgaagataatgtaatactatttttttgcatgtacagtatgtgattagattgcttacactgcatctggaacaaattgcatagtctccttccagctgtccaagcaaatttatcactgtttccttaggaagtttgtttgccacttctacagaaccagtatcaatcaaatctttttcctttcccttcaaaagaagaggatggtcacaagcctgccgaagtcgcagcagcaatacaagaatgtttgcaaaattttctcttatcgtcccagcagaagcatattcctgtagtatgaacatggagtataaacattttgcattgaaatttctgaactactgcaaatattttgaaaaagaaaagtaatcacactgaacatggtaaactattgactagcaaacctacttgtgcttacgaagataaatgtaaaaacttggcttctgttcattaaaagtaaaaccttcacaattgctgtgggcacaatacagctaagtgttcatcggataagacaagagtagaaaacaaaatgtatggagtattgatatggtgctattctaagaccttgcagcaacaactgagttaggaataaatcaaaaccgagcatatctaagttcaaataatgagtatctagagaacggacagtatctatctatgcaccataactgccgatcgctttttcatttaagatctaatagttgacatagtaatgcaatattttcgatagaaaaaaaaagaggcaaaattgaagtggccataccttgaacttttccctagaaccttcttcaagcatcatatagaaagttcgctcctcttttgagaagtctattttgctcagctgaatcgtttttggtggcaattttatgattggttctccatcgattagtgtttctgtatttgaacagtccaaaaaatagattaattagacaacatcagaaccagtgaaaacaaaaaaacagccatatgcactgaaactgaaagcacatcttacaaatttaagatatgcaaccaagtattgaagctgaaaacatcaactcaagcaacatataaataaacagaatgttacggggtactcaatatgattccacccaaaaagatagtactctttcaattatgtttcccaccttcacaaattccagattttcagatgtatttcatgacttccataaaatgctagagatccaagataagaggttgcatttttccaagtaaaagttgattttgccatgatatcgtattatcatatatattagctccagcacacacatatataatgaatgaatcaatatcaatattttaaattttcatagttgtgagtaataccaacgattattgtcaggaattagtaagcatcagaggcaatgggatgtgggtttcatatagcagataactaaaaggtacaaagttgcagacacatatgcagtcatgattttctattttaccttttgtgcgccgcaacagaactatcttcaagacagcttggagtttcttatatccacgagttgcatctctagaaatttggtattttatcatagagcgaaaggaaccatacacagaatatggttcatacttcaagaaacggaaataactatacagatcatcaattgtattttgtataggagttcctgataaacaccatctccgttttgctctcagtccacaacaggctctagccacttgagtattgtgattctttattgtttgagcttcatcaagcacaactctgaaccatcgcactctggcaagtggtccaccatcaaggtcagcatctgaatttttgggtttctttttcttctttggttcgctgtctttctttcttttattgccaatagaaaatgctggacataacccatatgtttcgctgttcttttcctccatatcctcatcaaagttttgtttgggtacctcattggctacaatagtgtatgtggtgacaacaacatcatattttgtcaactcagttggatctttagtccttgaacctccatgataaaccaaaacagacaatttagaactttcagtaaccttggcagccaactcactagcccactgtctaagaacgctggctggacacaccactagtgttcccgcagttgatctattagcagacctcaaagttgacgaaggcgatggtctcactctagccttcttcttgggttcaactttgacagcatttaccattctatcaacagcagaccccggtagactagcccagggcttcagatctgcggcatcacttgctgcttctgatgatggaaacagtgttgaatcctgtagcatattcacagattcacccttcagttgcttcttgtccatgactatcactacttcatcatcctcatcaaggttagctacagatttcatgctgcccacatcagcagacatgaacttagactgctcaaccctctccttttgtataagggcaatagttgatattgtcttcccaagaccctgcgtcacataaagttatgtccctataagataggggatccagtaaaacaagtaacagttatcaaggtagaaaatagaactaacctgatcgtctgccaaaattccacctgaacaatgtgagctattctccctggaaaccatccaagctaatgctattctctttcaataatgaagaacatagcagtgaacaggatcagtagaataaatagaattatcacacaaccaagattttcaaaatataaactttacctggtgcttaaggagtgatactgacataacaccttcaggcaaattttcttccgttgtttcttgactgatttgctgcacaatatatttttttgttttaaaaaggtataatccacagtaagtacaataaaattgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaactgatacataaaactatttaaggaagtaaacactaatgcattcctaggctaagtgtattgatcaaaatgcagcaccctattcaaagaaaatcacaaatgaaagattaactattaatccaagggccaaaattttgaaagaaggaagaattgtcacaacatgaactgagtgtgccatcacgcaagcatcgccttcgacaaggaacggcaaagccaactccacaacaatcaaacaattcgactacaggaatgcacaaccctaatcaagcccacgatcgcttaaaacttccccccaaaaccgcccaatccaccaaaaccctacctaagcgaaatccgcccaaagccaccgccttctcctcctcaaaaatgatccgccgcaatcaaaatctcccgcaaatcgcaacaaccctctcacacctccccgaaacaaaacatctcacaaaagcattccatccatttgaaccaaaaccgctaataaccccaaagaaagaaaccagtcttgcaagagagagtagtaaagaagttacctcctccgaatcgtcgtcgtcggcggcgattatccgttggagggatcgaaggcggcggggagcacacgaatcaaatcaaatcaaaatcaaccaaatttctttttgaggggaactgcgtggagattttatctggttcgtgacggccgcgcggcggccgaatcggaaaaactctctctcgcaaagacgagtgggaaacctgggacttatcaaggcgtcgccggtttctccgggggcgcgctcgtgtgtggctgacgcgtggggcccacgtgccgggccccacgtgtcagtgggcgcgggcgagcgggaaagggtggaaatttcgattggttcgcggcttgaaatcgtcgtggaggtgccttgtgttggaaggaaacgggtcgtgtgtgttttaaattgtttttttctcaacgcaaagtatgatgcggtttcggaagaaattcctcggaaattcagatggccccacctgtcagtggctattgggcgttgcaacgggggctgtcaacccctgaaaaatcgactgatattttgaaaggaggaaacgaataagtaattgcaacggtaaaattatcttgttaccgttcaaagaaaaatctcttgttagcaatagcattcggactaaccatcattatcaacgcccatgatcttagttaattgggcattaacatcggacggtcctggtttactgatcgattttttgctgtgctgcaacttgcaactaagcagatataaacagccacgaggattattaaaaacaatataaaacaagagaggattagagtaataagcccttgtttagttctcaactttctcttgaaacttctagcttttccatcacatcaaaaattttctacactcataaactttcaatttttttcttcaatctttcaattttagtcaaacttctaattttgacgtggaaccaaacacaccctaatatacttattttgcacggactactacaggtcttcaaagatgagcactaagggtatgtttagtttttaaacaaaaattttcacgctgacacatcgaatgtttcgacacatgcatggagtattaaatatagacaaaaacaaaaaccaattacacagttcattaggaaaatgcgagatgaatcttttaagcctaattgcgccatgatttgacaatgtggtgctacagtaaacatttactattgactgattaattaggcttaataaatttgtctcgtaatttataatttattttgttattagactacgtttaatacttcaaatgtgtatttgtataaccgatgtgacatgcatggataaaattttttgccaactaaacaagccctaaacacatgaaccgaagaacacttggaatcaaaatcgttatttatatccaaccaaaatgatcatcaacggcacagaaggctagaccagcttaaaatgcagaaactcaaaactgtagaaataattcacagccatcatagtatttcaaattcagaagaagaaaaatacaacagaaaaaaaaaagaagaaaaaaaatatactccgaagcgacttgctttcacccatgggccggggcgaggcccactgcgaacgggctgggcggcccaaggtacggcatgctcgccgtcggcggcgcggccgacgaagcagaggcgacgccggggaacgcggccacggccggctccgtcagcgggacgccgggcggcgtgtcgccggcgccggaggtggccgggagagggtcgccgccgccgccgccgccgccgtaggccggctggagctggcagtcgggccaccggcagtccggctggaccttccgctcgccccacgtccggtgggccagcccgaagcccaggacgaggcccactacgatgagcgccgccgcgaggcacaggaagatcttggtcgccttccccacgtagcagcacattgcaaagctaagctcgtcgtcttcttcttcttcctcctctccggcgagctcgtccggccaccgctctctcacccacaattcacaaagagcatgcgatgcaacgccgcagccgcactcgcagcagagagcacgagaggggaagagaatgaggctggagagagagagcaatggcgagagggatccagctccaactccaactcgcctcgcgtttttggcggtggtgctggctgtcggctttgcactcgtgcgaggcttcacgtgaaggagagagagagatggagatatagagaggttcgttagtatcacgacctaatcatcatattattaaagtgaaatgatcaccatcggtgactgcatgtttctgaacattttaatctcttttgcagtcagtgcagctcactgttcagttagtcagtgttgtatatatgaacagcagaaaacatactacagtaaagttagaaattcagattatggcaagtctcgtttctgcagtttattccagtaagtcagctctgcatcgatctaactaactcaggtacaaacaatagttgctatcatatcacacctaaacttgtctgctgttagtgataggagatgcactactctgccgacacatctagtaaaaaggtagtaattgattgaaggtaattaactggagtctgggacaagatgataaatgaagtgtacaagttcagaataatgctacagtgggtcttcagagaattggatggtgcaggttatgtggtgagggtccatggtgttggtccaataattctcttacttttatttctcttttgcccttttttccccttagcttttaatactctcattttggatgattgaatagtggagcacaaagatgaaggaaggcctcaagacaaccagtggcatgtccatagttggtcacatgttgcactgggccaaagaccagcttgcattttttgttcattcctaggtgtggttaggtatgcagctttaggttagagccttttatgatgcaaattcttttgattgaaatgcagagcttttgctaagctaatcattaattagtagtaccctgcaacagcaagataacggtacaacctactaacatgatctgcagattttacaatgaataaatcagctgctcgtgacacttgcttacacctggggatgtgcactttctgcggtggctgcagagatcatggcaatttttatagctcatcgtcagagtacgctttggaactacaccatccatcatcatgtgaagtgaaaaggcaaagcactactaggcatgccagatactgtcaacaaatctttttagtctaaactctgaagtctgaaccacatatttttcaactggaaacacatgtaagtaaatttcatagagcatggtaaagccacagctgcagcctgcagaacaaactaccgcaaggcacaagcctatcagttcaaagggacaccattcagagtcacaggagcaaagctagaatgtacacatggacgcatttttccggacctgaccaagaagcacccacggtcacagagaagtttctgaagataaaggcaacatctatatatctattccaccactatatcaggaggagcagtaactccaaaggactcagcagaagcgtccaccatcttcttgacctcatctgggttggcaccaacaatcttgttcaccacctccttgtccttgatgagaaaaaatgtcggcatggccttcactccaagcttggacgaaacactctgcatgcacacggtatatgatatagcagcttggctcagtaaactaatttaatgagcatatatgcatagcagttttgtaacaaatggttatgccatgatattcagtagaaacaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcggtctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccacctaggaaccactttacagacgcgcgcgcacctgcacgcgcgtgccggatagggggcccgtggaggcgccgccatctgcgtcgacgccatctatatgtgacacggtgggggttagagacggtggggggagcggagaagagaaaagaaaggagcgccggccatggcgcggcggcgcgaaggtttttttcgatggcgacgccgtccacgcggtcgcgtgagagagagaagagaagagaagctagggttttcggcggccggccgggagaggggggtttttgatccttcgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccatagcccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggcgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagagggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatccccaatgctgatcgattatcatcacatcatgatggccacagcaacttcagccatagctcagcctggaatcgaaggaccgggcttgtgtgtgccgtcttggtattccgatctcgcaagcatttacccttgaagcgaacctcagtgaacaaatcgtctccccaacggatgatgcctccggagaaatgttgacaaacatcagcgttttggaatcacctccaaggcaaggctgcaatagaaagttgatataagaaatatgtttcaaataaattcagggattgcaggtttttgtattaccatccatttgcacaagtcactcacctgcaaaaggtatgtaagttttgagttcctgaagggcacatgatcgtctcctttcgcaattgcaaagataacatcgctaagagctgacaagcttttattgattgcctgaaacataaagaaaacaaacagataagacaatgtgattatcaaataagaatattgtaaatttgtgatgaacacactcacctgagtttccttcaaacgatcacccgtggagccacttttagcaaggcgttcactgccagctaaatcaatcaagttaaggacaccttggacttgttgcccagtgttctgcattaagatcaaaagaaaattagtgacatacatttgctcaagtttcagtggttctgtttagttagcatgaaaatgaaaaaaaaaatattgtgaccagtttgtaaagtttcagcactgtgattaatattctaaaatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaacaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaaaggaacattatatatgactcaaattcatgtaagactaatagaacatttctgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaaccaatcacacaggcacacagcaacagtacataactatgcagcttattatgcgatagatgagttctaaccatcctgtcggccttctccttgttgaagctttccttcaacgaatcgcactgccgcgtcaagttcaggtgtgcagctttcagctcttccagatcactgctaagctgggcctctggaagtacagtaccccaagaacataaatgaccagaataaactcagtcactacgatgagatggtactctgatgaccaaacagcacacatgaatgctcaaaacccaaaagagtaccatcttgttctcttggtgtgatcaaataaatacaaaaaaaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttatcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctcttcttctgcaacaacaacaacaacaaccacaccccacaaatcgcaagaactaagctcccatgaatcaaccctcccccaaataggcgatttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaaactggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtggggaggagacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgatttt

SEQ ID NO: 37724 - DNA, 578 bp, Oryza sativa
  unsure (1)..(578): unsure at all n locations
tcggcgaggaggagcggtagcggcggttcagcgacgaagaggacgcacggtggtgaggagcggtggcgccagaggatgaggcagtggtgacgccaccgctgtcggccacctcaccaccttcgtctcccacctccatggccgacgagcgaagggcgngcggcgtcggaagaagaaggcgtcggtcgggaaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagca

SEQ ID NO: 37725 - DNA, 864 bp, Oryza sativa
gcagtcgcctcccgcaacgtccaccgcctcctcctcgcctgcctcctcgtcgcctccaaggttctcgacgacttgtaagcataaatcatctcttcttaattaacctctaatttactcgttcgcaagtaaaatcttacacataattgaaccatgtaaaagaacctcagttttgttaggatacatgaagaacaaacacaaagattgtggccactttgtctgtgtattaatcccagcaactgtgtttgttcttatcatgaacagttggaaacataaccacagatctgcagtcactactgcatgaacagtcaatgggtagattgagaccaaccaataccacaattaaataagaatgaattaatcgatcggtaattattatttattttttggaaaaagtacgaatcaccccccgaactatagcggtcgtctgaattacctccctgaaccataaaactggatattcttcaccccgaactatgtaaatcagacgaattacccccctcgacctaatccgcggtggttttggtctatgtggcatacgctggtagtccagtcagtattttatttattaaaaaaatatggaacccacttgtcatactcctatccaactattcccctctctctcttatctccctcttctctcactctcttctcactcacgcacacggaggcaggcgggcgacagggagcggcggcggcggtggaggcgagcggcgggggatgaggcggcgagcggcggcggggtgcggcggagtaggcgaggcgaggcggcggcggcggcagaggaggaggaggcgagtgcagcggcggcggggtgcggcggaggaggggagcgcggcggcaccggcggcggggtgtggcggagga

SEQ ID NO: 37726 - DNA, 190 bp, Oryza sativa
cattgtagcccggtggaggtggtgtcggtgccggcgttgaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgt

SEQ ID NO: 37727 - DNA, 699 bp, Oryza sativa
aaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatttgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggtt

SEQ ID NO: 37728 - DNA, 14082 bp, Oryza sativa
tccacctgcccccaccatcgatgctgctgctgctcccgtggccggcgacgaccccatcctgctggaggtcgacgtcggcgcagacgccgccctcctccccgtcccttgctccaggtcctcccctgcacgatgttgttggatgcagagggtatacatgtccttttgttgtacaactaacaccgtgacaccttctattagaagtgggggtaactggctggttcagattcaaagagtgagggtaaaactgtaaaccctaaaaagtgatgataaaacagcaaatgggtttgaaagtgggggcaccgatgcaattgccccatcctctttttatacatgaaggggagtccacaatgccaatgcatgtatgcaggagtgagacccactctattgaattaggtatgcttagtgttgtcgatgtccctacaaacaagctagccggacgtgactgtctcagctgtcggctaactagtggagcaggaggtaagaaagtgttttcccaactgtcacagggccacatgtcagcctttctaaagtaccgaggtggacctaaactacggatgatgagggcatgccatgttacctcccctctatttctttggttgatgtggccatgtaaggggcttcatgaagcatcatgtttctcagcatgcggacgagctgtacaccgagttgctctaccctgcggtttaagcggtgtgtcggttaatgttagccctataggcccaccaatacccataaataggacagagccttctgaggagagctcggggcagagggcatgctcgggcctgagcccgcccccccaagacgtttgagccttattcataggcggtcactgtgctcagtgtttttttaaccgcacgtccagggcagccgtgatcgttaccattgctgaatgcatagttattaggatcggaccagacacggtttgattggtctgatcggttgaaccaccggtccaacacggttcaaatcaattgataagcatgcatagctcagtggtggggatgattgagtctaaaggggaggttgagagttcaaatccctcaagccgcctattttcttctctatccccacgtttcagccagtgttcggccttttcacacatgttcccacgagcgctcggttctttagcggtctatttgcctgatttttcactggttctttccaaaaaccggcgattcaaccgattttttccgggttgattgcactccaatttttaaactggatcggatcggctgagcccctggttcccatttttttcggtcggaccgccaatccggtcctaataactatggctgaatgtaggttttcttgttagtttggacgaccttctcaaagatgttgatggcgcaggagttcacgatggatatagctagaaggagatgccgaaggtcgtgagctgcaacttcaacaccttgaagatattgtaggtctcgatcagaccccaagcacaaccaggccgaggaggagggcgcccgagggaaaggtggtggatgcgccccgagagcagccccccccccccctcccccaaaaaaaaagtgtgtagtcatcaatatatgagactaaagtgatcataactcttcaactccttagtgaacccctaggtcatcacgggatattctacttaccacacaacgtcctagtagaaatgagttattatcttcctttttaaatatatgatgctattgacttttgaacatgcaacaattcattttattttaaaaaacttatgcaagtattattatcttgttgtacttatattatcattgcatatattttaagcattgtttatatttttttatattactaaattgttgaataaggtaaatggtcaaacatcgtctatctaaaagttaatatatcgtatatttaaaaacgaaggaagtactgaaatatattccttaatcgtaagcaaagcatgagagatcagatctagcctgtgatatggacatgtatggttaggtcactatagtgacctacacggccgtatcacatcaatgtacataccgggcaaccctagctagttttgctgtcgatcgatcggccggaaacccgacctcgtgaacaccttttggaaatcaaaccctctctacgaccaccgcagtaaaagctagctacaaccatactccttccgtctaaaaaaagaagacaaactctggtttccgtgtccaacatttgatcatccgtcttatttaaaaaaatatgaaaaaaaattaaaaagataagtcacgcgtaatgaaatactaattataaaaaaaattcatataagacgaacagttaaacattggtatgaaaatttagggtttgcctttttttttttggacggagggagtacacagttacacatgcagacggactcagctagcgcaaaatcaattggctccctgctcttttcaaattaaaccagagaggaattagtaattaattggaaccaacaacgttaagctccactttctccttggccatcatcgtgccgctgcacagttgtgcgcacactgctcctgcatgctcttcccgctgactgattcagagcatgtgtagctagtattcactctgtaaaaaaaaacctgatatcaaatacttcctattacacattctactactataaatttcaataaatgtatatctggatataaatgtatatctggatttgtagtattacaatattcgatattaggtttgttttttatactctttccgctgactgattcagagcatgtgtagctagtaatccctctattccataaaaacaatctgacgttagatgtgacatactcactccattccaaattgatctacatatttcataggtacaccaagaccaagaaaagctaataactctctcatactatattttctctagcaacaaactagatatatgcaccatccccactatctcctagccaatagcaaatcaagatattgcatgtgagttataaatatttgtgtgcatggatgcatgcatcaatgtccatttactccaatgcacaaataacgaatagacctaatgaataaacacaaatatatagatcatttcggaataacctaaaaaaaactatatgtagattaatttaaaatggagggagtattttagtactacgaatctaaatatagtactatgatatatcatatcagatattagattggtttttcatggtacgaagtaagtactccctccgtcccaaaaaaaaagtcaaaccccgggttttcgtgccaatgtttaactgtccgtcttatatgaaatttttttataattagtattttttgttgttgttagatgataaaacatgattaatactttatgtgtgacttatctttttaatttttttcatatttttttaaataagacggatggttaaacattggacacagaaatcagggtttgtctttttttttttttgggacggacggagtatgccgctggtgctgctcctggtcgccgaatccaaaataatgatgcggcgagatagagatacggcctagctagcctaaccaccctctccacacctcatttcgcgggcggcgtccatggcgagcagtgtgacatatatgttcccttagctagctgctccgtgtggccaatgagccgcacggttcgtgctcgtgctgatcaggtcgtggcgcacagacgacgcagctagctagctcgctagcgcgcgcgcggcgccgatcgcgagcgagggggagacacagacagcgagagatagcggcaagccgtgcagcgacctttcacctcatgtcgccgcttttaactgaaccgaaaactgatctgatcatgcatccaccaccctgccttatccttcaaaagaaacaacagcacgaaattgacgaaaacgatggccactaactacctcgatcgacatgcatcgatagatcggaattaaccgccttttccttgcaagtgtgataacgtcgcacttgcaattagaaaaatatgcttatatatagctagctaggttccatattttgacccgatggttctcgacttttcgcaaagccaaatgctctgtaccgttcatacgctggatttgtctttaattatttttttctcgatgtgtaaattttgtttcgactttacatcttgtgatgtggtagactggtactctggtaatacatgttgttatatgagtattgtaacttttatttgggatttttacataactattgaaatgaatgatgtttaagcaaaaaaatttgccccttggttcctctctctctctctctctataatattgtaccgctgttgctaccgctgaaactgtataatctttctctgaagattgatcgaatcggcacaagatactgaccaaattaaaggccgccatccgatcggcttctagcttagctagctggactggtcaatatctgtggggatcgtcgaacactctgtgttccaaaaaggtgtcgttgcaatgacagactgttaagtgatcatcagtcaggacgatcatatattcggttgatagttgatacattattgcaattgtatattgaagcctatggcaacttgcactacccactaaccgtaaaggcaaccttactgagactttgcgtgtagaatagccgcaccaaattaaccgatcagcaaaaaggaaatttaaacattgttagctactagctagtgttctgatccctgaaagcctgaaactgaaagatgcacgcatgatgtataattgcggttggaaccagtggcggatccagaaagaaatatcagtggggtctaagcaaactagatggagttacagtccccctcccatctatgtatggtaaaaaaattttagtggggtcttcgtggggctctcatagtcttcacgttagtagtggtggctcgagaccccaccatccccatgctgaatccgcccctggttggaacaaaagtggaaatcatgtatgtgttgaacatgacagatcgataggcgtgcgcgtcttcctaggtggagttaacgggtgtgcaacctcatcttttggcttatgcttataaactaaaatttaaattttcaatattaaattgggagttgattttaagggttttatcatagtttattttcccctttttgtttttagattgtttttttattttcgatcgttaagaacacgtatataaaaattttattcacaaattatttttcgttataaatatgctatttgacttatcaaaaataagccaaacgatgacacctgtagagtaggattactgtagtgcgtagtggcgtacaggtaatcaggtatacagaggctagagggctaagccgaatggtgtctttcgttgctggggtcagaaagcaacatgctgctcgcaatttgcagtgttcgatcgatcgatcgatcggttaatctattcttcaattctccacaatttgaaggcaacgatatataggttgataataggaccaaacaagtattagtttgatcacaagacacacacaagtttgaacccatgcagtggcgtactttgagcaaaaaaattaaggggtcacataactaaatgtcaaaaattatatactcaagcgaagtcacatgctatatgatcagcaccaaaagtatacatgtgaaatagtacatgcatgattttgtttattagggttcaaatcctgagcccgctattacacatgagcgcgtgtgtacttttaataggattttatagtattttagcgagaccaaagattcgaaattggactatatgtaataaaaaatagcacagcatattgaggctctgattagggagtttctagctgctgcagcttctctcagaatcaaaaacttcctcaaacagctcagcttttggtacagattctcagaagctgtaattgtctagaagtcatgaggagtgcttggactctataatcctctaacattgaaactaacacctaggagtggaagaacataattaataggaccacatgttagagaacgaggacgaacgtcacgatggacaccggtcaccatggcggggaaaatggactgtggctagtcgccattaattataagatctcaccactgtgaggtcggcgtctcagagatgcatggagcccatgctttctcgcatgcttttcatgtttcgtttaggtttaaaaaattcctaggttgtccactgagagcacaatcatgcataccgtagttagagaaatatatcatcgatcattggacccattgataagacgatgtcatggtcgagagagaaagagaaaagtttatcgtgccattaaccttgccttaaagcttgttcagattttcttttgataatagaaatcagtctagcttcaatatcacaaatgtattattgtagctagttatttactcaagactgtagataagtaggtacatacagagtttggtgaatgcctacacaaatgatcgattgactatgcaccagggtttccaggtcgaatgaggagtgacaggcccactctggcactcccgtggttttgccactgacaaaagtttcatgaatgcatatatttagagtgctatatactttgttatgttattacggaacattaagttttagtatttatttatttttttaaaggaagacgagtggtcgaaatttgaggaatactatccactatcttgacaaatacttgaaggcagagagagtactggtaaggtaggttagaatttgtacacttatttgtagagatcttccgtttgaggtgaagcttttttttttaagccatgtattatatggctgtgtccgttagaacaagttcccatccgtaacagtgatcacgcagggccgtcccgttaaattcaggggcctgtgcaaagttgaaggataaaaacttaattgatgatataatatgaaaataatttatactccgtaatatatttcataaaaaattagaatggcctaaaatgataatccaaaattaggtattaccggattagaaattatcagaaataattaggttaggggcgtggcaaacagcattaggcggcacgaccgcacaagagagaggtgaggcgtcgtttactcctctcgttcgttgcggttggtgattgataaggtccatagtgggaggcgattcaaaattgcgaactggcgcaactatgcgaaccggcaaaggctttatcgaagccgaaacgacaagaaaaataacagattttcgggactagttaggctaccaatttacttattaagttgtatatctagtgttgaagttttgggcctaaggggcccttgaaaattgggggccctgtgcgggcgcgcaggctgcacgcccctagggacagccctgtggtcacggaaaacggagcggtccattagcacgtgattaattaagtatttgctatcttttttaaaaaaagaattaatttgatttttttaagcaactttcgtatagaaacttttcgcaaaaaacacaccgtttagcagtttgaaaaacgtgcgcgcagaaaacgagggagagtggttgggaaaggaggcatccaaacacagcctatgtatacaaaatacgtgcaacttttttgtcacttcctcactcgtttacaaattacatactttatacatcactccctcacaagatgatgtgtgttgcaaaacgagtaaaatcagcttgaagaaacttcaataaaaatataaccatgttcgcaaatagcactccatcttttctcccttatcaaaaaccttggcatctgatgcatgctttattacttttgtttataaaaaaacacaccatataaaactgagacacgaaaaagcatggaatccatttctacccatttcccactacctacactcttggactctgttcaatacagtttcagatctcaatccaccgttcacgatagatttatagtttatatatagtttaaaatcataaatttcatctagaacgaaataatttatccaaattttataaatgtggtcacagatctaaattgatggatttgtgaagttagggatacttagttctaaaaaattcttggatccgaagttgtgtcaagaagaaagaaggccttattcccgtcgaaagggaattcattgagagaaaaaggacattttaggacggagggagttgaagaaaaccaaggaaagcacatcaaatttcttccatcttccatcacttgccgcagcccagagctcacaactccttccaaggagtaaaaccactgcagcccacgacagaaacaggctctgcgtcctagctacgccgcggaccaccgctcctggcctaccaagcccaacaccggaaaaaaaaaacgcaaagcttcccctcgcgcaggccccgccggccagtttccccgacccaacccacgcgtcgtacgcacgggaaggaggcccaagaggatatagccgcacgcacgcacgcggcgggggctccaaatcggcaaatctcgcagaaaaattaaccggcaaaatctcacggcgagaggcagcgcgtgttccgcccacgacatcgtcacgttcgcacagccgcgcagacaatagccgagccgagcgttacgcgcgcggggcgggggggagctcgggcgcggctcaccgcgatcggcaaatctcaccgcgagaggcagcgcgtgcgtttgcgcggttcggcgcctcacgggcgcgcgcgcgcgcatgcaggtgatcgagagtgcgacgagatgtcacgtctctggccgatcacttgaccgcttcacgcacggcacatctactactactactacggctagtacgactaaactaactatacgaataatctaacgcatgagaaaacgttacacgccatggctacccacgcgttactgtagtgccggccgctagctctctgcgtgcatgcacttacccatgcagccatgctgccacgcatgcaggcgaaggcgaagacgacgccggagcaacggaccaaaacacacgcaaattaaggagcagagagacgaatcgatcaaatcggcgctccagtgcggtgcgcctagctctctgcattctcatgcatgtcatgtgtggtctaatccttcgctacaagtggctgaaacctagtcacaagctacttgctgctgcagaagccctggagctacgggcgctcacagctttggctttctcgggaaatagctcatgcatgcctgcgcgatcggcgctcggcggtagcttctggtctgtgtgcgtatgcggcgtttacacgtagtggagatgggagaagcttgaaaatggcaagggttttgggctttttggctggctgatcgatcatgtcgtcgtcgcctggttcagacgaaggccacaccaggccagagggaatgggttattgtcgatacacagtcaacatttgctacatttaggattttcatttttttttttttgcaaaacgcgatataattaaaccattatgctcatacacgcaagcgcactcaccccaatattcacgtttcaacccatatgagagcttccaaaatactaagtcggtataacttacgcttaacgaagtcatgcatcacaatcgatcatctcattgcacattatatcaaacttatccgaataatgtgtggtactccttacaaattaaatgctaaacttatgagtgctaattcaaaattttgtatgtacggtaattattttgttaaacagtagtacgtactatcttatacttgtgtacacgatgagatgacaaaatggccggcctaacccttttgaattaggggccatacaaaggccgaccgtgttgattcgcttgaccccagatgagccctagctcgcagaccccgtgcccatatcgtgcatgggcaaggtctctgaatagtagttggacatactacactatgtatagttttctatatgtaaagttgagttgtagtgtcagtgcctgtcacatctactacctccgtcctaaaataagtgcagtcatagatatccgtgttcaacgtttgaccgtccgtcttatttgaaaaatttaaaaatatttagtcatacataaaatactattcatgttttatcatctaatagtaataaaaatactaatcataaaatattttcaaataagacgaacggtcaaacgttaaacatgaatagtgtaaaactgcacttattttgggacggagggagtacttcacaatatactaacaaaacaacaaacccaatacatggatttctctagatatattaacaaaaaccaacagtgtacgtctgccttatcacatgagtacgtgttttgtggcaggctatgcatatgaaacaaggaggccctgttcaagcaataattcaaatcaatgcatatattttccatcacgtacgacattatatcagcagtaagcagtactactactccatattttgtaattaatgccggccatatgcttgatcaagagacatctagctatggactatggctctatgcattgaataagacaattgctgatagaagatgtcattatgtcacaagacatatggccattagtttaacatatctgagaaacataaacaacggttgaatcgtgttttctattgctgatgactgaaacatgcaacctagctagtgcaggggctttgtcagcagctaagctaaagtgccacgtacgccatggtactgagaaatttgtgtatgtctgatctaggctctctttctctcccgtttttccacactgttcagagtttacaaactccttgaagaaatgaagaccttaactcctacctgtagtgcatgccgctatgtattatgtgtatatatgtacaatgcagtcagattctacatgtattatatatttgcatcattacatctgcatgtctcctgtcagtgactcagtgataaaacacgtacacgtacacataatgcagagagatggagccttgtcagtgagagatcttcatatgctcgttgctagctagctgtgtactccaagcaaaatacatgaaaaaaatgaataattcatggccctagggcaagcaaggcaacacacaacacacgagagcaggcacaccaaattccaaatcttgggccgcgcatttaactcaaccactcccccagtgactgccccccgaccctctcgtcatttctagggtttcatggcgtctcgtgctctctcatccgtcgatcgaggccgcgatggacggctaggattgcatcccgggtctctccacggcggcgaccacagctgtaggtccaacccctctgccgccgtgttctttgtcaccattcattccgctctttatggttttttaatgccgtctcttttttccatgtggtcttgcctgttgcgatggccctgtatatttcccacacaaaaattttacaccatgtcatttcaaatgtttaaaatccgcataaagtatttaatgtaggctaaaaaataactaattgcacagactgcgattaatttgtgagacgaatcttttaagcctaattgttccatgatttgacaatatggtgctacaataaacatttactaataacggattaattaggcttaataaattcgtctcgcggtttactaacagattttgtaattagtttttttttgttagtgcccaagtaccccatgcaacaccccatataatacccaatatgacacgtcaaaattttacacccctaatctaaacaccccccatgtaaatgtatagctgtccatgccccagccactgacaggtgggctccacgggtgctacagctgcatcatggtccacttgtcagtgactatgcaggtgcatggctcgtttcaatagatgcactggggatgcatggtcgtcagagtattttcttttgaataatttgggtgacttcaaaaaaaaattatttatggtgatgtgtgcagctgtaatcatttcacatatcatgaccactccatggaccatgtcactggcccttgctccttgtgtctatacatacccgtgctctttgcccatagcttcttgcaagggaagaatatcagaggatgagaactagatagatagagagagagaggaggggaaaggaaaatagatagtatgaagctatttgcttctgagtggaatgttgtctggttcaaggtctcatgcaccttgcggttttgaggatgatttgtgcaaggtttttcattcctctcatccgtgggatctcggaccaggcttcattcccctcagagatagcttcaaaacattagatctatagttctcgctattatttcttcactttcttccctctattattgaggatttcatttttcatgtgatgtttgtttcggtttatttttgttggtttgttgagaaccgaggatgctgtttcatgatttcactgcttttttgtttgtttgtttgtgtttgcttagaaccgaggagagatagaagattggtgtaatgatggcttgctttgactcctcttttctctgtctctctggcaggcgctggaaagtttcatcattaccttttgattgggggaatcttccttgacattctctctccccctcttctatttcattatcttctctctttatttcttccattctgtttagtttcttcattttcacaggtgttcttttccctgcttccttttctcttcaatgaaagatatacttatgttacttcaacaagttagcataaaatttgatgtatatctggatctggttatattaccaaaagagaaaaagctctagctagctagcaacgacatgcataagagctatagctagccagctagggttgtcttctcggtgatgctgtgcagcctgcatgctcttatgtgattcaaggttgaacatgtagtgtgctcataattatgcagtagtgatgtttggaatagaggtgtatatatatatgaatgttttcagtgaaaactttctgtattttttttttaactaacttccatctccagtatggtttttttaatttgcccttatccgcaggttcaatcatgatttgtcttggtataaagtccgaagaagctctaggacgaactgatgctagattacgtacaataactcagatctgatcgagtagcttggtttaaccttctgcatacgctttcaagaatgtatgtataagagatgaagtggggataagaagtaacctggatgcggttatgcatgttttgttttactgtatattttgtatctagcaagattaattgttggctgaacacagaacatacacacatgcatgcatgatactttgggatgagcaaaggcaatatttaactgtgtttatgttctactctacgagattattattcctgcgcagtctgtctttcttcttttatgcatgaatgtacttatttcgttccaacttccatggtctctgatgaaaagcaggctcccttctaaaggtagggttttagaataccatgatccaacagatcgaactctgataaaccttttctacttgaatttcaatgtgtggtgatcgatcagtaagaataatgcatctatatacgtgctttgattctttcttcctcttcagttatactattcagtatattgaaaatatagagaccctatttcttcatgtaacgttgcacttgatatgtatatcgatcttccaaatgacactttgatcatatagaaccaaagaattcatacttaagaacctcgcaatttaatggtggaatatgtatgcatgtgatccatttattcagatctgcattaatttgttcttgatatatccagctacctttgtctgggataatttctacagtggtcatgtgatgttgggttcaggttgaaatactagccagcacatgcatggttgaaacacccccagattaaatggtattgcctggattgatccatatataatttcttgatcttttatagtgtactggtttaattaattaccccccgtgattctgaaaggtagttcaggcattgatatagacccactgagctctgggcaaataatattgcttttgaagcgcttgtaggatggcacacctatatgcattctcaacagagttatggatgatgaatgaaaatgagtttttgtgattaaccattattcgagagtaaatataagtaaattaattaaatattagaaagttgataacttggttttaaaagaagttctttttttaagttgtacttactccgcggatcgataatgcgccattgttgatcagattgttgtattgagttgtactactactccctctagtcacaaaaggaagtaattttgtaccatttaaaatcaatgggacaggactttga

SEQ ID NO: 37729 - DNA, 353 bp, Oryza sativa
aatgccatgcgtagagcaatagcagctgtgatgccggattctgagcattggttgtgcacttggcacattgagcagaacatggcaagacatcttcgtcctgatatgctttcagattttcgaacacttgtccacgcaccatatgatcatgaagagtttgagagaaagtgggtcgagtttaaggtgaagcataaaggttgtgaagacaaccaatggcttgtgaggatgtacaatttgaggaagaaatgggctactgcgtacactaaaggtttgttttttcttgggatgaaaagcaaccaacgtagtgaaagtctgaattctaaacttcataggtatttggatcgtaaaatgagcct

SEQ ID NO: 37730 - DNA, 1176 bp, Oryza sativa
cagacagtccattcttatactacaaaaaaaacattagcaagtgctctaaagagaagtaaggacccaaaaactacagaactgagcttgcaggatgagattaccatcaattacatgaagcaatgtgatgatgatgaaaaattgctatcaagtattgatggcatacaacttacatatgaatttcttaggccacttgtcaatcccaaagactcacaaatcataagcaagtggttgaaaggcagtgtaagaaatacttaacttcttccatacaacgtaatattatcagtatctaaattttgttctttattctttcacaggtcatagatgcatacattatgttgattaaagacatgcaagtgaaagtccaagagagcatggtactgcatttctagaaagtacagcacattgccaggcctggaaaacaaatggtgaacaaattggaacccgcaacaagcaatatcgagacaagagagcaaaagttacagcaaaatatttgcaacatgatatggtatatcaatgtcctcaaatatccttcataataataactgcatgacttacatttcatttcctatgtagattttcctaccactcaatagaaactcaactcattggtacgtggctgttctcaatggtgctaaagaaaaaattcaaatactagactcgatgcgcatggaaaagagctactacgacaaagataaagacctcaataatacagtatgctacattgtgcctttagattcatcactattccttactaactttttacattagatatgtaatactctatttgataactcagataaaaggaattgaaaagtttatccagtatgcaaggctagaagatggcgttgaaaacaaatggaagaacaccaggattaccaattggccattctgcccaatgaaagtccctcagcaaagtgacaagtcaaacaaacagttaatttttgtcgcaaattatctataacgaattaccacttacaaagaacatgcttgcaacagctggtcatgtggcttgcacacattgaaattcatacagcattggaatggaaaagaactctcccctgagttcaatgaaatggtaattttaaattgcattcagtactctttgtaaataaaatgacattaattgatattttttcataacttgcttttcaggatccaaccaccactttcaaacat

SEQ ID NO: 37731 - DNA, 845 bp, Oryza sativa
gtcttcacaattcacaagaaaagaaaccttcccgcttcaacagtattccgccactgcatggtttatgaatgtctgctttctaagaaaatttcacctctatttgtgtggcttttcataggatggtcatttttgttacaaatttaaaattcaaagataattatttgtgcatgacagatcccatatgcttatgccctgctgtcacttgcctagtgcctacaattgcctatcattggttaatctaaatcattttagtattgcagaaatttattgcaaacagatgaaggatctgtggttaagttttggacttcattgagcaatcaaaatgtatctgtgaagaagattcagttctagtgtttttagcaaaagaacaaaaaggacaacactgctgtcttgagtatagaaatgttatcaatggtctactactaacatggcttgtgagcatgtcatgtaacccaacaaattgcccagcacataatgtgatcattagaatgtaacagaaaagcttgatggagaggataaaagtacaaaaacattaccaagaaactgcagagcagaagcaggtaattcattacgacatggtcaaagtgttcccatggcttgacaggtggtggtcctgagccttttactcttttgttgttcctcttctttgtatgactagcatcttcttggcagtacccatcacctataggagaggtaaaagtgtaactctactacaagtaacataataggtaaaatcttcatgcttatcacagttgttattaacttagtagattgacagacataggagttgcaagattcctaaagacataataaatgacgtaattacctccatttgagctttcttg

SEQ ID NO: 37732 - DNA, 1074 bp, Oryza sativa
gctctgaacaatgcttatcaagaacacactgcggaaaggctgattcacagccaacctggtaaaaagggcagttaataagcttcatagggcaaactgatgcacaatgcctgtccatctcacaccgcataacatgctgctcgcacaactgctcacatggtaggactttgaatgggcagacagagtcatgcttctcaatgtgattagcagaaaaggaagctaaacatccatcatttttgcagtttactatcctaaatctacacagattcctgtgttcagccagcttatcttgtgtgtcaaatctctcagggcaatggataatgcatttcatgtctatactcttaagaatagtccctgcagtagcctctctaacatctggtgcccagaagttctccatctccagcttctgtatgaagtctttaattttgttcaagcgggtttcgctagacaaaaacccagacacatggctcaacaagttccgttttgatgctacaaaaccatcgatcaagtctgagaggaactccgtcggcatggtggatgcttttattaattgttctgagtgatcctcgcctccgtcgacagcctcacgaacaagcgtcatggacccctgaatcaaatattctgctagctcgctcttcattccaacagctacagaagatgggctcttgaagatatcaccagtagtgctgtcaactgaggcagttgccaatccacgaagcaggatttctgccatggaatgcactacatctgaatcacacaggttgcactgaaaatttaagccatctttcccaactgtgcattcaaggttctccattgtaataccaagcagtagttcaaatcatcataacagtcttctgaaaaggtccaatgaagcaaaccatttatgtacttagtctagtatatgctcatgcattcttataaagaacatacataaaattttcaaagcaatgaagcctaaaacttatgcaggtaaggttctccaaagatgcgtcactgttcaaacaacacctaaatggcttctagacgtggctcacaattgggctgcacatcgcctagtcagaagcgtttcatatgaat

SEQ ID NO: 37733 - DNA, 429 bp, Oryza sativa
ggggcgacggtgcgccatggacgcgatccggaagcagctcgaccagctcatgggcgccaaccgcacggcgacgtgcgggaggtcagccgcaagtactacgaccgcgacgtctgccgcctcttcctcgccggcctctgcccccacgacctgttccagctcaccgtgcgttccccgtgctactctcgatcccctcgcggcggagccccctcctatatccccactccatccatcggattcggttatcgcgtggctgatgtgcgcctgcgttgttttgtttttttgcagaagatggacatggggccatgcccgaagatgcactcgctgcagctgcgcaaggagtatccttggagatccccttcaaattattcatgtagggtaactagggtttagtatgtttcagttagattttgtgtgtgaatagaaatagat

SEQ ID NO: 37734 - DNA, 673 bp, Oryza sativa
tccatacccgaaatgccgaggtgagcacatctctctctctctctctctctcagtctgaccctatatatccccagtgatgatgaacaaaatctccataaatgaactctcgtaatatcccactgtatcaaccggatttcgcgaggctcgcatgcacacgccgcattagccaaggagtgaattcgcgattgaaaaccaatctggcattaatgtgtccgatgttttgttgccaactgctaaatgaagtgccagcagagttgccccccttccaaatcattccttcgcgagtagtagaaactggtgttctcatttgttcgaaacacacaccaccaggcagaggcagattttttctcatttcctctttgctttttttcatttcccaactcgagttcgcttcgatgatgcagcagcttcatggctccgactccgtgcaagcgcagcgccgccgcccaaggtgttcgtcatatgcatatgtgttcgcacacaaaaaaaattcctttctctttttttcccctcaagaacacggagaaaaatatctcgttttccccttttgagaattatgatccttagatctgtcgttgtggacgtgtttgatggtgatctcttcgtgcgtgtgtgcttgttttgatgcaggaatggtgacgccgccgccaagaagcagccgtggtacaggcgg

SEQ ID NO: 37735 - DNA, 591 bp, Oryza sativa
catctagtaagtctgtactttttcttatgatcatccccttgtcaaaagaagcgtaatttataataatctattttctgaagaacccctttgggaacctaaaaaaagaaatcataaacatagctaaacttgaaagtacataattaattaacactaatctacccctaacagacatatgcttacttttttaactactaagttttttctcaattctttcttcaataactttccagtctttgttactaagctttctaaaatgtataggaataccaagatattttacaggaaaagcacgccagcttacaaccaaagatactagagtattgatcataataattctttgcttgaccaaaacaaaataattcacttttgtgaaaatttattttcaagccagatagcttttcaaacacacataaaatcagtttcagattctttgcttgctgtaaatcatgctccagaaaaatgatagtatcatccctatattgcaaaatagataaaccatcatccactaaataaggaatcaccccatttataaaactagcatcctttagctctcttaattaacaatgcaagcatatcaacctactaaattaa

SEQ ID NO: 37736 - DNA, 183 bp, Oryza sativa
ctggctcggcccggccgggagctgcgccgtccacgccatgaccgtcgtcgtcgacctcgccggcgacctctcacgcagcgtggcgtacgccgccgcgtcctggctctggactaacgccggcgccgcccggcggccaccgtcgtcagctgctggccgcagctgcctcgcggcgtcgacggtggc

SEQ ID NO: 37737 - DNA, 355 bp, Oryza sativa
gttgttctctgtatttttagttccagattaatcctattgtttacatcaatctcatggccgtttgccagtgtatttatgttcagcccattttcccttgtgcttgctaattacctctgttccaaaataagttaatctagcatggaatctgataacttatttgaggcggtatacaggctggtgtttgcctttcagtcttctttctgtactggtaatctctttctgtactggtaatctcggaagattaaacataagagcagagcctggagctcattttcagaaaaacttatatcagattgatcactgatggcatgggacggaagcagagtggctcaaatatgtcacagttgagcaggac

SEQ ID NO: 37738 - DNA, 333 bp, Oryza sativa
tttgtttagttgtccaagattgtattttgtagtataaggcatatgatgattcttttttcatccgcattattcttgtcttttgtttgcttcactgttctttttatatactttgcagaatttgtttttatatggatatggtgcaatattcaacttcctggccattcttgggactgccttattccaaggtacaattattttttttggagtgttatcatgcatgatcaatatttttatcagtaatcagcgtcagattctacaataagacaaccattaactgtcttatgtggtcatattcatataatctttagtgaacgccatgttgtctaatgtttt

SEQ ID NO: 37739 - DNA, 342 bp, Oryza sativa
aaggttcctattttgtcagtagcaccaatcgcatgttctatttgctatgtcaatccttggatgtgttaatctagtgactggtagcataaccaacatttttttaatttatagtgttttgatttttcattctctagcttagcaagtggtacccctcagatgagtatggcggcaagatccgcgaagtgatgttcaggtctctatgccacagtcctttatgtcccccagatactgcagtgacagaatggcaacgtgcttctttctcaaagaacaaaacaaatctggtaagattaaattagtaacagataggtccactgtgaatcaggttttcttgatttttcttct

SEQ ID NO: 37740 - DNA, 1008 bp, Oryza sativa
gcaattttgaaaatttcagcccgaaattatatgaatttttaaataaaatttgatacaaatttaaacaaaatgttactaaattcatgaaaagatgaaataaataaaaaatttcagccaaaataatatcatactgggagatccaatagaactgaaatttcgatccgaaattttgaaccgtggcagtacaatggctaaagtggtttctccgcagcggcgttgtacgagctctgcaagctagcggagaacatgcatcgcatcgtgtgtgcaagcggggcggcgcccgcgctcaccgactctgcccgcgtcgcggatgtgctcatcttcttcgccaagtccagtgagagccgccacgagctgtccactgtccggtatccctagcatcgtagtcctgctcgccgcagccaacattgtcagcagtggcaacacccgtgcaatcgagcgtgcgctcgccgtcttcgattggatttgtgccaagatcaacgaattggcattggcatgggaggcaataaatcttggtctaagagaaattcttttgaatcccaaatcatccaatctgaaatgctctatgatatttttctctgaaatggctcctgttaaattccaatgttctcaatgctgtcctgtttcgttcttgatgcttattcagatgcttgttcagagtgacaaggagcagcggtcttgatggatccaaaataaaggaggacatgtcattcccagaaacatttcatcatcttacagctcatgtataaactgaagtagaattcagaaatgaactgaacaccaaaaagctgaatcttaatcaaggaaatcgaggaaaattttgtatcttaatcaagttagtacggggccaaattcagctacaggatcacatgtcactatcagctgtgaaggaagaatatttttgttctgctttaattcaaaaaaacctgaaatggaagtaaagaaaacaccaattacaactgatgcaatatatattatgtacaaataaccagaaagaaataagattaa

SEQ ID NO: 37741 - DNA, 1836 bp, Oryza sativa
agaaagctagagatattcagattccgtggttgctaaccgtaagggaatatcttcttggcggtcgaactaccaagcaaattaagaaagttgtgaactttcaaatgcgccaagaaatgtaaccttgtccctttagaccaacaaaaatatatctttccttggctgctgagaaactgccaaaaaaattcttactcttgaccgttagaaccgctaaggacattttttatccttgacggttagtaccaccaagaaagattatccttgtcagtcagggccaccaagaataacttattgatgtccaaaactgtgtctttccctggcggccctacctaccatggcaatcaagaatatatttggggtgtaatatgagtaatttccatggcggctagaaatgctagggccgccaagaaattatctttggggtacattatgcagatacagtccaaatattggtgacacacacactatatacacacatgcagtccaatgcaacacaacatagcgaaagtaatgtgaaagtcaatatagctggccattatgtgaaagtacgccgcgagaatcgccaacatttccaacaatggtaattttatcttacctaaaggtataatattttttagtgtaaaatttagtatctttacgtactatctatctaaagataaaaaaaaattagtgtaaaatttagctatctcaaggtgttttctcaagaattgtaaaatttatcttccaacgatgatctgatttcctctgatgattaccatgtgtgacgtgtttcttttgtataacgacgctctgtaagcctgctgatcagggagcaaaaatcccaattgaagtgtaaaaacaaacaattcaacagttccatgaaagaaaaatgctacaaaaatgtgtgaaatgacaccggagaaaaataaaggcatacataaaatagaggagtagaataagagtcggattctatactaaagggatatacctattgtagcaggatggcgacatggcgacttagcatagcgagagggagcggctgccagcgacgttcggccaagggttgctgtaactctgatatatacgctgtaatatgttggatcggggatgtgtacccgttatcagtgcctcggggatataagctacgactctcaatgacgtcattgtgtttggatctcctatgacatttttcgcatttggtttctaatgatgatcttgggccagttttataaggcttttacgtgtttgtgaataaaaaaaagatgaagatgaagacaacctccgggccatgtttgcaaagactctctatcagggggccaaaaaacctcaatcaagttgcgttgcatggcaaccatgaacaatcaacagaaacatgtttacaagggatctctactcctaccgagtcctcatcgatcaaccgatcgatcactgcgttctacatggcgaagatgcagctgacgaggtcctcgaagctgtaccccgtcagctcctgcaactccgtgctccagaccagcgcgtcgtgccggttcagcgaacacctcgcgacggagatcgacgcccgccggccgccgcctccatggacggcaggtatagtagccccgggcagccgtacgtagttcattagcgactggtcggcaacgtcgcgctccagccgctgcatgcacccgtagcttttcctctccccggctgttgtacacttgtaccgggtgaagtgctccacgaacgtgtccgcggttgggccatatgtagagacatcagagtaccaaaagctaataaatttgaatttgatgaattaatcacatatatttcaaccaaataacacgcgcaattttgagtttacagatcaatgtacaggcaaca

SEQ ID NO: 37742 - DNA, 830 bp, Oryza sativa
tctgttgaacaaaaggccatttaaccttatcataagcttttttaaagttaatcttaaaaattactccacttttattcttgcgatgcagttcgtgcatagttaacatactatatattgagcttattaacatactagaatactctcaaaaattgcaaatatgggtgatggccatcgtaaatagttaaacatatatatgacacaaaagtatctcaagtatttattgtacacgacttaagcttcttactagtcatacttactttccatcgtatacttgctgcacactctcggtgactcggttcaaacagattaagacagcttccccaacgaaaagatcttgcatggcggagaaatatccaaaaacacaacaaacaaacaaacaagtcacgtgaaaatattcaggagccacaaaatttgactgagacgacaaagaaaatctgtccacggaaatatatatactcctatgccgcaaacaacgttgacgtaatgcaatacgattttatttgattacttatgacaattattattcgtacaaaatcacatacatagcatatgtcaatccctgtaattagcaggtgaggttgctgccggggtcgacgccgaactgctggcagaactgctggtagtaggcgacgcggttgctgacggcggtggggttcttgccgtcgcactcgagcgcgccgttgatggcgcggatggtggcgccgaacccctggccggagacgaaggcgtcgtgcacgttgttggtccagtaccagagcgccgtctggaacgccagcacggggctcctcgccaccgcgtccgggtcgcccagcccgtcgaacccgatgctc

SEQ ID NO: 37743 - DNA, 2385 bp, Oryza sativa
caaatgcatggtctgactttgggcgcgagattgttcagaacgaggaccggttcaaatgcgttgacgtccacgtacgtacgccggcatctgcacgttccggttggatggtggccgaaccgaaccgcgtccacttgtgtggactaaattgctcatgtgcgtgccggttggttcacttcctactggatatatttcgtaggcacgacgaactagtggatatgggcatctagaagtagaaacgtcagtcgcaggtgtttgctgcgcgcgacatagccatctacgttgaactttgccgacttcatgtgtgccgtgcgtgcgtacgcgatgcgaggatcggacgcgcacatgaggtgagctccgttgcagcgcgcggcgcggcggaagaaccgcgcgcgcgcgggagagggcaacccgttccgtgcagggcgaaaataggagggggatttttgtacgctcacggcattttttttgtcagcgaaaattcatgcaagttgatcacggcgacgaaattctccccttgtctcgatgagacgagagcaccatgtgcagaggaaaagaaaaattgcaaagccatcgattgctcttgctcttctggtttcatgagacgcgtgttgccattgctatgtccggttccagccctattactgtcagttcgcacagggtctccatcgggtttaaaaatgccatggtaaatccagaaaccaccttgtaaactcacaggtttcgaaagagtttaaactgaaattcaaatttccggcaaagtgcatccaaatcttaccagttttcatcgttaacgaccactcgggcgtggtattcgtttttggaaccctggtacatccatcgctccatctcattttcattgttcatctgtttgcatttaggccatctttggcaattggaataggtggcccataaaagacggcccgttattaaagcccatggtcctttgtcacgttggagaagacgcgccacggcccacgggctgtaaaaagtggggcccaaggtgaaggctcaccggtttcctaacgggtgcgacccatctaaaaatacaatgcatctcgattcttatcccttccgtcctccttcctcctcccccctccccggttcgacgcgcacatcgaaccccgacgaccaccaccgcccggccgtcgccgccgccgacgcggtcgtcctctccggtaatccctgttaccctcctcgtattatcgctccttcctctcctcgccggtcaatctccgcgtcgtgttttttcttcgcgcgccacgatccttgccggccccccaccagctcccgccgccccggcggcggaggcggtccgggcgtgctgctccggaatccctttacataccggaaactcctctcctggcccacccccacactgcccagcccgattcctaactccggacggtggtcgtcgtcgccgccgccgggaaggttcctgggtttgtgcctctttgtgggtaggatgcgttcgctcgttttggaattgtggggatagttttggaattgtggggatagcgagaggaaaagctagtttggtattccgattcgtcttctcctcgtcacccgccttcttggaaaccccgcctcgcccgtccaaccaccaaccccgcacccccgcctcgccgcctgccgtccaccgccatgaaccaccttacggaatacgtatccatcaccgttggtgttcgaggtaacctgcaccaattcaattcgttatttggcggtgctttcttggtggaggtagatgcttgccttgcgctgtggtttaccccctcagcttaagtttggttcttgagttggacttgcttgggaaaaaaaggtgtgattttccgtgtccggtgtccctctgtgtgaaatagcaagaaagacaggtgcattgtgccgtccattccaacatgttgaatgcatgtggtctggcattctgcttgtgatttgtggcatagttttggcaccaatgagttgatgggattatgtgattagtattgtagttttgtgtcctcatgtccagtaaccagagtttttctcatgacaacatttctattgtagagttctatttactcctataacagtcttattttcaataagacgtcacttattttatgtgatttccatattggatggttgggtacacaggttagttagtatttatgacttgcttgcaaatgtcacactggacaatctccttacctcattatatggaaggggatgtgtatgattagacagaagggttcaaattcatctgtttttttagaaagtctacattgcaatatttggtatatataagtagatattcatcgcttaatgctttatagagggagttggggagcccagcattcccttttttctattataaaattcactatgtttccactcgtgatgaactctgta

SEQ ID NO: 37744 - DNA, 2780 bp, Oryza sativa
aacaatgcatgtatattgccttgttgcagccctttatggaatctttgaagaaggccatggatgatgccaaaaagccacggcctattcaagacttgctgaaagaacagatagctaagctgagagaacaaggatctggtggaggtggaggaaaccgaaatcgtcgtggaggcagtggtgattctggtggcccagaagatgaatcattcaaggaatcattggatgaactagtccaagttatcttagcaaccgttgcattcattcttgtggtaactaacgttacattcttgtttgtactctctttccgaatgttatttcttctgacactttcacttttaccccaatttgtagcatagtcctgctttccaagtatcttattatgattagcttaactattaacgacatactgtaatgtcgaaacaccttacctgtagatagctccatggtcaacgcactaaaagacttgctacatgcattgaaactgcatagaaactggagactgagagcaccatttcactgtaaagagcaatattatctgcgtattccataaaagtctcgggtgtagtcacagaaaaagtcggtgtaatgtagcttcaaaataaacaacaggcactaaatatatattaagaaactaattcgtatttgtgtaatattgcagtacatccatataatcagaggtgaggagctgtatcgcctcgccagggactacaccagatatcttgttactggcaagcgtactgcgcggttgaaacgtgccatgcaaaaatggcgcaatttctcagagagctttatgcaaagtgaaggctcacaagaagaccagtatgaaagagcagccacctccaaaccaacttggtggcaacagcctcaaaagtttgttcatcttatggaggaactctgccgaggaaattggcgcccgcatgcgcaggagtcttagttcaggtgctcccttgttcctttttggccttctgaagcacatggatgtggcgatgagcagtactgttttcatggctggtgcaatgacctggaatctggatagcgttccttgcccggggcagtgatttgttcttctttgttcgttaatgcgtattttctacgttttgttaagcactaaccaagtgagtaacttcctggcaattttgtagttgatgagatcgcatatataagctagccggcgtctcatgtcatatgcggcaaattgtagattatgttgaagttgaaccggtgtagcttggtttcactgcattttggtttggtttccttagcgttggaatgtaatgggtcacccttgacaacgtggctccaaatgtataatcttcaatggaaaacgagtagtaagtaccgaagcgcttcttcgctgaacacaacatatgaattcttgtcgcgtgtcggactactaggcatcaaaatgagatatccccccattctaaaataagctcacttttatatatgaatctaaacatagacatgtatatccaaaataagttcacttttatactacgtgaagaagattcctttatgcaattttcacatgataccatgcgtatttctctgttctccaattttcacatcgtcagtgaagctactattaatcatcagttactaacgaaatgaaaggagtagctttgatagtatcttttggttttgtcatacaaccatcagttcaaacttcaaaaactatcaaaatttcgagccgttcttgtatcaagaaacaacagatctaagaagcagggtgcattaatcgcgcggaatcaaggacagtttcccaggcagtgttactttgacagcatattcgcgtgattacatttcaaatggcaaaatgccatttttctggattgagacaccatttcactgagtagaagtggatttaattgtcatcagcagaggctccggatccttcagcagccttcttctccttctgtttctctctgcgcttcttatttctcagtgcatttttgctcatctctcctctgtcccagttgcaatgttagtgatcatgcatagaggtaaaaataattacataaaacaagacaagaaaactaatttatcgatcaagaaactaaccccgtagaagcaagcccaccaaaaagctgcaattcaccaaacaaatgtgttaagccaatagcaatattcaaatatttgagttctttaacaacttgaaatagagccaataaaacatcggggaaaaaaaggagccaaatatatttggcggagtgcgaccaacaaacaatactacttgtttttgcacaaaaccacagcagtttgcttggatagggattttgcagccttggatgtgtataaactataagtcagcaattgagccagcataacaaggatttactcagcacaacgatgcaacaaatagtaaacaagatttatgcacacttctttttgttgcaactctaacacggcttactaattgatctctaatatataccttatcctgaacatctgcagaattctttgaatgaggtggtcgatatgctgtaggtttcgctgctatatttgcaggggccttgcttgatggttgtgctgatttagaaccctgtgctgaaactatacagaaaatgaagtatgtaaatcaattgaccagaacttactaacatggaatataagaaagtgtaaagaaccttgttttttcgtttcttcaatttttatgctacccaacgatatcgtgaggtcggcaatgtcactaaatttttcaggcgcttctggcttccagtcagcctgtgtaattcaaaaaaaaagaaaaatcaaggatggagtgtgtgtgattatggaaatat

SEQ ID NO: 37745 - DNA, 14473 bp, Oryza sativa
ttggatccttatccattcactgaagggtaaaacagtaaataaatatttcataaaaagaaatttctatttctctttgtatatttttaacccaaaaccgtgggacccatctaacggggttaaaagtgagggcaaacggtgggttcgtgttcaaaaagatagggcaaaaatgcaaactttaaaaagtaggggtaaaacagcagttgaggttcaaagtgagggtatagatgcaattatcccaaagaggatccatgccaccgagaagaaggatccctgagtttccagcaatctagcatacactaagattttccactccacgcactgtgaacatgatcatcaccatcatctaccaaagaacacaagagtaaagtattacgcttccgagcggcccaaaccggtctaaaaatgcttgcctctcccacttttatccttcgagcgtcgcctcatttttgcgcaccgctccctggccgaatcttcaaagggggagtacacgcttacccgctagaggagttccacgctccgacaaccacattaccatcgatccctaaaaaagagcacaaatcaaccactctgagatagatagaaggtgcatgagcgatgttctggtactctctactggtagtattattctaccagtattattaggggtaaattaataatttaataataccctaattagttatgttttcttttctaactaaatatatctatgattatctattacgatgacattactcatattgcatagaaaaaaatgtttagtcgctgataaatgatgattatacccctccgcacctttttttttataataatgcccctccgcgttttttactaccactagttactattgtagtataaatagatttgaacccttcgatcaaatgaaatcaatagttcatattgttttctacttagtagtagagaacatcgtaatggagctcaaggtgcgtagggtacctcatgtccataacaccaacaaataaaaatggtgcaaataccattgagtatttgagtatatttcttcgatgctttctggtacttatatggattgtgttagattacatgtttgttcagcttcaaataccactataaatctataatcactgttgtcgaacttttatacttttttataatgtaaagtatgatgggccattggagcgaggggtacacttccttaataattaagatgttaaactccagctccaaatagtagggaaacatcactgaatctgccttcaagtctattatactccatttatcatcaaaagatccatatcatatccttgtatttcttaatgaaaggagaactaattaggtcgcatgcgccagccattcacacaagagcttaacgaaaagaaaaaaaaggtggagaacaactcacagaatcctcttattctatttatgtttgtgctgtaatctccgctctttgctcgctgacttgcattatcttgcaaaaagcaactctagatatgcgcgtccaaatcaacaactatacaatcagtggctagctagctgctagctagctagtgatcgatgcaagttgatactaggattaagtatactattacccggtttgatcgatcaatcagctcatgatcaacactaaaccgtatcgatcggcgtcacatctcacatgtacttccccagttgccggttgccccctgcatcgatcctctttcgtgttgcctgccgcctgccgcctgccgctttcagctctgtgatgttggaaaactattctaaactctcaaagatgacatcctctcgttatttatatatcatctaaatagttataaaaaatattaaaaaaataataagatagattaatatatgataaattactccacaaatatgcaagataaaatttaacttgtacaggttgcaatgaaaaaaaataaatttaactaaatatatgttaactaaccatagtttaatttatgtattttctataatttatagattttaacttgtatgtttatggagttatatatcacatattaatctatttatttaattttttataactatttaaattacatgtaaataataatgtaaataataaggggaagttggctcgaaagttttagagtccactctcgtgatgttgccactcgtacgtgagctagcttagctatatattgcgcacatgtgcagcaaccaaacctagctgctacgagcaaggcaaagcagagccgtcagttgcggtcagtttccctgtcacctccaggcgtccaggaacatacacacacatcaaggtagtggtggccatggccgcgtgcaggtgcagcagccgcctctccctgcagctgcctcctccgtgcttgctcatcgtcctcgtcgccggtaagtgtatcgtatcttgcatgcatgcgtacgtgtgtgtgatgtgtgtcactgtggctgacacggcggctgggatgtgttgttgttgttggttttggtgcagcggcggcgatggtggcggcggcggcgacaggggcgagggcggcgtgggtggactacccgtcgggggtgccgtgcggggagacgatcccggtggagcagtgcgacccgggcgacgcggcggcgaacagcgcgtgcatggacgtgtgccactacggcggatgccggcgcggcggcgagtgcgtctccctcggcttcggccgcggccggggatgccactgcaagtgctagcagctgaactgagctgagctgatctctgatctgaactgaactgatatgctaatcaggttgagcaaagtagtagaagcagtaattaggagagaataaattaatgagcgctaagctgctgtttgtagatgctcgcttagctactgtcccgttgctggctgccttgctagttttcccgcccttttttgttcctctgttttttcctgatcttcgtgttttgcatgagttggtagcacattaggtttgcttttgtccgcgctgcctctctgtacaaaagcctaaggcgtgagctttgaaaaatgaaatcgccaggtgccttttgttttcttgcacctgtcttttgcctcctttttacaacaagctcgtgctaccaagtaccagttggatctaaacaaacaggagaaaataatcactggattgtacttgcggatccggagtgttcttttggttgccagaagcatgtgtacttccgttacaatgtttgtggtcaagagtttcataatccatgttctagagacaggaattctctaggacgcatcaactattcgaaggtgtgtatgattctccaggacgaaataaagtaagcaccattctgttcttcgggaccaacattgtcacacaccatccactctctgagactcggtatcaaatattcgcttgctaaagcaagatacttcctccgtttcagtaatatgaatagatttattaacattaatatgaatattgaaaatattagaataacttatattgtgaaacggagagtagtactactacaagatgtgcgcattcctgtgagaatataacaggcaagtaaagaaagcccacccaaccaccaaattgcttatcctccaaacgacaacaatacacatcagtaactctatcttcacaagatgatcatcatcatctagctcatgtggcagacaacacgtacaaatacaactcatacatcaccacaattcacgaagaacaagttacaagggaggggatagaaaggtacatgagcagttctgcactacagattgtccatcttttttttcctgttgaaaaatcctatactgtactgagaacacaaacaccgcaggacacaagtcttattcacactttgtaaacactacaaggctcaagctgatcaaggacatcacattcggggtgctgtccctttaatgggggcgatgaacatcaagtggccggcatcagggacctcaaaacaaccacacaaacagggacctccaaacaaccgcgcacactgggggtggcagccactgtgttgtttcgaatgcaagtacaccgattcgagattactctatagtagttgtattagatatcagcaaggtaaaaaggagaaaccacgagatgtactacacaacaagctgcagtccagactccggataggcttttacatttggatagacatcacctcaccaggcacttttgctcgtcaagcacacgatgcacacctctgaagttgggtgtcagcaaggctgttctgacttctgactttagctatgatcaagcacacgatgtacacctctgaagcaaggtgccagcaaagctgttctgacctcttgactgtagctatgaatctgtgggcgtggacaaaaataatccacacctttgccgattgtacatgaacaggatatcgggcaaacttgagaactgtgcagactttggagtcatgtatttacagctactgtacaggatttttggctggcctgccgattaatcgacattgctgaggcagcaaactgcatcgaacttgccccttgacatgcaatagttcaccatcaataccacatccatcatgtgtgttgggcccagccttgagcctcacagacttaacctggaaaagttaatatgtccgtgaactaagtaaattaaagaaaagagttttaacatgaaaacttctggataacaataaaaatatcatgacaggttcaataaaaaccagaaaattctaacgtaatatatgccaatcccgactttataggtttacccttttttttctctcatctatgattccaatttccagaacagattgtgaatggcatgtgaaaggtaaattttttcattacacacctacaattgaaccaagttgtgcagtgaatccaggagatttgcaataaaaaagaaaataaaaaatacaataatcacatgacatgcacaaaaagattttaaaacaacagtttctaagaatgaacgaaaaccttaatatttgaccaagagaaccaatcgtattaccttcagatattccacattgggaagagaaatatgctttccaaactgcaaaagcaccaaaaatttcagtaacctcagcctcccacttccaccaaccaacagtaggtccaggcaattgtcatcgtattcagccttaggagcaataacctgagagcttaaactctgcacagtcttgcatgaatggttgcataccagtacaccaagataccgccccttcctaactgtccatctttcatctaagcttgggactagttccttagtcagaccaagttcaatatcatccaatggaccaggtaagtcaatgggagtctctggttcccagttaggttgattatcccatttaggctcatcatcccacttgggtcctgaatcccacacaggcccaggatctgaaattgtggaggaggcgtcttctttgtcatgtgttgtggtaccacgagaggaatttgcatcatttgtagcacccgagcctggccatgccttttctgtccttgatttcgatttggatctacgccagttgggagtcgatgaaacatgagcctgaggatggatcacttcttctggttctttgaaagtacttgttctccctaatgataggcgctttgattttgggtcaagtgcacgaacaagttcagagggttcattattagcatgtggactcgaaacctctagatctccacctgacattattcctgtagacatgattgaatcaatgctagataaacttgaggcacgaggtagacattctactcgcgacctccgaactacatcatcatagaggtctgatgcatcaactttatcttgcccttccacaattttatgctcaccaccaccaccatctgatattggaagatactccaattcaaagttatactttggcaagcacaagaatttcagaaaaccggctacaaagtaacggagaggaccaaaacgcttctggtatctctctgagagttcaagaactgcaatagaaacaaatagtcagattttctgcttccatttcaaaaaagaattaatattgatccaacaggaaaagaaaatggtctgaaatgtcaattatgtggttaccatcactaacaaaaccaaaatatgagactgttgtgccaaaatggatagtcccactttgaatccattcaacggcaaaaacatcaatgggtgtaaaacctccctgcaagcaatgaacagtttaacaaacattgatgtgaaacaaaaaagaaaaaaatgctgacacaaaattgtgagggcaataattaactcggtctacgttagacagctaaactagtacacagcagaactcttgactaatttgtatgcttcacagactttcagtgccctgctacattttcttgaaaagcagcatgtaaactttcatacacgattctaccttcagtgttcaaactaattcttgccagaacaatggtttcaaatgatggattctctaagaaaaaaaaatcagcatgacttctgtgtactttcagaactgctcgactgcacctggtgacagaagccccctttgacataagttgagctagcttactactgtggcatactaggatggctagttaatggagtacaataagcagatctagaaatgtcagtacaggcctggccaacaattccacatccccagggtccaactagagcaaagcagtgtgaacacatggttggcaacaaagagtaaagagtcatgatagctagtaactcaagagctggtatcatatccagcatcatcaataacatttaatttctttgatgcctagtactgaatcaataaatcatgtgacacgtatatagaaaaccataaatactgaaacaatataatgatgtttaccctgacaattgacattgctgcagaaatcggatctttaacacccaatactgtccaaacaagtgagttatcggaccctgctggtattataccaattggaacagatacagccacattttgatcatctctacaaaggagaccattgagaacctacaaaatgaatttattaatgcatcagaacctgtagttgacaaatgagcattttatagtgacatgcaaggagaggatggcttcagaaagtggaagacaaacatggtctagtgttcatagaagtacataggttttgagaagtaagcattaacagccctcatgtgataaccattctaggttagcagcgtcactgaaaatgatttgaaggttttgtgggttcgacaaccagttgtttaatgaactccaaaattgtgaataacaaagtaaaatattacaatatacaaatctgctgatccctgggagaagcttcttgaacttagtagtttccccctgaaacagttcaggctgaggaagtagaaggttggtttcagaacaaagttgcgaaacttcaagcaattttcagcagtttatataggtatatcctatttgttcttgatataacagatcaaaacttcagaaaagctaaggcaatttaagaaactgtaattggtaatgttgtcataaaagattaccttctctagttggtataccaaacacattaaaaataagatgaggaaacataaaaaaatcatgcatgaaattaacatagactaacctcattaacaatcccatcgccacccacacatacaattcctagaagacaggcacaaacatgaatcagatgatcaaaatagttatgtagaacacttcaggtaagatgtaaagatatatataccatctggacaggtactgaaatctattgttgatacaagagattttgcatgaccagcatgtgtagttttgaccacttccatcttgaaacctgcaagctgtcaccggcacttattattgttataaaaacaagcacaaccacatgatacactgaaaacaagttgttttgctctggaatgataagatgagtatttccatacaattgaatgctcacttatgtcaaagactatagtgatgccgaattttcatccctaataaattcagcattacagagatgataggacatggcagaaataatcttcaaggcatggcactagaagcagcaagattgatatgtaacgcagtagagacaacagtgtatcaagatattactccatcacacgtgtctatgtaataccaatatcttgattcaaatagactggatgaaaggatacaacagctacagacacacacagcgagagagagagagagagagagagagagagagagagatttaaaatcccttaaagttcaggaacatttcaaacatatgaatcataccaaccagcggaccttgacagataatgtgaactactagagccagagaaccttcaaaatggctcctggcaacaaatggatagcaaagcatgctccagttcaacaggagagatgattcttagggcacaatatgaactcaaacatgaatttatacatagagaagctcatcttggtaagatactgacaacatgaatattgatatggtcctctactacaaacgaattcatttttatggagatggatcaaggaacataataaagaaacagttcgtgccttttcatctacctatgcaaagttagcatcttacttgattactacaaataaaaaggtcaacacgattaggtatatgacttgcatttttatcggtaaccaatgtcaatggtaaataaggaaacatgaaagacactcattgcaacattttttttaaagttatgtaatgactatatgaccatagctaatgctgcaaacatgcttaagagttgatgaggcagacatcacagctctgattataaaataatgcacatgattctattcatctagacataccttgaatataggttccacttttccgtggaaaactttgctagatctaccatgtccagatcgaggattcaagatgacaagtatctttgggggagaccggcatttaacacatggatcaaacatattatcaaatggaatgagttcagatgaatgcttcttgctagatgccatggggtgaggtaatagatttacatagcattgttgatctgcaaaaccattaacccaccgaaaagcctcgtgtggagaagtggataggaaacgtaagtccttttgaatttttctaggcttcataaagcaggaaagtccactggatcttttttcaagagggcatgcatgcacagtgaagtgacggagcccggaatgatatgatacctgcaatgttaaagttgaaaagatcttagaattgctctcacatgatgtggacttgcagtgaaactcagaaacataccaacgcaatttacagaataaagtcaatgagctaaaaactcacagatacaatgtcctcgagcttaaggatattagaaccccataccaaggcttcagtagtgagtctagcatcaaagcaattgctactggaccctgatccagactgttcacctgatgcacttttggctttgttatccaatgtaagcttcccagaacaaatttcataccctaacaaatcagacttctcatcttcaattctgttgtcgtgtgtgcctgccttctctggatccttgatggcatcatcaatatccttttgctttaagaattttgaattgcttgtctccaggaatacaggagaagggttatggtctgctgcagttggagaacgcctgctacttgtgcgacgcagcactttatggattagccctcttggtgaagtaagattctgctcatgatgatcagacttctgaatttccatcttttaagggagcccagtacatgcataacattgggagatgctagatgctatagaaacatgccaataatggcatcactcttataagctcatggaacaccaacttatggctgtgtgcctgcaaaacatatgtaacagaacatcaagcaggtaataatggaacagatctgcgcctaattgattgctgtggcaacatcagtaaccaatgaaagccgcaatggatgagtagcagctactgagtgttcagttaaatcatcctatacatttataagaaattgcctacctaatatgatagtttagctagggatgcaagtggaccagatcaggctgacccattgaccccttctagttcatttgagtgcaaataatactaaatggaccaccaataggtgggagtgatccctagaccattaccatagtacttgaggaataaattataacagatcctacaggtgaatttttctaggtccaccatagccaggagctaccctgcatcaataattcatctctatttgaactatgccagacatacaaatatcgatgtatgaagctgaaacactcaacaccaaccttttaatcaaggacagagatcaagccaagtcaaaccacacagaccaaaagggaaaaaagtatttagaaagctacatagaacaattaatttatagtgccactttgtaaccaacaaaaactattttaaaatgaaaggttccgttgttggcctgtcaaaggtgatgacagaaacttaatgcatatacatatgcatgccattaggtgataataacatgagtaaaacgcatggtcattcaacatgtttaggtgtgtcatataggtcactacttccaaaatgcacatttaggtcactaatgtgagttaaatgagtcatgttctcatctaactatccatgtaagcataccttacacatgacatgccacctaagactgaaaaaattacttctgaaaatgtgcagacctagcaatgtaattgagtggaacaaaaacatagtgaaaataaaagctgctagggtttgatggcaactgagaacttgaactcgtcaaaataggcacatgaaataatttagtttcactaattccgtgtattgccaattagtagtgctctgacaaaggaaaaaatacacaaagagttttctacacatttctagatgcaattttttaatcctatgtggcatgccatgtgtacaaggtatgctcatgtggatagttagatgggtaaatgactcacttaactcacattagtgacttaaatgtgcattttctaagtagagtaaccaatatgacacctaaacaagttgggtgaccctccatgcattttactcattaaacatttttttgacaacctttatagaatttatttataaatatacgcatcataggtccatacaaataaagagtagtaggcattacttatcattttaagagatcccacagtgaacaatagaatttacgatttcatgaagtgggcattcatagcaaactcaactatatgttttatactcaatgaacaaaggaatcaaagggacatctcatgttgttacttttcatacagcatatgaatctgtcttatagtaaacttactcaatggtgcaaaccttactcttatagagttacagtaagatgtctgaaggtgaactacagatgtcggtgtaacttccatcaatcattagggaaattaacttccattctatacaaaattgtacagatatacatgagttattccgattatgaaacaactacacctatagcatctacatgatccttggtttgtgaaaaaacacaagtgatggacactaaatgttcctaaatcttgtgggttaggaacaaatattgctcaaggaaagctatctgctgcattgcccaatgaaaaaacaacaataaaaactatagtacatgaagcacatgaggcgtatcaactggattcatcacccgtccaggacgggaatgaagaaaccagttcagaaatgactcttaaggatctgcaaccaatggatagtggccaaggaaaagactaataagcaaccgaagagaacatcatgttaggtacaaccttggcacagaaaaactgcgtctacctaaccacagaaatcagaaggcaaaagcatcccacagccacagcccacaggactcgcaccacagccctgggcgaaacgccgccgcccaaaccgaattcgcgcgccttccagagcaggcacgccgaggaggaggaggagggcactcaccgatcggatcgagccggacggaggccgaggccacccgaagcctccccaccgccgcgggcgctccgccccaccgcaaaatccccgcgccaccgagctcgattcggcggcgaaaccctagcttggtcgaagcaaacggagagagagagagagagacggagcgcgtagccggtggaggaaggaaggaagaggaggggggaaatttattaattaacggagagagacagcaaggcaacgacgacgaggaggacgaaggtatagtggggggagctgctttggtttgcttttaatccccgattagactgtggggattagctgctaatcgtgccatttcctgcgtgctaattatggcacgtagcgtgtcttccacgaagagacgcaggaaaggaaaagggggcggacgcctgctttctctttggattttatcggcacgacccccgcggccgcacgatgggaatttccgacagcttttttatttgggtagattcgtgttattataatttttgtggttttgttattataatttttgtggtttggggaaaaaaaacattcttactgtttagtactctgtactgtttttgagtggttatttcgattcatgtcattataatttcacctttattaaaaatacgctaatttttagatcatattaccctcatattcttccttcatcctctactctctttcatattcatcttctccaccgctagatctgacggagctgatgtcgttgaatggtagctctaagcagtatgtggtgggaatagggcagcgttgttttccctcgttggttgaccctgctcattgacctatttgcatgttcacacctcgaagcccacaaccctcacctgcacgaggagcttcccaactcacagtcccaaaccccaagaaggcactcacctttgagctctcccgcgatatgggttaggatgtgctcttgccgctacctaggaaggaggaaggtgaagtgggataggtgtcagagctcgcggttggacgcgacaaatgggaggatgggagaatggtgtggccagtgagggaggggatgggaagagaagagggccctcccatcgtggagcttgtcgcactactctgcaccgttttcactacatggaactcgtcggtccgagtccctgatctaccacttgttggcaccgggagaagcaagggcaatggtatgagcttgtcggcttgcgccttcatgatccactccgccatacgccatagtgcgccgaggagcttgcgggagaagggagaggtacggtagcagcagaaaggggatcgaggggagaccggccctcggtccgtgagatgatggggactcgtcatccgtgccatcgccaaggctcgcttcgttaatttcatcaggttggccgcctcaatcttgagaaatgaactagagatgaaaagtggatgaggagaatgaaaagggtaatatggtccaaaaattttagagaaatatagtaaaagggtaaagagtggcatattttgaataacaacttcaaaactgtaaaataataacatggatccaattaacccggtatggccgcggtacactagcgtgtacggtgaccccacctgtcggcctccatcgctgacgcgagttcatcgacctgagtgtgttctgcatctgcacatccacagctcggccaatctttggaaaatcataatttagggaatttgggcttttatgatgtgcaacataagtgagcccatcttattcttcagacttactgttgggccactcatcttaccttcacgtcccatactgccatctaactaaaggaataagttcacttgaagtcccttaatttgtcgccgagtcttaaatttgtccctgcaccacaatattagatagaagcatctttcaactaaaaaactactgacttcgatagttgatggatgcaacatatctgatattgcggtttatggatgaattttagacttgacgatgacttagaaacctaaagtgaacttattcctaaactaaatgggcttgctttgtaagttttactgagatctgggtgttgggcttcgtaaatggccaaataggcctcggtgttggcatggtttacaaagggtctgtctggcacagctccaactctagctccacccctcctggagttggagctcagccaaacagtttcagctccatcaaaactgggagtggagttgggtggagctctctcacaaaatgaactagagttgtggagctgggtttaggcagctccacaactccactccagacccaactcctgaagctaaatttatgagttggagctgtatcaaacagacccaaagtattgacaatctggctaagcgcctatcaacgaaaagaaacacagatgctttgaaaggttttttttttaaaaaaaaaagttttcaggggtcaatcccaagtgtcctaatattgctacagattgatagagctaaccacaaggtctaatggaaactttgcttccgaatcagaataggacatatacactttccgatgtactataaacttactacaaaagaaaaaaagcggtgaaaaaaaaaggtactacctccgtttcatattataagactttctaacattgtacatatttatatatgtgttacacacacacacacacacacacacacacacacacatatatatatatatatatatatatatatatatatatatata

SEQ ID NO: 37746 - DNA, 13040 bp, Oryza sativa
accctcgagaaggaggagatgtaaattagatctattggatcaatagacccgatgaactccgagaaaatccattgttaaatggcctataaaacgaaaatatgacatcgtgtaccgagggatattaagtttagagtaacaccaataaactatttttttctcgatccgcaactaatgttgatggtattgttgtaattccatctatgccttcccagactacattagaaaatactcgttttagaccttctcagaagaatctttttacctgtgacccttaaatggcgtattaactttttattagtttggtgttaaagcctcttttaaatggtgcatatgagccttaggatacatatccaaacattttaggtacatgcaaaaaagtagttaggtgttgtatgctttagagcaagtctaatagtatagctcactactagctccaaatcatgtacagccaatatagtagccaattcatataatagttgcttactatatactattaatgcatagtctcacctgtaatatatacgttatgtttttgagtccatgctgtagctagctacagatctgtagcccgctactcttctctctcttctttatctctttaaaatatatttatagctagtttatagcttgctattgtacctgctcttacatgagttttggcatctatcctatgtgaatggctagaattacagcctacagcccccaatgctccaagaatttgagtcacaattattttcccttttctcctctccatgtggtttgtgcaaaggcaactattttgtccttcttgtggtgatgtttggacacgtggcatacttgaatagaggaataaagtttatcaagatatggatgctatggtcctcaaataaaagataggaattcctcacaaaaaacaggagaacaaaaatagacatggttggctgacattaaacctccaaattgaaaaataccgccaaaaaagaagccatggatgaagcagattatactatcaaactgctcatacgccttttgcacatttgtttcagatgacacttgtatcaccattaaagcagtattgaccaaacaaaaacaggccttatttagattcaatttttttttccaaaaatgtcacatcgaatgtttgaacacatgcacagagcattaaatgtggacgaaaaaaaaccaattgcacagtttgcatgtaaattacgagacaaatcttttgagcctaattacgtcattatttgacaatgtaatgctacagtaaatatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaagattatggatgggttttattaatagtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacgcggaggcgtttgcggtggcgggcggaggaggcggaggcggcggggagggcgcggaggccccgctgtcgctcggccacatcgtgttcgggatcgcgggctccgcgcacctctggccgcgccgccgggagtacgtccggatgtggtgggacccggccgccatgcgcgggcacgggtggctcgacgccggggcgcccgcggcgccggggccgagcgcgtccggggaggggtccctcctcccgccgatccgggtgtcggaggacacgtcgcggttccggtacacgaaccccacgggccacccctcgggcctccggatcgcgcgcatcgccgccgaggccgtgcggctcgtgggcggcggcggcgggggcgcgcggtgggtggtgctcgtggacgacgacaccgtggtgtccgcggacaacctggtggccgtgctcgggaagtacgactggagggagatggtgtacgtcggcgcgccgtcggagagccactcggcgaacacctacttcagccacagtatggcgttcgggggcggcggcgtcgcgctcagcctccccctcgccacggcgctcgcgcggacgctcgacgtctgcatcgagaggtaccccaagctgtacggaagtgacgatcgcctccatgcttgcatcaccgagctcggagtgcccctctcccgcgagtacggattccatcaggtatgagcttatttttcaacattttgtggccattcaacagaaatgtgggttgggtattaacagcgcttagattattgagtggtcttatgaaatgttattcgcctcagcaattggagcacttattctgttctgctttgtacgatctgctgatagactagttaccagtgacacagtgacttgaattcagggactatccactctctcctgatcccatgcatgaatttagtgcgaaatagcatgctgtctatgctcacggaaattcgggggattgctaatgaactagcccaatttagaatttgcgttagatcttgggaggcatgcatattgatccactctttggaaccttaccatttctgtgatgcttgattcattatggcagaaaggaagtgtagcctgtctgctgttgtgccaacctagctggctgttatatgttcaatcagaatacatgaacaatagtagtagggtcttgccagagtggttatgttagattgatagtgaaaggaagtttggtagtacttgaatgttacctttctttgggctcttttatggccagcagaagtttttgcaagaacttgcctgcttgctttatagtactattgtaatttctgtcaaataggtaccagcatgctgcatgtgtttgaaaatatgataataagtgattagcaagttcttttttctgtttgcacattaacaagtcatatttacttttttttattaatcgtgtgtatggagaactaaactctactctcttaatcttacttttgtccctttgcattgtaatcagtgggatatcagaggcaatgcccatggtatattggctgctcatccaattgctcctttcatcagtatccaccatctggagcttgtcgatcctatataccctggtttgaactctcttgagagtttggagctctttacaaaggctatgaaaacagaacccatgagcttcttgcagcgctcgatttgttatgataaaaggcagaagtatacatttgcagtctctttgggttatgttgttcaagtgtacccctatgttcttcttcctcgtgaattggagcgatccgagcggacttacattgcatataataggatgagtcagcgaactgaatttgattttgacactaaggatattcagaaatcattgtgcaagaaacctatattatttttcttgaaggatgtttggaaggatggaaacataactaggggttcttatatacgtgcaagtgttcgggatgacctaaaaaacaaagtgttttgcttcaggtcaccccctttacctgacatagacgagattcaagtttctgcatccccattaagcaaaagatggcatctggtttgttctaatattcctaacaatatatcatatcttgtttctacatttacattggctaattgtcgtaccactgatataggcaccaagaaggttatgcagtgcgcttaaaggatctattaatggcactttgtttatgtttgttcggcaatgtggacgggggacatttggctcagcttctgattctctataattgatggaaagcagaggtgtatattttctgttcagatgatacctggaagatgtagttaccatcctacattctttgaatcgagtgttgtgggggctctttttctgcctcgagcacttggcagttaccaactgcttgttatacttggtagttgttgaaggtagtttctgtatcttctgaatagtgacattagaaaatagttttaatcgttgaccgtaacaattgggattcatttttgatgatttttaaggtgcttctaaaattatgatggtttctcaggctagtaccattccctatttgacgattgatgacctgtaatatatctaatgtaggccttttcaggttttcattcactttgtactatatttcatcaattggaaaaaaacccaatcatgcatgggctatactaagtttaaacataggtctcagacataaatatggaccttacttattacataaaaaatggcatcatgcttgtccatacctactttgagttgcaaattaattccatgtgctatgtatgcttatcatggtgttgtcttttgatatggatgcaagaggacccttctaggagatcataaccccccctcccccccccctattttcattagtagaaatgagcattacaaagtttctgaccgtcagtattatgattaattgatcaaaatttgatactttcttcttgtcatgtaccattttgttattaaaggatatagtttctaactttgtttaggcatcagagcaatcaaatcattgctaatatacaaaaaggaattcagaaggatatgcagatatacaaacagttgaaaaatgacagggaaaaaaatatgcctgctgattggagagagattttttttgttgttaaaaataagttagcacacaggcgtacgattcaaaattaattgtggtctaatggctgagtcgatgagcgaaaatacctagttgcttcgcacgatgaatccagttttctacgtcttgcatacatcttatgagaaaataatcattgactgacatggttgtcaactattatgttccagttacgaggatctttttgcagaaagctctgaaaatttaagttgcatttgccattttagttatttgaaggaaaaaaaactgttgtgtctagtcataaactgccttgagcttcatttttcctaatttttataaagaatgttggagtgggatgcttagcttccgacaatcttttacagtgtcagtgtgctgtgtgcggtactctgtttcgacaaccttaatgcttatttaagagtaactggcttactggcatatgcagattgatatttttcatttcccttgcattttgttttcagtatccggtgctttatctgtagccttttttcaacactctgttctctacttttatgtcgccacatgatgtgctttaatcaatgctttatgctgtggtcacaaatgttctaacttttgagcaaagtttcagtgctgtattcattcacttcaatagcaagattaatctatcatggtacattgcaaaagttgccagattgacttggtgttctgaaattcttttgtagcagtttgttaatagaagaatctgctgaggaacaaagctgaaaaagaaatactggtggctttttttgtggaatcttcaagctactcgtggatgtacgatacttgtggacggagactgggtgaacggagtgtcaccctttgattagctgcattagtctgactgaaacaactttccggcttcattctttgagacccgtgtactaaccttgatggattctcagtcgaaatgtgaaatcactaaatcaggtaagaacagcactccattagcattgtattggagggctgtaaacctttcccgataccttgtttagaactgtaaatcagtgtgaactgtgaagcgccataaccatgaaagagattccattcaatctttattcctttccagttcattctgaaagccgttatctgctatgacgcctaaatttacttttgtgtccattttagtcctactccttttgatatctgctttatactatcaaagtcttaccacagctaaacatgttacctttattggggcatgtctaaagttgaggatttaaatggggcaaatccgcaaatgcacatgtaccttttccagatcaattaccttaagctatatgccatatcctttctgtagtatatccttgctgttctcgtgtaagtcgaatttctaacgtgtttttccttttcaattgacttccctgatttagtcacggttcaatccagtcttgctgctcattattctacgaatctcccgtatgtacttatggtacactgtttgctgctaaattaacatatgaactgctatgctgtatctgtttgctgctaaaataacatctggacttatatgctgtgtggaagtgattcatcttccttatcaaaaaggaaaataaaatgtgtatgtctgtgatgtgctctccacggtcggcaagcagatatttaacctcctagttctgttcgttgttattttcagtacatgatgtttcctgagtatcaacaatatttttcctcttattttttcccctgaggtgggactatcaaccatattttacccgttgctaatggctcaagtggttggtggttacttgtcaagggcacaaaacatggtacttgactactcctaattctcaagtaacaggtttgttcagatactgcatcgctgcttttctgtttactctgcaaattgcgatcctcttattacaacttgtgtagcaactcttgtgctgtgcaaaggcaacactacgtactgcgctagtacatggtccaatcagggcccaagcccttgaggcccatcttagcccatgtggtttgagctttgccatgtgctccctgagacagtaattagagttaagttagcaccctagtgggcctttttcttaattgtccatgagctttggcatccattatcgaaatgatatgaacataagaggatttgaataggtgggaaggaggttaaacatcttcccactacttgatcattggccctattctttccttggtgcatttgtaaagtccaaatataaattttgatgtactaacaactatgctttccaactgtcaactgttaggcgctgactttttgtagtttaagactggagatcagattcggcgtatggtcgcatggtctcgtgggacatttcatatcctcgcaaagctagcttaaatgttccatcatggggtcatctgtcaacgcattttgcatgttgattttgatatttcatatcttcgcaaagcttatcggacgtagctaaaatttaaattttaaaacttaaatttaaaattgattttgatgctttttatcgtagtttattttcaacattagcttttaagtcgctaaaatatatatatgtagaagttatatataaaattagtttatatttgctaatcagcgttacgccttataataagtggtatgtgaaaggcaaaactatcacactgggactgaggtgctctcctctaatatcaactctgttaagtttcgaattccgtgaaccaaaattcttttgtcagcttccaccaaaaaatgtcctcttatttcttctcttgaatataagagcctggtctctataggtgaagtacagcagttttaccaactactatagtctggttgacacagtatttttttttcctgatcatgcatttacgtgatataggcccatattaactgttactcattactgttgcgagcaaaacctaatttcagatcaaggaccacacgagtgtctctgactttcagattcagtgtgaaaaattccttgtatttattccgtggacttgcaggctgttactttgtcttttggtgttcatccagcccatgttttgtcaactctctacctaacttgcttcctcaatcttttcctaccctctttctactgtgttttgccccagtaggtaaccaattccaatgtaaaaaagagaaaaggagaaatgtcttcagtggcgtgcagccagggtagtatagttgtgtggttaaaatttggtttgacatctctggctctgaccagcaacagcatcatctttgctcctaatgaattctaatgaaattgctcaattattaccaggatttaagaaaaacctacctgcatgcatgatctaacctctagaaaggagtccttttgccttctactaatccatttctaatttttctttctgcgaaatgcgatccatcattccatctcatcgatcccaacattttgcaaccgatatacaaaacagtacagtgggaattgtgggaaaggtgagaccaactgtgcagtaaggcgagcagttcggttgcacgctatctgaaacatgttttgtgtgaaggctaggcggttggaactaacatcatatcgctggcaggcagcgtgcgtgcgtgtgtgtgaggatgaacaaagagacgatgcgtgccgcaaaggaaaagcgcatgcaaattgccttcgttttcgcgtcatcccgcccggtgcatggctggcacgcgccgccgtaagcaaagctacgccgagcatgggagtcgccgagctgcggtggcacgtacgtggacctattccaaacaacttcaccgttttgctcttcagcttatcagccgtaattaaaatttaaaattatcagacttaatttaagggttgattttcaatttttttcgtcgttgtttatttttagtttagagcttttaaatcactaaaaacatatataaaacgctttacttatactatatataataaaccttacggtttaaaatctgctgtaggcgaaactatgggaatgaaaaatgtttctcaataactaaaccagccacttgtcactttgatcattcgttcacagatcacaggataagttgactaagttcagaaaaccgactgcaaaatttctcccatggcacgagctctctatctctctgcccccaatttggcgtagaaaagaggtcaaaattacgtagaaagctctttctctgtttctcataagtgagctttgagcttaacgtcgaaacgtccaagtgttcaactctccaagacctcgatgatgctctctgttaagaggccaaaattacacgtcagatgagctgcctagtgtggccgtgtccgtctgcaactctgtttgcttctcccattgggtaaaaacccaattattgatcttgtgtgctcaactgctcatcagaaggtggcatctgactatttgtaccttctgcaaattcatccacttctgctgcccttttcacatctcctaactaattgccgtgtacttacacgctgatgccatttatttcctcagcttcatccacctctcactgacccattacgtacatcaatcatcagatcacacagagatactcctatactcctccagaatgtcagtgtgctacagtacgtgtaatttcagaaacacggattcagcagagtggtttagccaataattgtgcagagtttgcttgcgtgtaatacaaaccaatccaaaatgtgcatcaaaagcttggagttaaaactacctacccatcttcacctaatccccatccttattttacgagtccttctgtactactaccacttaattaccacgagtcattttattcgttatcagtagcaatcaccaacatctcatccgctgttcatctttgactcctgaaagctgaaaaaacatactccgtacagtactctactagttttttctaaaaaaaaaaaaccatatactcgcactggaagcagtaaattgactggaattcctcactccagattacgtgaagaaccgagatatttcacgcagtggatttctcccggtactgatcctatctctgaaccgtactactgcaaagcctgcagagccgtgtctgaattctgacactgacgaggttgcagatatctgaattttttttttgggtgctgaaagctgcggccactacggacactgatggttacgtgaggccgccggcgccgaagctgaatatatgcagatgtggccgtgcccttactaatggcactttaataaccagccgcactgttagaaagaagcaagcaggacagtgctggctctaactcttaactaactgaattaacttcacatgtgactttgcactaccgtatcttatcttccatgaaagtttttgcaagtgtagtttccagtgctggacgatttaagcctttcagaagatcagatgctgcatgtcaaatatggtaacatggtgtccatctccgtacatttttctcatgcagaaaaaaagaatgaaaagaagaatgaaagaaaggaacattgcgtgcatagggatcaaacattgctgcatgctgagatgagatggatcctgtagatgtagctagcaatggacaggtaaaatttggccatcacagtgtttgatgcttgatctgatctgatctgatccgatctgcttctccagaatgcaccagccgtttgcatggacgcgtctctgtaaccaggtgccagccaagtcactactgtcaagagtcagcatctgtaattctcctcttctctgatctgtccctccctgtggcctgcgtgcgtctctccatccccttcatcacctctctgtctcgcctccacgaccccgttcttttcggctacttcacagttattgttacgggttactcatttcacgtctctaaaaactcatcttctaaaaaaatagagaacatttttaattgtttatatcatatcgcttgttataagttatccgcttactatatttaatttatatttataattgtatagttaatctgctataataatttggtcaataatctgttgtagttttggtcgtgaaaacgggagaaatcgcaacttataattgtatatagataattcactattgggacgcaggctattcatctaatttctctaaaaattcctttttttctaaaagaaaagaataatccttttactgcacaacatcacttatcctaagttatcagttattaaaatatttaattatttactatcataattcagtggataatctgtttcaagcaggtcgtgacaacgagagaaagcaaacagccaatagctcggccgcgggcgtccctttctcgtgcatggctgcaacctgacggggaacggaaacgccgagcacttccgcgcgcggcgtggaaggaagccgcgcgcgcgcgcgtgcgacttggcgaggggagagccacatgtgtgcgtgaggagacagttaggcaaagctgggcacttaacagtgctgacactgccgtgtgctttgacactttgacagtgaaatccccttgagtttagttcttttgctcgtctcccggtggcatcattgctgtgctgggggctcaaaaaggagagagagatggagagggtgactgtgactctaggttacaccttcaccttggttaaccttgtaaacttgttttgtttagatttaaccatggttgcaaaaaataggggtatttgcttttccacttgcaagcttgcgtgaggaatccttttatttaggtttaaccatggttgcggaaattgggtgtgttccttttccaccggcaagtcgtgtatgcgtgcagaatcttttgtatttaggtttaactattgttgcggaaattggaggtgtttcctttcacactggcagacgtgcatgcgagatcttatgaccgtgataatttgataccataacgtttaatttgggcggaggtgcttcttgtgcttcttacttaattacgagctcattttcggattcgtcctcgatttatcaagaagggtcaattaaaacatgcactaatgtttaataagatttaaccacggttttttaaattggaagttttagggttggtttggtttgtggtcaaatagacattaccaaattttgtcagtgcaaattttagtaagttttggcatgactaattttattaaggcaaagttgtgtttggattgaagctaaaatagcctaagttcattattgaaatgacatattttcttaggcatgtcaaaatttagcttcaaaccaaatagacactaaacactattgaaattatcaaatattggtaagcctaatttaggtctcaaaccaaaccagcccttacttttcggctagtagacatacgagtgatatatctcttaactatgatatataccacactacgagtatttaggggg

SEQ ID NO: 37747 - DNA, 11894 bp, Oryza sativa
aacacccccttagtctaggatacttcttgtaaacgatggaattacttcctagtagtatttgcgatctcaattttggccttttgtcctcgattcatccagaaggatcaactggaccacacgcttagttttcaaatagtggagtacaatttgcatgtacagagattcaaaacaagaaaaggggagcatgtacaggaagtgcgagtctaaaaaatgtactgaattcgaacaggacagagtgacaaggagagggaatggcttgaaatggcaatgaaaaggccaggtcaaattggcaatcacaccggccagaaaacctagtcaaaacgtcattgaaaaagagaaaaaaaactgaggcgttcaacctgttcatgcacgagccgttcgttcggttcattcaccttttcacagcggtcgctagctgacggcatgtcggctcgcttgtgttactactacttgattaattgacagctgcatgccataaaacccaattacaattagcagtggtatattttttttcagataaggacaattagaagtagtagtaaaagaccaattctttctttgttaattacgcgtatcaatggatggccttttccatgtgcagcagctgcagtggtatgatcactgtcaatttatgggccggggttgagcagtatatttgacttcaaaagatgggaggccattttaatcaatcacctgttctaacaacctttaactagacgtgtttggtttaatttcaccgttatttctagaatgaggtttgtgtccggttgttgatacggcgcacgagtttgaacagtgacatgagagttgaagtactgctggtggtaaatgctaccaaaattagtccgacgtgaccaattcaattattacttctctagtttctacacttttgtgccattggtcaaagaagtaatactcgtggatgcacacactataaagatatatatcattctcaatgttccggtatattctttagatagcacttttaagaaaaaaaactttttaatcacaaataaaaatatctataaatttcaagcattaatttaatgagaatgatactggtacattctgtagttttatgatactctactttaaatctgtaattttgtaatatattttgtgttaaacctatagttttctgatatatcatctttaatctataattttgtgctaatttggtcaatatatctataactttgtgaaattacttttttatataagaaaatggtgaaaagtggcacattatggggttgggttttaatatgcatgtgatgtgaatggttcgacttctctggtttggttgaacttttgggtgagtttcatttttttttgtgagaaaagctttggatgaacttattgttgcatacaacttaattagtaaataatatcagtaaacatttcactagtcaaatttatgatatatcggactacaaaatgcagaacaaaacatcaactttgttttttagcatgggtgcgacggatgaaagtgaaacaacgttagaaaactgggagtataactgttgctaacaagtggacagcgtacggacgaaagggtcagcagtggtcaaattaaccgattactgtagctagccgtcaaaccaccccaaatttgaccgccgaaaaatctaaccattccctctgaccaccatgcatgtacgtaaatacgtgcacacaccatccccgaaacacatccaaaagccgaccttttcatcgaaatgaatagcgatcggtcgagtgagacgcgcgcgctacagtgcaagtacttcgtagcttttttcttaccgtcggttactgtggtatacgtataccgggcacatactggtactactgagttggagtataattttacatattgttttcatactatattcactgttaccgtgcttatcttaatttggctagggtaaggatttgcattcttgatgaaaaccgatctggatttcacataatccagacttctctaacgaggtaaaaaaacaaaaatcgctttttcatgttaaattcaaaaaattcaagctggactataaattttcgacaaaaaattatcgatttcatctctttttcatttttatcaatgtctttggtgaattccaaagatacacctcgtgagcggtttttatccagtatcaggatcgtgaaccctattccctctcccccgattgtccccggtaataaggcaaactaagagcaggtacaatagcaggctataagctagctataaacatatttaaaggagataaaagagtagagagaagagcagtgggctatagatttgtagccagctgtagcacggactcctagacacaatgtgtatatgacaggtggaaccaggtattaatagtatagtatgtaactattgtatgaattggctactaaattgactatagataatttataatccctccgtttcataatgtaaatcattctagcattttctatattcatattgatgttaaatgaatctagacatatatatctatttatattcattaacattaatatgaatgtagaaaatgctaaaatgatttacattgtaaaacggaggaagtagccggtagttggctacactattaaacttgctctaaccgagcgcaaagcctggaagaaaaaaaaaacaccgagccatcgctcggtccgcatccgcgcgcaagtgtgggagcagccgcggccgcccgcccgcccgcccgcgcgcgcgcgtgtgccgcatgggcaaattttccctctcacccgcacgtatgcacgcatgcgcgcggcgtttgcgtgtggttgcgtcgcgggagacggcgccccgcgcccgatcgatcgatcgaacgagcccacgcgccgcgtgcgcgtgagccctcgcacgcaacacatgaagctagtcgatcgatcgagccgccgtttcgttagccgacacgcttcgctcgatcggcagctggcggctcgcggaaaaggcgagacgaaatcacgctgcaacttgccgccggatatgcacgcattgcatgcgtatccggtcaaaactcaacggggatccacagctagtttatttcaagtctggactacttggttcatcacatcgaccaatctcggtcagcctcacagttgatttatcgctggtcgtatactctgctctctttttttttcaaccctaaaatgcacgcactcgtgtgaaatgaaatgaaatgatacacgagatcgatgtatcgatcggtatcttgttgccagaagctaacgagatgatatgtacgccagcagggtttacattaccatcggtaaccgcgcggttatcggtcttaacgtgggggtacggtaataaaaaaactgcgataacctccttaaattcaaataaaattttaaaataatttaaatttttaataaattttacatggtttcgtacggtttgtcacggttatcggggtaactgtgcttaccgccagggcgcggtaaccctgacccccggtgttttgggaaaccctgctagaaacaggttgggaatctcaacatccgataaacgagatcgatatatcggtcggtatcatccggtgctgcacgttgcaaactcaaactacgggagtcaaaaagtttcgttgcgaaagtgagcagatgcagcaccacatctgtgtatactccagttgcttcctcagcataaacatctctcattctttgacgggaaagcaactagttagcaagcatacatataaacatctctcactctcacgggcattgggatgcacacgcagtagaccaagcagcgacccgactctgatttttgtactagtagcgcctgtagacagcaacgtataatagtacgacgtatgttgccatttgtaatacactaagctgcagcccaccgcgcatattattcccccggacaagttgctacttaacaaaatgacagggaaggaataacatactttgcatatgtacacaaaagggtgttcctgttcatggaacaagagctcgtactgccgctgcagcggcaacccctgtcgtgtggtggcgctcggctaataaaccaatccccaatcccccgagcgaatagaatttgtgattaattcttcggtgtccctctctcctctggtttgatgtgaaatcctctgtcacgttgccaattggaaagaggtagctgtacgtagccgaagtccccgaggcggtttggtggtggtgtggtgtggttggtcaatgcgcgcggccgcgttcgagtgcgtgcaccgtgcgccgccgcggggtgggtgattgggtggctatggttactcagtgttcagttccattcaaactcccaaaaatttcatcacatcaaatatttaaatatatacatagagtattaaatatggatagaaaaaaaaaccaattagaaagtttgcatgtaaattacgagacgaatcttttgagcctaattgcaacatgatttgataatgtgatgctacagtaaatatttactaatgacgaattaattaaacttaataaattcgtctcgcagtttacaggtgaaatttataatttgttttattattagtctatgtttaatactttaaacgtgtgtatgtatatttaaaaagttttaggacacgaactaatcactgccggcttttgcaggcgcgagatgcgcgcgccgccggatgaaaggtgtggtgtgggtgtgtgggtggtcggagggaaagctgcaaaagccggcaggagcactgcggtgcgggcggagatggacgtggtacgtcatgctgctggccacagtggtgcatgcctagacctgcggcttcctgggccactcgtactagctcctggggagagtagcttaagccagatagtgggtaatcagtggaagtgctagaccttggccattccaaataaggagattcggttaactaagtgctttttactctagtattataaaaactaaatatattgttaccggtattttgttacctcatccgtatttgagttcgttttaaagttcgttcgcttttaaaaatacagatccgtatttaagtcggattttaaattcatttgtttttagaaataaaaaagaatcatataagaaatctctttaaaatactccctccatccacaaaagttagaaatatttcacatttgagtttttccaaataagttattcctatttgtagtctttatgcattcaagacttaaataaagagataaattaaatgtttgattagaacccaaggagtcatataaatactcattggttgcatgctttcattcactcgttgaatttgtaacatccaagatgatttaatttctccttggtcttgatgacaaaagtaataggtataacttttgtggatggagggagtaactcgcaagctaacttgagatgaaagtcggattcctaattgcagctcatgattttctaaaaaaaaatatctaagcgaattcttacagtgaatttcatcatagctaaaccgtataataataataagattaaaatagcattcacctgttgcaacacacggatattttttttatctttttaaaaatataaaatatttgtatttgatcggttcttaaatttgaagcagagtatcacgtcgatttggatagcttcacatagaattttcagctcctcaaacagttcatattgttacctaggttctgacaatctatagttgtagtcagaagctgaaaaacaaaattctccgtattctcgaagttggctaccaaccagcagattattagaatcttaaggtccccaaacagaaccgatcatctagattcatgcacttataaaatataaggactaaaatcttggtttaatgtatcacgagatgtataaagtacaaacaatgtagctcgggtgctgacatggttgtccacaataacgagaattttgtatttacacctattcaatacaatatgtcccaaaatccggctttcatcactcccaagttgactcctaacacacatgtgggagaggtggcgaagagatgacgattagagtggcatctattgtcggagataggaggtccccgaaaaccgaggtaagatggcaccatagtgaaagggtgatcccacgaggggggaaggctaatgcgcgtacgcgccagcaaatttagctggcgcacacggcagttggccccctccccggtttcagcgtgcttttctttctcacattcctttttacgattttagtgcccagatccgggcacgtttttcctttttttggtttctttctattgttttttaattcttcagacacctctttacaaatgtagagttgaaagtatttaattttgacttgaaagttttcaaattttgtgttgaaagtttttatatttgagttgaatgttttcaaattttgagttgaaagtttttaaatttgacttgaaagttttcaaatctaggttgaaagttttcaaatttgggttgaaagttttaaatttgacttgaaagttttcaaatctgggttgaaagtttttaaatttgacttgaaagttttcaaatttgggctgaaagtttatcaaatttgagatgaaaagttgaaagttttcaaaatttgacttttaaaaattcaaatttcaagttgaaagttttcaaatttgggttgaaagttttcaaatttgtgttgaaagttttcagaatttgacttcacgcataaatttcttttcaatctgttacttaaaaaaaaatcttatcttcattatctaaaactaatggatttttttacatgctaaaactaacggattagttactagacgcgctatggaaaaaatcccgaaaaaaatctaaccgcgccgacgcgcggtgccgcgcatacgcgtgggtcttgtgggccggaagtacacgtcggcgacgcatatgcgccaattaggaattatgtcccacgagccatgcacgtgtgatcgtcgccgtgaaggcaaacaatggaacatcatattgcacgaggattacggcgaaaataacaccacactgaacttacaatattaaccctctctatgtgacgtggtttttctcggttctagggactatccaccaatgacagtcgcagctatcctcgttaccatttcttcgcctcctctcccactggcatggtgggagttgatttgggaggggaatattgtactggaggggctgaatgtaaaatttccactggatggccaaattagtttctaagtttgtgttatctgtactttgagctgagtgatacattaaatcaaaattaaagacatagatgtgcattttaaaatccataaatgtagatagtactctactccaaatttaaagactagccattattttactattagaaaaaaatagctactctaattttttcaaatataagcatgtctgaccgttaatatagataatatattttggaacgttcgtacggagtacgtgatagaaatgtgatagcaagggagcaaggagtgtccatgcctgtgcaacatgcggatgagcttcggtagaaaaaaataataatgaaatttaccaaaatttcgcataaaatttctaaaaacttattgtgctcccataaataattaattgcttcaagacatgtataaagacaaaatggaagatatctggtggaggaacgaaacaaataaaagtatttagaaattccacaattttattatctgaatataaaatctgcttcagtttttgttcgaattgtctaccgaactttcggtttaatcgcctcctactgcaatacaataaaataaatttgatatgtcctcatcatgagccgtccaattttggatactctcagtttctcaaacgtgtcgaattgctcagcagtacatgtacagtaatatatatattgtagaagtgaataagctaaacgagggggaataattaatttgattgtgatttagcatgcttaattgaattgaccacacgttgcaacttaacacgtacgcacgtataccatttatatatcttttgctactttctttaaagcaaaccaaaagaaattagaaaacgacgagactgaataaagttaaatttatgagaacaaatcaccacgcatatgaacaaaaaaaatggaagatgatatgggatgatagagcagattaaataggaaaaaaacggaagatcagaatatgggatgacaaagtggggtggttatttaatctgatgaatttgaagtgacttattttattttcatgcaaaatattcctgttattagttattactaaccaatatccaatctaagaagacttctcatctagaggttactgccatcattcacaatctcttggatctgatcgagttgagttattaaggtaaactgccattgacgtgcatgcatcccatcagaaagtgacactgcatcacacctaagtggatgagttaaaaagagggtgaagcaactagaaaaaaaaacccaatttaagccacacagttatggattaacacgccgccaatatggtcaggaaagttgggcatctacttgcaaaaatgtggggcccggatttgattaatgaaaatgtgattagatggtgatatgagagttttgagcaactaaatttatctaagcatgcatcctaccacttctttttttcttgctacataaagaatatacatgatagtgtatattatggtatcaggatagagtatagaccgaactattttggtacaagtctacatgtaaatgtgagtttcatatatagttaggtatgagttctacgagttcaacccagataggttaagaaaacgtcgattttctttgacccaacataaggtgattttgacggcacgtgtctacatgatgttggtagttcaatgaaaaatgacctagcttaattacagccaccagtttgagagtaaaatcttgtcctcaataatgagaaaaagtatcccatttgaacacatattattggtcaattaatattatagatatatgattttacattttccatggaaaataatttcataatagattattcatatgatgttaaactatataaatatttagaaataaatggttaaagttttatattataaatgggtgcccctcttttctttcaagagctacaagtacataaaagttattgtataattctagtatagttacaatctaattatattgcgattgcactatagttatgtttgaaagttttttactgaacaaacttgtgacattttttaaatattccctagaactattgcatatccctaatcttttgtataggtgcaaaagcactatatatatatatatatatggatacccatatgggactctatggtgcccgggctccaaggtataaaacacacaaattctcttaaatttttaaaaatttacaaattgtaagtagatatctaggtatataaatttgattcatacaaatacctaacaacaaaacaactcaaactcaactttatttcacaattaattattacatacctaacgaattatatgtctggatgttatatacctagaaccaaaatctaacaaaaaaaagtacaaactcagttcaaacttgtttgaacttgttagtaaagaagttaatgttcatatctaaacattttaaaaaaattcatactcattcaaattggatatatactcaatttgaatcttagagcccatactgtatgtagcaccagttaatttacctatatatatatatatatatacacacacacacacacacacacacacacaaaagtacaacactagacccttacttatatgcatgtcttactttataaccaagtaaatacacatatatcttcgatctattagaatcatatatactggatcgttgaattgaattataatttaccacgtctaggatgaataattgttgaacaatccggcggctaaaaggtccaacaaggagagttggaggttggaacagcctgtcacaacaggttttttgtacgcagttgttaccaacttcaacgccgacgacgacgtcgtgtggccaatcttcacctgtcaccgctggctcctgatggccggcgacgacgatagatgagagccaaatgaataagtaaacatctcatcaacaaaagccctaattaacatgctaattaagaggctatgaagccctagctgggtagtacttattttatttgtgcaagataggattagccttggtagttttagttaattaaagggggtgatttggggatggatggattgtgcttttacatccctcaaggcatcatcaatcattatccttcctccggctcccggcagatgatgaggtgtgatgcaggtgggatcgtgtgccacctggaggggaagattcctctttctctcaccctaaacttcagcgtttttcttagcctttgagcaagtttaatagtatagctaactgctagctctaatttatctatagccaatctaatagcttattcataaaatagttacatactacactattaatacctggtcccacctgtcatacacaccgtgtcttggagtccgtgctacagctggctacaaatctgtagcccgctgctcttctctctcctcatttatctcctcaaaatacgtttgcagctggctatagcctgctattgtacctgctcttagtggtggtggtgctagtgctacacgcacttgatgctgtaccaggataaataacacgcaatgcatgagcatcatgcccaccctaaaaggcagaaaattaacctcctctcttcctatgtatattgccatgtttaccgtgtattcatctatataattaaggtataggatgtgtgcgtaaaattgtttcattttgcattcatgtagataggtaaagctggtaccacgtctaattagttatgtgcttgttttccataaagatttttttttatttgcaccccttccttagagaattaaggtgccaaaaatgaagaatgtgattgaaggtacacaaaaaaggataagtgcttcccctgttggtattgcaccgtgaagtatcaggctcaaacgttcggctacaaaaacttctccttaaagatagttttggtcttactgtcaacagctagctagagttatgtcacaaacgtatgcatacacaaaccgacatacaaaccaatggtcaaaccagagaagcatcccatggtttccattacatacataataacttctttcatttatttgttgtgtgaagtaatacaccaatgatgaattctactacaaaagaaatagtgaaatcaatgacaactcatttttttttaccaaaacaactcaaagttttacgtgtatagtagaattaaatttatatatagttgtgtaaatttctacattgtgaattaagggaaggtaattcaatgaagttgtcagtcaaatttctactacattggtttatggagacatagtatttttttataggcaatatggagatatggattgatagtgtaaatccaaaaatgccgcttgaagacatgacgtagagatacctacatttgtacacattatttaatgagtactacaccattcaccatctatatattttattatatatgaatgcatgatatactacatgatgcatgcatttgcaagaaaattcacattgaaagtatgggcaactcttacttcctaactgtacatgcacatccctatttatcacgaatagagtagatacatatgcacgaataaatatacagtgagatcacaggcgttactcgaactcttgtttcgaagggagcatggaaaaaccattttgaaattcccaattcttgtacctacttgttcatttacatcaggctcaatatttatttgaatttataactgttgaggttaatggagaaaataccagtaaacaatatagaagtgatgcactgttgtgaccatagcaaagctcaaattcaactcccttttgggcccaattctaaaattaatctcccatgtgaaacgaaatgccaatcccggtcttgcccatacattaacctaagccggggcataataattggggtggttaacttaatttaatcaccaagattttttgcctaatcattaa

SEQ ID NO: 37748 - DNA, 2929 bp, Oryza sativa
ggggtccgcgttaatcgccgggcacgttctgcacctctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttggctgttgctgatgctgctgcaaagtagtaaaaccaatcttggtgtaattgtttttctgctgccccttggatcctccaatggtccttggtttagtactggtcatcagtgcaaacaattgcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatctcctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgtgcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggtaaaaaattcaacgccatgagcccccctcaagaattgctccgccgtcgatctcgccgccatggctgaattctcgtcggcgaaatgctgcatgaaatctcggcggcctccagaagcagtagcctggtgtgatttttggttaggctcagttaattaattaccggctaaaataaacacctccttttcactttttttcccttaaccatcgttcacgagcacagtgactttttttccattttaaaataatacgggtatcactctccttcctcacctttccaaagaatttttttttcatggccatctcttatcaagatggtggtacaatacaacacacgcccatacgcttcagatccgaaaggcatcaattccaattttgcaagcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgtgagggttacagcttaatttccttcaaattttggctcgccattgacgagctcgagcttaagcttcttcttcttcgtgttgtttttaatggcggcgtggtggtgggttgggtgcaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcgg

SEQ ID NO: 37749 - DNA, 5530 bp, Oryza sativa
tcttcgaggggttgatgaagcaggtgatggagcggcaggaggcgatgcagcagcggtttctggaggccatcgagaagcgggagcaggaccggatgatccgcgaggaggcgtggcggcggcaggagatggcgcgcctcgcccgcgagcaggagatcctcgcgcaggagcgcgccatggcggcgtcgcgcgacgccgccgtcgtgtccttcatacagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaaggtaagctaagctacgtgcatccatccgtgtgcatttccccgtgtggccgtagcgaattggcgcgtacacatgtggtacgctgctgtcgtttttggtgatccaatgctgattgcgtaacgctgcgcatttaaagccagaggaaaacattatgaaggagatgatggagcagaggccgcatcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttataccagcattctttctaaataagtgtgatgctctttgtctactttatttatttttagagaaaagaaggattagaggcagatgcaacgatttaaattacatgtgcagctctggttatactctaggatccaatgcttaatttattgtaaactttttagttttagatcccataaggatcgatctcgatctttcaaatattaatataaattgctatgccacgattagtataagcatggggagatagccctcacatgccaaagattagtatagcacaaggaaggcttgatatatagggtataaaatttaaagcaagtaattatcaaattataaccgaggtaaactcattaaaataactaggtagcatccaagctagatgtcacggtatgttgtcatatgcatgcatgcatgtaaataaaaaaaatgcctgcaaaaatttaggtagatcaaaagataaaattcggtatgatcttgatcaacttaaattgccagcacaaaatcaactagtagaaggatcttgtgtagatcgccctatcatgacaacttcgagtgctagctaagagagcatgtgctacaaagtgacacttgattaattatcacttgcacaaattcttgctacttaaaccacacttttatacacactatgctactgtatactactcccagtagcactagtcctgtaattaaaattgtgctcctagtacgtgagataccctaccactgtagttttaggcttggatgcctcggagttagagccagcagggggggggggggggttgcctagctatagtgagtatggctgatcctttggcaagcatacaaaattagttttggggtcaggctggcttggctgtggctggggatccgtataaaaacggttgaagtgtggggtgatgtgtctgccataaaaggttaaaaagaatggagctgtgggattgatgcctcctgtttaaattatgggagaacgtggaggttgcagggcgcgcgctcgttcaccttgctgcccttcgtagctctagctctactccctcggtcccaaaacaaaaaataacttaaaagaaaatataactttttctcctaatacaacgaatttgaatagagggttgtccaaattcattgtaccaaaaagaatcacatctagactgagggttgtccaaattcgttgtatcagaaagggtcacatctcatactatgttaagttttttttggacggagggagtatgtagtagtagcagcatcatcagttctaaggttgtacagaaagggtcacatctcatatgttaagtttttttttggacggagggagtatgtagtagtagcagcatcatcagttctaaggtgggaataataattttaggatttttgatatgaaatggaatagtttcatattctaaatacaggagttcgatctcaggattttaaagaatttttgttagagaggtaaaaattttcgtattctaagagggattcggagagggatggagctaattctaagatggtggctcgcgtacgtgccatgtacctaggagtacattatatttgtggatttgaatgcaacatttccactattttcttttgtgaagggaaacactaggagggccgtataatacactgtcaagatagtgcactatgcatacacgttgcaataatttagtgataaatctatccattatcttaaaagaagagtgataaatttattatataagtttatcgtgtttgataatgtttgctatcttatgacaatagatttacatgagctacatctacactctaattccctagtacacactattcatgcatcttttctcacactcttcatagcttcttgggcaattggcatgagaagggagagcttggctctacactctactttcttctggctgcaggctgaatgttgcacatgggatggtgagaaagttaaaaaagagggagagataggaaattaggaacagacatgtccaggaggagcccacacaatgccaccttgcttcctacttgtgctcccttagcttttgttcctttatttttttaccactggctttttatcttgtcatggtggtagtaactattaagtcatatgtccaatgcgtaggagggccaattcatcatctgccaacctgttgagatctgcgtgtgtaaattcagtgtacaatcatgtggcaatagcatccgcatatgtataactatctagaccagtaacaagtgtaacaaacagttagaaaatgctagacaaaccaaattctaaaggcattttgcacacaaacctcaaaatctgaaacaatattccaagtccaagaaaaatttccttttcttacctggatactagggtggtgtttggttggagggactaaagtggagctaaactttagtcccagggactaaatttaatccctagttcccaaacaccccctaggtaatctgcaacagggccatccactgagagtttgtgcatggaaaaggcaggccctcatgcagagaggtggctgcagaagattcttttggtgagagagaagagtgaaccaatgctacttcaacgtactaccagtagtacgttttattcaggtaaaagatggcaaagtgcacagggtaataaggtgaaaaagagagaaaaaaaagaagaaaatagtactggcttaggcacattgagaattcactggccccggcagcatgtgcggtgactccacggttcacgaggcggtgttacttgagggctggaaactgggcggtatactgaagggcgaaaaaaaaaaactggagaaactttcgctaagtcaacacccagcgttacacaggcttttcactaggtttggttttatgtgaaggtgtagtttcaacatagtccaggggaagagcgaggggtgttgtcaagcccgaacaataaagaatgtttactagcaatcggtaact

SEQ ID NO: 37750 - DNA, 25132 bp, Oryza sativa
ctcctcaaggatcgtaaaattgctcatattagattgtgcaaaaaaatagttgatcaattaatctctaaagcatcatcctttcacttatgcttatataagccaaactttaaaatttaaaacttagttttaaagttgattttgttggtttttcatcatagtttattttacagcacatgcttttaaatctctaaggacagtatgtataaaaattttatccacattatttttcaatggctgataagcaatacggataaacacgaagtataagcgaaacaatggggccgctagtctctaatgaatatgatgataactgtacacttgtaaattttacaaaaattctttcaacacagttcacctgaagactatatttatattgaaaattttcaagcgtctatgtatcattttgtcaacaatatttggtgactaattatcatcactatgatagaaaaagaatatatccaaaatatactgcaaacaaagtcaaccacataggagaaaaaaaagagaacaataatgttgcatttttgtagaatatcttattagatgacacaaactcatgatctccaggacaatgaaatggcatgcatatgccttgatcaggctgctagcttgtctggatcacagtattaaacagataactaaatgaacatgatgaatcatcaaacaaatgcatagtctttttcaatatttattatcttactcctatatacatagaacatgcaccacattttatatagtagtacatggaacactctatcttcagtgctatatgtcgggtttgctatcctggtttgtttttgactttacatagtagcttttatcggtgtgctggttaggtacatgtgtgaagagggacatcaggaagcaaaagagaagagaaaattgaaaatgcttccaattttgtggcaggtagtacaaatgttttatcaagaaaatataccgcctgcaaaaaaaaaaaatcttcggaaggaacccaaagtgaatgatttgagatcacgcaatactcatttcattctgttggttggctaattagttatagatgctttgtgccttcgttgacacactcatatgccaatcaagcaaataaacaagtttatttccaagtccaaataggaatgcacacatataggaaatttagcattcggccggtggtcttcacgttagatgatgccattcaattaaccagggacgacctttcaaatagagtcatcgcctcattggtgtagttacgtaccctttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggattttatacaaaaccaaatttgacaactagataggtagaacatacatgtacatgcttgcatgtcggtgcaaacaaaaaaaaacaaacaaacaaaggcgtgcagatgaggaggtatcatccatcctagggtgacaaaccggtaaagagaaaaagggcatccttcctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaagagaggaaaaaaaaaacctgtaaagttgcggcgattccagggaccttttccagtgcagcacggctgaaacaaataaaaagataggaaaataattaaaaaaaagggttccctccaacgtcgggatgagctctgtgtgtcgtgttctgtggtgtcagtgtcgcacaaagctgcaatgctaacttagttatatatgcatgcatggctgctgtgtgcaccaagaatttaccaaaagaagcctcaccaacgtgtatttcaaattaccctttaaaggccctgccgcagggatacctgggactttttaatatcccaaatgtttaaaaaaaactctaattaactactttattatgtaaaaaaaatatcaaagttaaagctgattgcaatagttcaactggaacatatacctagctattgtgataaaaaaattctagagtagattatattacaacatgttgtatataaatttgcgaattaattaggaaaacaaagcacctgatggattacctgaacaattctttttagccaggggtgtgaccatttctttaagaaaattaaataatgtgagctctgtcaaccaatgaaagggtttaataaggcaaaccttgtctggcatgactaatcaaaccagttaaacagggagatgcgtccaaatggccccttgctatatatgtgaaccatggtccagccggcggctcccactgtgcacgccggtgagccgcggcgatcgatgatggtccaaacggaaacccatacattatcatggtcccgtacgtgttgctggagagacgatctgaaattagacatctttttcccttgtcctcttcaagcttggatgcataggagagataactaattaagcagatccatcgatccttgagagataaaccacatgtatatctagttagcttgtgttgtccatctggaccaccaagtcatcaggtttggttagccacaaaaccttgcgtaaatccatccgatcgggtcacatgccgaggcgtgagcctgaagctcgttgaatcattagtacttgcccctgaagaaacagcttcgatctaatcggcagatcagaggctggatgcatgcttggattccttccctgtcttttaacaaagacgaattaaaacccagtatgttaacagactccgtgagagttaatgacagattagcactgaccttattcgatgaaaaggaaccttctttcttcagagaaaagcttgaactggctttagcctgtgcaaggggtaggaccatttctgttacagcaacaatccaagattgttgtgtccaggatggagctgtcaatggctcgagatgttaatcctgccaactgttttcccctttccataatcccttgtgtggtgtgcatctgtacaaagctagctaaatggtgcacttccattaaccttttagcagcacctacccaacaagtgaagctaggaccaactgttgacaacaatacttcaacgaccacaatgaaagatagccggccaatttggttgtccctgtgagcacttgtacgccataatacaggttccttgatgccgtcagattatagatgcatgtactcaaatacgcatcatctgtaaacaggaaaagaccgtgagtgtaactgaagatagcaatcttgtaaaaaaaaaagtgtaataatacgtcagagatttcaaatactgatatcagattgataccacttgattggcgaggaaaatgaagtgctggaatctgggccaggatttaagtaaaagcagataaaagtcacaagcatatctgggcaggactaaaatcatatattccaacttgcatatcggcttccagtgtcccaaggtatttttatcttgggcatctcatccatactcaaataagagcctgacccatgtgataatcagaactactagtttccttctcattaggttaaagtgccaacatttcgcttgtacatcatggttccagcaaagattccctacagtttcacaaaaggtaccatcacctaaagcacacacttgagtgttactgtcattacagggcagtacaaagtgaccaaaccacaaaagaatttatcagtcagaagtccatttcaccttaatgtgctcaattacatgtagaattgccaccgttgctctggttgtcttgtctcatgattaggcgagcgcaccgatgctgtagtgcactaggaaactctttctgatatccgttagtgttaggtggtgaaaaaactttatttacagcgtgcaaaatccttcttccatgaccatagcacacatggcaccccagcaatccatctggttccagtaagaaataacagaatggtacaatgggaaaaatacttaaactttaaagctgattacttggtagaaatcaaggaatcagattttattcactttgtcaaaataccagctaaaaaatatcacatatgagggaatgaattctcttccatgtcccctacagggatgaccgccaattgaaatcggatctataaaagtaaaacggaaaaggaaaaaatagtaaagcttccatttcttttggtttctaatattggtaggaaaagggtaagtaatgtaaagtagaagtgggggaattgtgagttgttgatagttattcccatgccagaggagtccagccaagaacgaaagctatacacaaatactcactaggcaacatggagagacatggctcccatgttatcccgtgcaacccctgttccccacttgtgccctcccgttgcacatggcctcataaccaacccttcctcccctcctctcctatagttaacattgccatgggaccccattcctatacagaacaattatcaccaccttccttttcccaactcctctgtaccctagacttctgcattggaacagtgctctgttctaagcattgtatagcaatatctctaccactataaaatcaattcatgaggtgaatctgattgcaaacttttatgaattattgcatggactaaatagtcttgttataaacaggaaccaagctaaggataaagaaattcatgcaatttaatatacagatgctaaaaatgcctaacgcttaattgtgagattaaggggatctttataatgagcatctgtaccatatacagtacttcagctcagttagtcacagctactgtagaagataaatattcgaaattggtggagtcccagttctttcgaaaaggacatgttttatcattttactttcatgtccatctacactatctttcgttgtcagcccaatcttggaggtgtgtcataatatcatctactaagatatgacaaaagtattcgggctagcgggccaggtggttaattagataatcacaggggaggctttagagcccataaggaattgcacgctacagtaggaactgcaataaagaatcccaatatattgaaacgttactgttgactgataggaacatatgagcataaaaattcctgtaactttccagccatacaagtgggttggcctttgaggggtcattttcacagaccatacttacaattgccacaactttgatagagatattgtaaactagaagttagataaggagtctgccgcttacatattaaccattaaaggaaatctttagattatcaccgcatagcccaaaataggaagattctcaccaagttgggcctcatcaattgatatgccggagttctgataagagtcacgcagctactcgaacagcaaatgccagtgtaagattcttcacctgaaataaacatttggacagaaactgatgtagtatagatatcaatagaacagatgaaactcaaaggattattccaaataagtcatcgaatcacatatcatcaattcttatatatataattacccacagggggtaaagaaaaaaaggaaaaagaacagaatcagaggaatcagtgatcaaaatagctccacatatttccttgtttcttttaggactaactggcttacaaatgaataataaatatatggaagtcattgttgtatagagttgttatgtattgaagcatgtagaaataagttcaatattactagtttgggtcccacatataaagtataaaacaaactgaaaaaactatgttagcttgagtttcacacggtaatcctccttatcatattttacacacgtcacatcaaataaattattattgcttcaccagacataacttgcagtatatgctaaagcctactttaaacaataatgaaacaaacttacatgcccttaacaacttgactactgacctaaataacgtttacatgatgacagtgcaagctggatgtgatgcatgaaagattgttcaaaaacaaaataatcattcacttacatcgatgctgtcaatcactatcctagtcaaacttaacattttgaagggtttattcagaggctatcattattataaagcctaagagtatatgaaaatcagggaagattcatctccccattcagcccttcagggaatatgacttctgtcatgcaaccctgacaggttattgttactgcaaaaagtactgaactccaatatcttttatttcccttgaaattatttgacccctgtatttcactttctatttgatggaaactatttcgttgagttcacaatagtaggagccaaaacaaaaatctattgcacagcagctgtaagtgtaaagcatagcactactagatctgtgaagtcaactgccgggaaccatagagaactcaaaatcaagtgattgtgtattggagaggtagacagtggaatacttacagaatgtctgaaacgacaatgctgggacatcacttatctaataaatgaacaaaagatagctatgaccaagtgaggcactgcaataagggggtaataatcgataaaaactttgaagagagagccgattgtaccaatcaaagtacgatgcaaacataactattcctttcactcgatttcgcagaatccctctataaaattcccttgccaactccaagcactacttgtgcagttctgcccatgcccagccatcaactaggatcgtgttagggttaatcactacatgaagtgaataaaaaaaatatcaactgaccttattgggtaaaattttacaggcctagcgccctacctctcaaattaacatctagtgaaactgaataatagataaacagaggcacaaagtgagtactggttactggtaagggaaggggcgtcacatcgccactacagtgctcgcggctggtctcctccccctccgaatcgaaccgagcagcgccggcgaggaggagccgccttcccccaacccggcaaccccccgaacccaacggtgcagaaggggtcggcggccggagcggagccgacgcggcggttgaagggagtagccgagttaggaggaggagctcaccgccgtgccgagagtgggtgcacgcacgccgcgccccgccggccggcttgttcggccggccgccgctccgcgcgacgcggcacggcgaaggcgctcgcctcgctccgtccgtccccacgagcagaggcttcagcgggccgtgtgcttcgtcacgggcccaacagcaagaagctcagctggagaagcagcccgtgtagatgggcccgtccggttaccgttgattggcctcagtggtgaaggagcccgtgtagatggatcttcggcgtgggggaaaaaggccgaaatgtcacgggaaccaactacgggaggccgtgggccgcatccattaggataagcgggctagatctatccatgcgactagcgggcatcaattcgctgcggaaaatgtctaatttttcttaggttggatctaattcgtcttttaaccataaaatcagatataataacccctctaactattaagagagttgaaaaagatttctaagatagtattgcgggaagaggagagagatatggggaggagggaggaaggagaaaggaaggagggtaagcgagaatgacatgtgagttccacttgatatcctaacatccttgttggcttggtgtttttgaccgtggttaatttgccacgttagctaatgccattctaaatactccctccgtatctaaatataagagattttagtcggatataatatatcctggtataatgattcgttatattaggatgtgttattttcaaccaatatcccttatatttatagagacagatggagtagtgtcttataagtttttttttccggttttaacggttagtagagttgttgtatccagcagctttacgatcgagaaatacggcctatatttaagggagttacaatagacattttccattcggcaagtcagaggttgacacgacgacgacgcgagtcacacgacgcgacagccttcaccgacgcacatggccgtccagctcgggcgcatcacggggcacgccgcacgcggcccactccgtaccggccgcgccatggattccacgcggtggccgcactccgtcccgtgcgggcgtgcggcccatgctgccatggcatccaatccgatgcaatccaaccgacatctccgcggccgcatcgcccgctcccgtcaccgacgcaacccacggtccaaagtccacagacttcaccgccgctgttaccgcgatcccgggctcctccccacagctgtcgtcgcgtcaacccattatccttcaccgccacactcgctgacaggtgggtccacgtcgccgacccgcaccacatggcccacgaggcagtcaccctacgatgtgtggcagtgaccctatgcaggcggtgccttatatttagcgcacaggaaacccatgagaaatccaaggtcatcaccaccttcttcctcctcttcatttgccatctttagtaccacctcgccttcccaatccaatctcgccgcccattaaggcccgagagcccccattccgccagatccatgacggtctagtcgccgtcggcggaggagccgttccgggtgttcgtcggctacgacccgcgggaggacgaggcgtacgaggtgtgccgccgcagcttgttccgccacgcctccatccctgtcgacgtccgccccatccggcagccggatctccgcgcggcggggctctactggcgggagcgggggcccaccgagagcacggagttctccttcacccgcttcctcacaccctacctcgccggttaccgcggctgggcgctcttcgtcgactgcgacttcctctacctcgccgacatcgccggcctcctcgcctgcctcccctcctccgaccccgaccaccgcctcgccgtcgcttgcgtcaagcacgagtacgcccccgccgaggcgaccaagatggacggcgccatccagaccgtgtacccgcgcaagaactggtcgtccatggtgctctacaactgcggccaccccaagaacgtcgccgcgctcaccccggacgccgtcagcacccagaccggcgccttcctccaccgattcgcctggctcgatgacgacgagatcggcgagatccccttcgcctggaacttcctcgtcggccacaacaaggtcgaccccgccgacccgtccacgcagcccaaggccatccactacacctccggcgggccgtggttcgagaggtacaggaactgcgacttcgccgagctctggatcaaggaggccgacgagctcaaggccgacaaggagaagcagaagcagcagcagatcgtcatggccaacggcgagaaggagaaagacgaggaggggaattgaatcgaatccaattgaattcattgtgccgcattgcgttgcaattttgcatcgaattggttcaaatctgttgtttattgggttggggttgggtggtaggctatgagtggatagctctagtattggtagtagtacgcttttgtgtagcggcaaatcaatctatctatgagtcctcaatgttcaggaattttaattcttttggcctttgatcaattgaccatgtacctgtttttgctgtttctgaatactgatcatactggctagccttctctaatgctggaattgagaaatcaggttgggtctcgagtgtcccgtgagggaatgaaatgtgatcattttccttttgcagtgaagattttgtgcccatttcatcagtttgcaggtagcattatgttcatatgttgatgtctgcattcaaccgattcaggagattggattttcatttggtgatctgaacctcagaatgttccgtacagccgatacagataatctgaagagataccttcgttttatatatctgttactactaattaaattaaagctcagtgacagatcacagatgcatgttctttggagattggacaagaccagcttaaaatgtgtcctgtcatccgtacattgtactcctaatcacgtgtagtgtacacaatacagtactactattagatctcagtgatcactgcagtgttctggtgatcactgtattctggtcgcctgaattttctctcttgataagagaatccaaagctgactgaggtggtgtttgggtgggagggactaaataagtcattatcacatcggatgtttggacactaattataaatattaaacgtagactattaataaaatccatccataatcttgaactaattcacgagacgaatctattgagcctaattaatccgtgattagcctatgtgatgctacagtaaatattatctaattatggattaattaggcttaaaaaatttatctcgcaaattagcttttatttatgtaattagttttgtaagtagtctatatttaatactctaaattagtgtctaaatatagagaataaagttaagtccctggatccaaacatcacctaaactttagtccttcacaaaaaacataagggggtgtttgggagagaggggctaaactttagctatctcttaagtattcagtccaaggatgcaagcaaagcatcatgctggatggattgctgaacaatttatcccattgatcaatgcctttctcaacatgttgtgaacttgtgatctgaaagcaaagtatctggtctctctgaactctgaagcttggaaccagcagcaattggtgtcagtagtcagcaactgtgtactgaaacgttgggtttgctgttttgagcccactgtaatgcatgtgcacatgtcttggctgtaagctgaatactgaattcgttgcaaaatgccgtatggatcacagaaagcacagccagaatggatcagtacattggttcctgcctgagaatggttggaatctgatgagttgcttgaattcctgaaatgtggttccaaacaacgtgtgtaaatttccattcagaaataccacatgtaaacttcaatagaggaattgatcattgtgagctggttgcatctttgaggctaaaacacattatgttcatcgataaagtacctcaaaccttgaaaccttgaagagtggagttgaggcatccggacagcagaggaagagcgtgttgcagctgaagactgaggagcaaatgaaagatagcggcggcggaggccaatcgtcttctccgcggccggtggatgtcgccgccgcccaccggcttccaatcgagtcgccgcgctgatcgatggagcaaaaactctcaattccatttccggagtaacaagtacgggccgcacgtagcccgcactcccttttcggcccaattactatataggccgcacgtgttgcatcccaacaaatgggccaaaagtaattcgcaatccagtccggaccgacagagttggacgtggccagcgaagtgggccttgtgggccatcgcatcgcaccactgcattttatggtttgtaacaggaaaatatgttgcaactttgacggcatttaaatttcttcaaaacaagaatattttgaaactacactgaacaaaagtcactgtgaaattatctagtcctgatgtagtctgtctgtgattttgtcatgtatttccttttttcctttggtatactttggaacgaccaattgacaagtataggttgaattcacattgaccagaagaaatataccatacattatttcatgatgtcctctatacatgatgataatttattgcctttcggttaatgttttcatggtatcaggcagtattttgctatcgtctacattactgtgtaccctggaccgcctccaccttctggaacggtccattcgatgttttgctttggatctttgatgtcacaagcctgcagataccgtcaacatttcattcagttacaggaaacaaaagatgcaaatgtccatggacaactgaatcaacatggaggcaaataccttgcaatgaagacaattttgagcatttatgtgaagcttctggtcacctttctcgtcggtgacatacctgcatgagaacatgtatggcagaagtgattagcaatccttgtttgggcattcagtacttaattgtaggttatctttcattcaagtaagaaaggccaatttccttactcgtaaactcgagctggacaataatgtgactctggtccagcatacagaggaagatttactctctccggtactgtaggatccctcaaacggagatgaggaggttgatcatgctcatggtttgtgctgctcctgtataaatgagatcatacatgatcagtgtacagaatatgcatgtaaatcactccacattacatttcagttcatgaaaaaaaaatggagaacgatagccattcacccactaaatttgatgaatctgccgccactatactacatgtgactattaagaaaaagctctaaaccaattcacaggaaagcactattgcttctaaaaattgtgaacataacttgaaactttgaaagaaagaattctaaagagtgatgtctaaagagtgatggacgtcatcattcttgctgcatatcttacctgtataaagaagttggtacgtcaaaggatatttgaccatctggtttcggatattgaataggcgagtgcaaactggccatctgttcacaagaatgtgtttggttaatgtcagtagtgaaaaaatgaaacaatgtgcttttcatttatgctaacaaagaatgtctatattagatgagcaccagcagtacttgaaactcacatctgttgcttcatggtcaggtatcccgtgctttaaggtaaagggggactttcctttgaatacgtatctaaaaattgaacaataacaacaaacgtcagcgaaccaagtagagtattgacttcatcccaaaagaagtatagaatattaagtaatattaacaaattagttgggcctcaccgttccagtgcagacaaggcaatgcctggaataaatccatattcaaatgcctgtaacagaatataaataaatctgtctgctcaatagcttcagaaaggaaaaaacagaaactgcatatcctcacttcaaaagcttgtatgacggaatacttaattagacaaaataaatgttcaggaagtctgtaacaaacataatcacatactggtctgtaattccgagctctataaagctcttcccatatccatgacttcttgagattctcccaatagagttccatcgaagatccttcaacaagagttttgaaagttgcttctgcagccagcatacctgttgtacacatccaaccctttagtacatggcttctcagcatactctacagttagcacacatgatctaccatttttggttgagaataatgtgccactttaaggagatcaaaatgtgtactctgaaagaaatgtaaagtaattgacataaaagtgaacaggcagcactacaacataaagctcaaagcatcacgtaaagagatacctgacttcatggctgtatgagttccttttattttgggaacattaaggaaccctgcagagcatccaataattgcacctccagggaaaactggatttggtattgactgaaattttacatgaacattatcagcaccctatcagtaactattgctaacaactaaagaaaacaaaatacaggagacctgactgaatgacggaggtaaaagctacagtgtcgaaacatatagcataacaagaacactataacaatgctgtgtctcaaagttcatgtaccagttaaccggaaacaccaggtgaattgattttgatgtaaaatgcttgtaatgtcataaaccggcagatgcccaatatagttatgcgcagagtttacatatcatatgaatctatttacaacaaaattttcatttctttgacatgccacttacttgaaaaccaccttcattcaacgtacgagcaccatactgaagaactgttccaccatccaaaattgtcctgacagcagggtgttgcttgaatttctgaaatataaaatatgattgcataatgcttagaagaaaaaaaatcgaccatcaggagttcaggactatactagtacactaccatcataaaagaacatacccatagaaatttgactaacctggaattcatcgtatgggctcatgaaaggattttgatagttcaaggcaacaaccagacctatcgctaactgaaatatcagagcagagataaagtaaacaccactaagcgataaagtaatcaaaatttccggggaaaaaactgagcaagttatacatttatccactctgcaaacaaaaggccttatgataagggatgaattaatggttcctcctttaaacccaaattataatctgtaagctgtgaacttaggttgtggagaaggatgcatctatcatgtaagataaatacatttttacatctttacacagatgacagacttcactgaacatatatttgcaaaagaaaagagaactcataaagggatattgtagcaaataacagaagaactacctgtctatcatcaaggtgatacataaatgatcctccatatgttttcgagtccaaaggccaccctacagtatgaatcacagaacctggcttgtgctttccttcctcgatctcccaaacctaagaaagcttccaattagtttcaagtggcactgctaactcgtctgtaagtcattttaaggaaaagaatggagatgttttgaagataaagctagtaaatcatagttctataaggaacaaacgaaagcatctaatggaattcctcaaaaataaccataagttctttattagaaaatatttttgaagtgtttgtgcatgggtgattttgaaaatgttaacataaaagagtgttacctatagtttgcatatattgcatgtataatgtggtatgggactgatttaagtcagacgattttcacacatacacacacacacacacacacaaaggatcttgttttcctcacgagatatatgagttggtttgataagatttgagaacaaggcatttggaaactgaaagtggtattactgaatatcaaggtacctccttaattccaagagcatatgtctgatgctggccttgcccactctctctgagcttgtggttccttattattttctggaaagagaaagagggaagaataacatgataagtgttagcaccaaatgaaatatatatataaaaaagaacatatgaatttcataaaactagatttatgctgacctctgataatgaacctcggcaaccctcggccaacagtgtcattcgccctgcattttctaagtagctgaccatgagaatagacacgtgagtggaaccaccagcttggaacaaatgggtaccaattttacagaaagaacaacgtcaacagactgaaaaggttttaaagacaaacaatagggaaaacaaaatcactattatctgcctatacaaacaacggaaaaaaaaggagcaattgattatctcaacattatgcactcaataaggatggttactcgcctcttagttcaacaccaggttgaaaagtttcccttttggaaccatctttagcaataccaacatcattggttgcaacgcctgtaactatttgattttcatcataaaggatctgttagagaagaattcagacagattaatattagccctttgacagaagagttccacaactgaaaaatggtggtacctcactcgcagcaaaacctggatatacttcaacacccaattcttcagctttggaggccatccatcgcaccatttggctcaagctggacaatattaagcattgtttctaaaatcagatactgtcgaataagtgaaatatactagaactttgcatagatgaagctaataattagaagaaaatctcagcaccttatcacatagtttcccttgttatcgaaaggagatggaagtgtccatgccttattctttgtcaacagccagaacttgtcagatgagacggggactcttattggggtctatcaaacacacagtaggcacataaatatcaatgccttatgtacttagaactaaatttactttgttactgaagtgtattttgctatcattattcaaggaactgccatatcaaaaggaccaggtcttattcattgggaatttgggacatctcatgatgcaattgttagtttgaaactgttactgagcatcaactaattaaatttcgcccccccccccccccaaaaaaaaaataaataaataattattattattatatatcgtttatttctgtgcatttgccctacgcaaagcaaaattagggagctgaaacatcctcatacaccaaaatatccatgatttcccatgatcaaatgaacctcaggcttctgatgaagggatcaaccatagttaatttgcacttggtctagagtctagacagcagaatggccaactaaaacatacttatatagcatatccagtttagagcagagaagggcatacatcctcttgcctccacttcgggatgagttcatccaacgctcgtggctcgaacacgttccccgacaatacatgcgcacctgcagcgagagcaagcaaaatcaaacaaacgccaaattacacgagcaggagtagagtaacgccatcgcgcactggcgtgctaagacgcaagcaaccggaccgaagggggaaccgattccggaggaagacacgcaccgacttcggagcccttctcgaggacgcagacggagaggtcggtgtcggcgtcgcggcagagctgcttcagccggatggccgcggcgagccccgcgggcccagcccccacgaccaccacgtcgtagctcatcgcctccctgcccccgctcagccacctcgccgccgccgccgccgcgccccacctcggcgcgcggtggcccgacgcgtggccaatccccgccgccgccgcgcggagcactcgttgcattgccgcgggaagcttcccgatcccgagccgaaagggaggaaggagaaggccgggaaggtacggaactgtggaggaatgggagtggcagttgagctccgcgacgggacggcgatgggattaggtcgctgaggtggaagaagacgaggacgaacagtattcctttttttttaattgaaaactaatactccctccgtcacaatataagggattttgagtttttgattgcaacgtttaaccacttgtcttattcaattttttttacaaatataaaaaatgaaaagttgtgcttaaattactgtagataataaagtaagtcacaaataaaataaataataattttaaatttttttaaataagacgagtggtcaaacgttgcaagtaaaaatctaaaatcccttatattacgggacagagagagtaataataattcgctctgttcatgggctgtttccgggctagctttatgggcctttgaacacttctacagtttttgggccttacataaatgggccgttacatggtgatgcaggctggagtttgggcccatcgaacaaggagcatggtattgctgggcttctttcggcctgccccgctgttcaaggatttaacctcgattttgctattacatccatcatcgaacaaaaaacttgtcaagaataaatatagtataattatattgtaacttacgtttaactaaagtataacttgtattatattatagttgcatgtaaactacagtgtaattatgctacaattatactatatttagattttacaaagttgtcaacaaatgttagaatataacatagtcattacacaagtacgtggttgtctcgaagaaaaagggagttacaatgttgccatcactggccatagatgatgtatacgtatacacgtcctgtacttgtctctgaacacaagctacgatacccagctagttccagaaaagaaaagcagagaagaacatctgaagcaatgccagaggaagtgccacagcttcaagtcaagctatcctgcttttgcacgagcgtgtagtgttgtgcatagacgacggaaggggataaacgcctgtgatttagccgacaaatcccatttaggacagatgaccaaagctaaactatgctggttgctgccttacaaggaacatccctcctgcctcctgattcctgcacacactgcccggcatctctctctgtctgggtcaacgtacaaatcgttctagttttctactactatatattgtatactactagtatatttgatcaggtaagtgctagagaactgtgtatagctagcacaaaaatgtattataattaggattggtttaatctgtaaatgtgttgcactccaaccaagcacaagtccccatcagaagtttcagagccattagacaaagggttgcaccacactctgagctgcctgcacgtagcttcgtttctgtacttctctatttggatgccaaaccaagacgcttgtcccagttagtaggttcaagcaacaagaacagaaaatagtacatctcttctacgattaatattattcagagtttcggacacataaactggagctaatcagctaatcgcagcagcgtgcaaataatagagagaatctcttatatgccactagaatttaaccagttcccttatatgccatttaaaattggcttctctcttatatgccactagttcaagtttttccacccttttatgccactcccaccactatagtgttagttgactgttagtcaaaggttagttttttcataaatgaccaatatgccctctcaactaaaaaatgtgtaaacttcaaaaaaatcataactaatttattttaaatcctttttggatgaacaaaattttatcagaaccagtgaaaaatgctctttatattaaaaatattgttggaaaactgcatgtttcatgcttacattgaaaatttatttgtgatggtaatggctaaaattgcatgtgatgcataaaaaatcaattttcatatgttgtatccagtatagctatattagtactaaaatacctattattaagggcaaatgagtctttttacaataaagttaacggtcaactgacggtggactgacggtaatggcataaaagggaggagaaacttgaaccggtggcataaaagggagaagccaatttaaagtggcatataaaggagccggttaatttagagtggcatataagggattctctccaaataataatatttggagaacaaggacacgttttcagtaccggtgcgataaacaaattcaagtacaggatcgtagaagatatagcttatggattgcagcgtccgacgacgattcagccgacaaatttgctcgcgccggcgacgctgtccggtggttcgacgaacaggatttctatcgctgaatcctccacacgaacgatctgtaattcgtgcgcccatgcaactccaggggagttgcaaaaattgcaatctcttccagtcaatgacgcaaccagatgcaaaattgtgatcctactaaaacctttttttaaagactatttcaactgatgaaaagtttagaatcacgcatagtttcaaagctgctgttccaatcagtgcatttgaataggagtataggaccccatgggtagtactattttatggctcgttgcgaagctgttgagcttggaagttagatgaacacagtcttgtcagttctgatgtcgccattttgcttcattcgctcctcgcacgtagcttccaagcacactgcaaaactcccccaaaattattatttttcccctctgaatatccatatatccattgcaccaaacgattgaattggtggtacggcaagcaaaagacatggcatatttattgtctctaaattatatatttagtagccgcacgcacggtttaggaagattgttcttgtctgattgattctctagtactcctctagctagtagctcctgttgcacacatctttttctgccttaaaaagttcgatttttttcttcttctgaatgactcgtgaagcttcttgcttgcttcacgctctcgtcttgagcaaataaatttgagtcacatcacatcgctcaaagatgcctatagttttaagtatttaaactctaattaatctgtcgtgttcatgattgattggtggtggcggtgcgattttgggaatgtgatggaatttggaagccatcagagttcagccacgcatggcccagcaggagactgcactgttggtgttaattgtgtgttcttcgtgtcaattggactgaaactaagtgcacactatgttaggacgtcgtcttctacattggaccccaggatgtgtatccctgtgctgctctctccatggacggactccaaatcttcaatccaatatatcgtgatgtgatcgccgcgacgatacgattttatagtgtactacacaagtacacatccgaaaggcgctgcgatgtatgatcagacgatgaaacagcatcaagatcaagccttttttcataaacaaacagctgtcctattcctagatagctatgattaattcccaagaactgcaagatcctgaaggcaccaattaattaatattcagatgataaataaagatggtacaaaactgagaggtgaggggttaagttcttggtgtcagtgagatgtgaatcacaagagagaaaaattgtgacctaaatgaacacattacacatggaatgaaaggctctttgttttgtttctcttacaagttttattaaaaaaaactgttgcctagttgtggaagcaagaactcgagcgctttacggtacattgtcaataattatctagcagctttcacgcattcaggttgttgacatactctctccatcactcatatcagaatctctacattagtatattgtttatctacaagccacaaaatcaaaggcaaacgaactgacgcgtgagtctgaactctaatacgattcagggactagcagtagagcacaagacagtttagtttagcacatgtgatccacacggtgcaattcgccgtggaaagtcaccaaaatgtgacatgtaaactcgcttctgccgttgctttcggagctagtttctttcgtcaccttgcagatcactgttgcaggacagcaatcagtgaccaaatcaggtagccgtgaaaaatgacagtaacctgctgaagaaagctctgaatttcttgtccgggacgctgggtgtaactgcttaaattaatacttggacctaatctcggatgcaaattcttttgtttgcatctttctcacgagagttgaacatagtgatgactaaatctctgaaaaggattcacagacaatctgggaatcaaagaaagccatattttcagtgattcaggacactgactgaaactattttctttgtaggcatgcaattctgtcatcatccatcaccaggaacactgttctgtgttctacacttctactggtagcacttgcaattatatatctcagctagtagctgtttcagagtgaaaaagtctatggcgtcccaaaattcactcatcaagatgcttcactgtgaccatcactttgtccttaaagagcatttggacgtactccattttgcaacacagtgcagattagtgctttgttttgtggtcagtgagccatccgaatcagcaccaaatgattgctcattggcctactcaattagtagtaaggcccaagctgctgctgatgctgctactgttcctgatgacttagcctcagcgactttttgttcccagtacaggtttcttttcttgctgcagcatccgtagcatagcagcaccctcccaagaaccaaacgctgctgattgctgcgtgccaccggatgtttttttctctctaatgctgacaagccaatgcactgttgaaccttgatggtttcgtgatatcggcgcaaggtggacggtccagatcatgcaacgagccatcatccgacggtcccaaaccgagtcaaatgatcaccagtcctctcctcccactgtttttattcacatatatgttttctgaacttttctctgaattgagcttcagtaaaccagaagtgttcattacgagagatcaattgctcactttttcaggtgcagctgtacgtagaagcacacttactcctgcttgaccccagtgactcctacacttgtcacattttcagtgtcttgtcttgttggatcatccaaacggcgagatgcccttgcattgcaaaagaggggaagatcagaagaagaagaagaattaagacggttcgatccataaagattaaagagagggcagcaagaacaggatggctagctgctcgtagcaagaacagtagcttggaagcaataaatttcaccttttaaaaccgctccccgtacgcagcccatgcagatgtgttgagttcagtgaacgcgatcgatcgtgaagagagatactagctctctttcctgtgagcttcaggaatccgatgtgtgcaatgcatgcccctctctctccttttgaaaagctgttcatctatgctcagctttattaactcgcaaatctgaaacaccgaaaggttagacgggtagtagtaactgtagtagtaacagcagaaggcaagtaagtactgatgcataactatatactgacattttagtcagggtttacaagcaaaatgttgcttttgctgatgtaaccttgtgacttcagagaacagagatatttcttttaccaccaaggactgcattttcgtctgcatcagcaggagtcctagatactactacaaggggaacatggtggcggaaattcctgatcgaccgagtatcacaatttttgtaaaagtagtaccatttccaattgtttttattctatccctatatatatagaactttgatttttatgatttctggaatcaacattgtactgatatcgccatcaaattgagtatatgaaattctcgaccaaccgagaaccattttccatagacatgatatcgttttcgacagttttcattccagcatctagcacactcgtatgcgagcttaattcgagcctgccagcttcacttcgccaacaacactcgagcattgcaatctgcaagcttccagcagcaagcagcctaattagcatcacagactcatctcagtatcacaccccatgatttcttagatgcatatgcatgcattcaaggacaaatcaaagcattctgctaataagctcgctaacgcggccacaaaatccgtcgctgacagatcatcagaagcaaccaaaaacccacattaatcgcggcgactccgctcagatcgatcgatcgatcgctgcgcccaccgtgatggccaccacaccagccgtcgtcgtctcctagctccacacctcccccttgaccaccgccaccgccaccggccggccgggccatgcacggcgaccggccggatcgaccaagccgacgccaccaaccaaatccatcccggtcatatctctgtcgcctcctcggacccccaagctccatcacatggtggttgtcattactgtcactcgatgaaaccccatccattgctgcggacacttatataagaataaaaaaaattttggatgcacttaatagtttagtgagaagggacgtgtggtttcaacccagaggtccctattcaatccccaacacgcttacatatttttctttaaaaaaaaatggagaggcgtctctaccctccatatctccattttttaaggaggatggaaattttattaaataaataagcaagaacaattagcaataaagtaggtactaaataagttgagtaattaatagggaatataattgcatagaacatgaacggttgagattaagcatgagagagatcgaatggctcatcttagcttcacgcatgttgagcttgtggctgtaactttatagaaagagaggatttgtgtcgtcagtgtaagtgtactgctggtaattgcacagtttaattaccagctaatgcatggctgggtggttaatcagctagatctctctggttttgagctagctgatcagtgatcagtgtagcagcggcaaattaataaatgggatgaaaaagcttttgcattgcatgcatcatttcgtacctcacctagacgatcaatggtggttgtgagacatcctggatcttgaaggaaatataactgtcctgtgtcacatataatggcgtttcagctgtaatctaatccaatggagctacctaagctaccacgtatacatgtacctatagctcacattatgagtgatcgatttatctaaaatccaataattagcccatccaaaaagggccataattgtttcaatttcagtgtaatctattggattccagggatgttggaataatggaataagaaggtgagctcaaaacggatttcctgtacatgtttaacaagtgtatttgttgtaacctaacactggcgagtgagtgaatgagtgagtgagtaaggtgggccccacatgccagtcactcacccccaggctctgctttctgctcctgcataataatcaattttttaatcagtcaccagttcatctcaacatctcatcctaatttgtctttgcatttttttttgcagtttacacccccaccaaatctgaaatccccacacgcagcaatatataaggctacaatacagagccccaaacgccacacaaagtctcctcctttcttcttcttcttcctcctctcgcctttcctctcctcctcctcttcttcttcttcttcttctcgtgggtgcaagaagcagagaaggagcaacgcgagctgagatcgagcgcgaggatgtggcagagatacaggttcttgtgctgcggctgcggcgggaacatggcggcctcggccgccggtgacagggggtgcgacgatgacgcggactgcggcggcggcagcggcggcgggggatttggggaggaggaggaggggggaaagggtggtgtggctggggcggcccggtttgatcgatcaatcagctcatga

SEQ ID NO: 37751 - DNA, 3212 bp, Oryza sativa
gagcagcaaggtgggttgggtgctcccgttctcgcgcgagcctcgccgcgggcgtttgctcgagcaggttgtgtgccaccgcgtcgtgctgaagaattctttggtttttttttgtccttgcagaggaaggcgtgctggtgctggagttcgcggcgaacgggaacctgcacgagcggctgcacggcggcgggaaggccgcggggacgatgccgtgggcgcggcgcgcgtcggtggcgctgcaggtggcgcgggcgctggagtacctgcacgaccggtgcgagcccgcggtggtgcacggcgacgtcaaggcgtcgaacgtgctcctcgacgaggccatgtccgccaagctctgcgacttcgggtcggcgcggatggggttctccgctgccgtccgcccccggtcctccgcgcacaccatgctcggctcgccggggtacgtcgacccgcactacatccgctccggcatggtgaccaagaagagcgacgtgtacagcttcggcgtcctcctcctcgagctcctcaccggcatggaggccttctgcgccgccgagggccgcctcctcaccgccgtcctcgcgccgcgcctcaggcccgcctcctgcgccgcctgcgacgcccgcatgctggtcgacgagaggctgggcagcgcctacgacgccggcgaggcctccgccgtggcgtcgctggcggcgtcgtgcgtcggcgagaacccgagcctccggccatcgatggccgacgtggtgcgcgcgctggagcagggcgcgcacggctccatctcggccgtcgcgaggagatccgacggccacgggaagctgtgattcacacgaggcgtgtcgaatcctaggcgcttagatctggggggcttttggtgagctgtaacttgcgatgacgacgatgacgtcatctggcgtcacctgcacacgtggacccctcctactgggtggagcttagaacaaagcggggtagtgggcgagcacctcaaaaaaaaaagaatcaaaaaaaggagaaaaaaagtagtagtggtatgatttggaaaagatttggagcatcaaaaggtggggtttgtgtgtgctaatggaggaatttcgatcacattgtggtgcaaaaaaaaaatggcagcgatttgggagggtgaggtgattatgaaaatggatcgtccattttacgattccaaagagattttggtttttattctttcgtttgttcgtgtaaagttcaccgagtgcctcctgtttctgttcatattgttgatgattgatttagatttcgaccagagtttgaattccaagagactatgtatatattctatgttcaacttgattctgtactgctactactattgacagcagggttcagtaataagagtttagatgtactaaacaataaatctggtaagtatagtccatgatcaagaataaatacagcattatgaacttaaaacacaactttattccgctgtaccgaagagtgctaataattgattggatcatggcgcccaggatttcaaagagcgtctctgaaagtctgaactgaacgcatatattcgcttcccttttctcactgacaactcagtcttcgctgccctctgaccagctatagtaggagcagtattctactccataatgctgaagtatctccaagtcaaacaaccgtattctacatttgtactcctctagtacgtactggttaccttcgggccaaaatcgaaagaacttgcaaacatttgataatctgctacctactctaatctgattatatttcccctgcattccatcagacttgcccaattcatttgacgatttccatgtattagcaaactaaaaaaatgtgcgactataaaaataaataaataaaatctaaaacgcaattttacagttgaatttggggacttctcattgaaatttatttcccagcagtgacttttaaactgagaacaatataaatatacaatatttacctataaataattttatgctaatttttccgtgtttctaccgcttattggttcaaacagcctgacttcatttcttaactactttaaaagcacagtcgttctactctttccctagaaaaacagctccagaaaagcccgtgaaaaaccagcataaacaaaaccgaatttcatttttatttccaaatccgatataaaagaaactaaattacaagtttttttatctcttgttcccgttgcaacacactggcacatactccctcaatttcataatataagtttttttttcttaggctgtgtttagttcacaccaaaattaaaagtttggttgaaattggaacgatgtgacggaaaagttgaaaatttgtgtgtgtaggaaagttttgatgtgatggaaaagttgaaagtttgaagaattattttggaactaaacacggctttagtcaaagtttttaggtttgatcaaatttataaagaaacacaataacatttccaacacaagacaaatatactatcaatcaaggttatatatagtgaaactaatttggcatcataaatatttctcttttttttctataagtttggttaaatgtaaagaagtttgattagaaagaaaattaaaacaacttatactatggacggagggagtaattagtttgaaataaaaacgagaaccagttacaccacggtgtatagaggtgtttgctgataataattccggtcaaattagcgaaatgattaggggatttgacctgaacccgatgtggacgcgcccgcgctctgccttgcccccaaaccaaccacgcgccgatgcctctgctctcctcacgccgagccgagcaaagcaaaacacacccacgtcgcggacgacgttgacgcgcccgcgcgccgctcccgtgacgccgccgctgccggtgccgcccggaggcggtcacgggggacgcgacgcgacggcgcccgcgcgcgcaccggcaccggtggcgcgtccccgtcggcgacggcacgcccaacaacctccctcggaaaaccggcctcccatctctttcacccgggaagcacaagcacccctcccccggttaattccgatttgaatcttacacgtactaattttattggtattattattttagtttttttttttatttacaaacttgttaaaaacgccggtgtggtgtcatggtgtgatgaaatctgaattttctcggtgcgtttgcattggctgtacatttagtttagtactcctatatgcatcctaaatttt

SEQ ID NO: 37752 - DNA, 5870 bp, Oryza sativa
actaacaatatgttcaatcttcggttactttctatgtttcataattaaatatttttaaattaagaattaatagtaagtactaagtattactaagttacagtacttaaaattaattttttttaagtattttaaaatcaacaagtaccaagttaacttgtcatgcatccttaatttagttttttatttaatatttctaaaactagaaattaacacgtaccgatttgtacatgtcaagaacttgctgtttccttttctaatacatagataagccgttataatttgctcctgagcagatagatggccaatttttttttcattgttttttttttccacagaccactggcttgaagtgactaattaagcatagataaatagatagacccaccagaagttcagagaaccaactgaacacatggcaaagcctgaagattcagttattaatcgtatacggatacagagcagttgttgcaacagggagaaattaggtcggagtgacaaaatgggaagaaaaaaaacagagaggaagagcctagtgagcgtcttcctcctcgcagtgcttggtgtacttggccgggtccagcagggcgtccagctccgacgggctgctcggcttcaccttgatcatccacccgtcctcgtacgggcttgagttaatctgtcaccaccattggcagtagcattagggtttgaaaattgtctcgcaaaaaagaatttgtaattctagtttgtggagagtactaatgaattaaattaacaaagagacattccggttaattaaactaacacctttaaacagggacatgctaccagtcttgaaaaaaaaaagagacacatgtaattttacagcgttattgttaatatgccctatgttaaaaaaagtaacttctgagaatgaatatgcacaaatgtatgtttagatttattttcaaaagttgattttttttaacggaggttatactctctttgagacggtgggagtacataccaggccgggtgtctcagagagcttgtcgttaacctcgacgacctcaccggagatgggggagttgatgtcgctggtggccttcacactctccacgttgccgaatgcacctccctggctcaccttcgcccccgcctccggcagctccacgaacaccacctctcccagatggccctgcgagtatacatacatatctagtcatggctatgtatatccctcatgaatacagagaccggattaataaaaattcattatctaaaaaaatatatatctagtcaggtccaatcaaattattttttaccccccatcttactgttacttttgttttcaaataattgccatcattactgtgtagcactaaaaagtaactggctagcattctgcagtggaagttagttcctttatcttgtttcttattaaagtaacaaaagacatgttctatttagtttgaaaaaaaaagttacagcaaaggtacttcatcatatttcttaaaagtagtaaaggaaaatgttctgtgacatatcaggaaaagggttgttagttgttgcagcagagggcagaatatttgattttgtagcatgccacgtagtttagaatacaacagcaaattgacacttaggccctgtttagaaatgcattaagctttaactaatcttgttgcacatgaaaggcatggaatattttctcctttggttggctcacctgagcatggtctgtaattccaattgtggccacagagccatcattcttgacccactcatgagaggagctgtacttcaacccatcaagaactgcaataccagcatgaaatcatcaccatggcttaaatcaacagggaccatagttacaacaagtatactcaactcttttcaacaactggaatttctaaattttattcccttcccttttcaatcatttagtatgtctccggtgtataactacagcatggaccagtcaatgtaacaatatagaatgtaaaaaagaaagaaaagaaaaaaggaagccacagcaatttataactgggtgcaaggatagcatggcacaatgcaagactgtacaggaaccagaacattgtaacaaccacatgctttgttgcaaaaggcaacagaaaatttatttgatatgaattctactactcaagctagctataccagtggagaagtatctggagattgagtaggcaggtgcagccctggtggctccactgcatgagatcttgagggcattggcagctgagctagcccacagcctcagagccatttctgtgccaatttcttgcttgttaccaaagtatctgtgttcttcttttttccttctcctagttagctggatgagtagtggcagctcagtggtggtggtagtatagtggaaagctgcagtgagatgaggggatagggaattgtttggctcaggaggagagggggaaaatgagagggggttgtgcagggataggatttgtatggttggtgggtgctcatagcctcatcctttgtttagaccattaattcccctctgcttgatccagtgtacatccatgggttaggacagattagttactcagttaattaagtgtgagactggaaaaaaatatctgacggcagttttataagttgagtgattgaactagtgaaagttcagttaactgtcaacggctgtagatttgggatggcagactgttctgagtcaaaatgaagcttttactgtgcgtggttaccaggtgcagtaaaataatttcagatctaatcgcagtaaaaaaaatgtagtactatatgttaagacgagattggtcggtcaaaatctatctggccctttacatctcccaaatgttacctcagttgcaggtggtaaaaaaaaatcactcgtttcacgtgatgtcggcagatcatggaccatgtctcaaatgctgaaactctgaacaatcaacaaaaaaatccaaccagatgagctgtgcaactgataattgatcatcacactatttgcaactcatctttcatgtagatggaacttcaatcccgaagaaataatgacagcaaaatgctgcgatcctgaagaaaggatggcggcaaaatggcagcgataaaaaaaaatggttggttactgaagaattatttgtgcagcagttgagacagtagcaagataagagctagctaagctagctaggtagagttggatggaagagtagtagtatgagatagagcatggagcgcgacaactcaagtggatgctaaagtaaaaggcattctcttctcttgtttggaatcagaaaagaaaagaaaagacttgagctgcttggctggaatgtttggttggatcatgcgcgctctccttagcttagctcgccaagaaatcctctcttcatctctctcaataattcaaagccacgagctctctgctcatatccagtgcgacgattcccgttaatgcaaatgcattatatccagttcgaaatgttacaattcttgcgtttgcagcaagccagcaagtggtgtgaattgtttaatccctcgtgcatttcaacgaaattctctcacaaattcgcattgacttctttcttagcacaattagtaagcagtgacaaataaagaatttttgaacaggatgtctttccaaggaaggtgagattttttatgtggatagcaaggatcgcctttccttagcatgaagagaatgtgatcaactttacaccttgcttacgattatggccttaatttttgataccctaaacaggagcacatcacatgcatgtcgacctgagaccaccaattaactgattaagttggcattgcagatgcatccgtcagttacatgatcaggtgatcgatggatcaactgtaggtttcattgctaatagctgctgctacatctgattattggagccagaaaaagatgcctgtcctttgcaatgtaaagagtgagtgaaaaatctcttcttcatctgctcctgcagcaatgcataccttgagagaatcatatcttgctagcattcgaatgattcatataagtaattgttagtatatattagagatatgtacttgcaagtagcactgaacaataataaactttgcatgctgatatatatcaactgaactaagtacaggttgttcaagaaaaagctgcaagaaccaaacatcaagtagtccagattgtagtagctacttcttcacggggtgcaatgcaatgcaacaatgaatcagaaagtaggataccttttgcatgcacttgaggaggggcatttgttaatccaattattcaactactaactaaaaactatatgtaattatgtcacatccacctactaccagacgtcattcacagacattttttagatggaagcttaactatataagtttgtgtcatccaaagtacacaagcacatgctaaatgttagcatgaggttgacacaatgctaactgccattgcaacaacagagaaaaaacagactagttaacaacagctgctgcatgcatacctagtgaatgattcacattgatcaaccgatgatccatattaggagtatatatatatatatatttatcatcatggaatgaacagttcaggagagaataaagggttcctagctggtgagctaaaagggggaattgcatgaacaacccaactgcattgctgctgtgatcatcaaccaacctataattattcatcctaacatgcagaaacatcaattctgcgttgatccataatggagtttaattagaggaagcatggcacatgccaaacacttgtcattggggcaatgctgtggtcatatccagcagcatgagggacatcctcgacatacttggtcacttccatcgataggtcaacccatcaaacggtactttcaaatatatttatatcaagaatgttattatcagcattgccaattactctagcaatctcccacatgcaaatgcacagtgttactttggaacagtcattctcagagattgcgtatgtggcttggtttaatcatcgttgttaaccggtaatcgagtgatctatcagcaatgcaagcagccaagctggcagtaggtggtagtagtagtagtagatacatgttgattgatcgagaggccaataagaccttgcatttcgcagagcataattggtacctagttgcagggttaacgtgctactgctctgttagttgcaatgcactcaaagcgattaaccattctatatattaattaatttctccaagaacaacaagatcgaagagatagtgccatttgccattggtctaccatggaggaggataagattgtgcattagctcacatgctctggacctcaccttatccatggcgaatccatcattgccgccatgatcgagagagatgagaggccgggagatggtgttgttggacatgtgtgatgtgatgatctctgcacccctgtctgtcctgtcgagtgtcgatcaccactgaaagctggagtaggctgcatgcatggatggatggtccccatttcgttgcaacttttcaagaacattcgacagcaatcactatacttgtactgccagtggtagtacattaaccacgtcgatcgactgctaattaagcattgttcctgcctgccattgtctcgacgactgttcagagccgtcctactctaccagctgtttagctaagctgattgtagtttttggcttcgttcgagtccagcgttcaaaatttcggtcctatcggtccctttatatgatattatattggccgaaatttttattttaaaacgtttcatgaattttaacaatatttattcaaatttgactaaatttttgaaaatattgctatctcgacacccttaatacaaataccgaaaacgaatgattaagccctagtcgagtctgccactcgtcaattagctcgagctcgattgactcgaagctttag

SEQ ID NO: 37753 - DNA, 13375 bp, Oryza sativa
caccttagcaacctgcattattgtgaaaatgtcgccgtcgatcgacggccggccggccggcgacaagcagcgccatgtgagatgatggctgatgtaggagaacaccctcgtgacaataaaaccacagaagtctggctccatgcatgttaatttgctactgctgcagtagtggtttcatgaatgcgacttggatggatggatggatagatccataccctgttctgagcagagaccggacgtgccaagtcataacatgtttgaacaacgtatattctttgactccacaggtccactagtacagtgttgtaccgtatcatttcatctgcagggatattgctgtagaaccttttttctttaaccaaaatacaatgttaacatatttaattacatctgcaatcgtacataatttaggccctatttgagattgctttaagtgaagatgaagtgtacgcacgtaaaaaaaactttagcatgttattaattaagttttaattaatttaaacttaaaaatgaatttatatgatattttaaatcaatctatgtatataaatttttcgcatgaaatatagtgtttgacagtttaaaaaacgtgctaacaaagaccgatgtaaaatctgtatcttaattgaaacagtaccttaaacgccaatcaattcgcaaatgcgtcggtgagccaagcttgattcggcagaaccgcaaaaacagatgaaattcgagcaaaagctatactactagtacgaatcttggcaaaaatgcagtatgaatcgtccttctccagttcctccagtccgtgtcatcgtgctcctggagtccttgctagctactgtagtagtatagctgtcatggcaggtggggccctccacccagcacgccgcaaggttggaccgccagcctggcgccccatcccaccatccctccccgatccgatcaccgatctcagccgcccgcaccaaattcaaatcccccgcgccccgccacgtaaccccccccccacacgccacgtcggacagaatccggtacacgcgggcccgtcacgtgactgctcgccgccgccgccgccaacgacgcaagcaacgcgaccggtgggtggcgcgagtcgctggtgataataccacgggatggggagaacgcgtcgcgagtgtgtacaagaaatcccagcacgaattgtcttttgtacgcatctaacaactaccagtactactactacctgtatgtatatatacacatcaatacgcataatgcacagtgcattagtgcacgatcgatgattgattgcattgtgggggaggtatgaataagtgtaccggtagtaggccgtatagcacgacgcagagcaacatacggcaacaccaggagtacgtacgatgccgtgggttattacgtactcccccgtcccaaaaagaaaacaacctgtgacgaatctagacaactcttatccagattcgttgtattaagaggggataaatttagattggtttttttatggagagagtagaaaacgaaaagaaattagtatcactacagagccaacggcctagatatatgctctctacattccaaattgatctgcatataattttttttatgttattcctaaattatctacatatttgtgttcatttattaagtctattcgttatttgtgcattggagtaaatggacattgatgcatgcatccatgcacacaagtatttataacccacatgcaatatcttgatttgctattggctaagaaatagtagggatggtgtatacattgagtttgttgctagagtaaatatagtatgagagagttactccgtattagtttttcttggtctcgatgtacctataaaatatatagatcaatttgaaatgtagggagtactgtctccgtccattttgggatgggggaagtatctagctcgccgtcgttctttcgttcgttcgtctcgatggccgtcgggccctcccccgcgtgccaatgatgccacgccatgtgatcgttcgccgcgctcgcgcgcacgcctttacacggtttacaccagcaaagccagcagccacgcacgctggcgcgagccgctcgtccacggcgtcgcgcgacgcagaccgggcgcgggctagcgaagacatcagacatggcacatgcatcccgtggatagctagctaagataggggggctgttgctgctggcatggatcgcaaaaggttgggcgcctttgcgagtttgcttcgctttggtctcacctttgatctgcctttggagcagcctactactagtacgctttatacccagttgtagtactcctccgatcgatctgattcgatgctcctgagagtgcttttctttgctggtttatgatgactgatgagaggggaggggttgatgtgtgtcgaggtgccatttcaccagcaggttaatctcggagcaaacgagcccatgagcgatgcaaatccttattaatcctacattacctctatgtactaccagtactcagtactgatgatcacacgctgcactgttttattttactcctgcgcagacgtcggcacatgttttataacagtttttccttaaccaaaaggctcgcaactggcgtagcttttcagaatttttttagaaaaacgatccataccatacgagcactggtacgccagcagctagctactcctagctctgacatgttctgcaggctttctgagccatacgcgagatgacgcaaggcaagggcatgtgtcgtcaggacaaggacgcccccctctccaataatctatcgctgcacccagctgcaatcattggccgcccggcgcagggtatcgatgcagacatgtacagtggagtatcatcatggccctgcacctgcaccactactactcctactgccagtctaccactgaccgactactgtacaactctcctcggaaagacaagcctcacaactcacaagtcacaagcttgtttttttttttgagacaaaggcggcatgccattcattgattaagcaacatcatcacaaagtatgtcccggatataatccggtattacagaacggtacacagtacaggtagacagctcggcattccgagctagagaatgagccgccaaattggacaaccggttaacatgcataaaagagcataaaacaaaggtggacgccaacttcttgatatcttcaatcacgcatcccacccctgagcgatcccttcctgaagtttggatgcgtctgattacagtgagacaatcagatgccatgacaatgtgttccaggccctcttcctttgctagacccagtgcccgcctaattgccagcgcttctgcaagctcaggtagcaccacatcgctgatcatctccgagcaagcaaccaggcatttccctgtattatcacgaatcaaagccccgacccccatggtcctggacgagctgaaaatcgcagcatcagaattgatcatccatacgctggccggcggtggctgccatctaggtatggcttgagtgtttccaccccgctggccatccaccgtcttcgtattgtgctttagaatcatgtcgacataagacaaaattttgatgacaacacgttgggggtgcactgtgccattgttgttctttgtattgttccttgcttcccagatgtgccaaaaggtgacagccaaaagggtgtttgcatggctggatccccgtttcaggaaatcaaagatccattgcctcatggttgagaacccatttcttcctagtttgacagcgcacttacccttgatttcctcccagatttgagcagcaaaggggcagaacaggaagacatgttccactgtgtcatctctgttgcaaaaaacacagccatcagtagaggggatatgccgtcgtcgaagttgaaacccagtcgctaagcattcatgagcagcacgccagagagtaattttcatctttcccggcgcattgattttccacaagcccttccaatccttttggctttcaagcagtctcgacgccattcctcgcccactgttgctctgatcagcaaagaaagcttctgatcgcgccagattgtaagccgaacgcacagagtataaacccagtttgtcatgtggccaagaagcgaagtcagcatcaccatgtctactaataggaatctgtagaatctccttagcaatgtccacagggaagagggatcttatcaaatctccatcccaacatctggcatcctcgttcatcaggcagctaacagtggcatctgttgggaagggagaaagcgttgtcaccaattgaggtcgaaacccaggtatccaattatctgaaaagattttgatggttttcccatcaccgactccccacctcactccttttgccagcagttctctcccaaacagcaagcttcgccaagtgaaagacggcgatttcggttgagcagcctcccagaaggacgagttagggaagtatcttcccttcaaaaccctcgagcacaaggaatcaggatcagtaagcagcctccagcactgtcttcctaacattgcttggttgaaagtagtgaactccctaaagcccattcccccaagaaatttaggagtagaaagccagctccaagatttccagtgcatttttttcttaccatcctcaaagccccaccaatgatcggcaatacaagtcttcatcttttcacagattgagacagggatgcggaaacaactcataacataatttggaattgcttgggccactgctttcagcattgtctccataccggcccttgacagcggccggtcagtccatccattaacccttttccaaattctttctggcagaaacttgaagaaatttgtggtagcaagcccaatttcagtaggcatcccaaggtaagagtcttgcaagacttcattatcgacttgtaagcagcttttcaccgatatcttgaccgcatcaggacatcgtttgccaaaaaagattgaagatttgtgcaggttaattttctgtcccgacgcactgcaatatgatcgcagcgtgtttttgagtgcttggacattcctgctgtcagccttagcaaagaaaatgctatcatccgcaaacaacaagtgggagatagggggtccatgcctgccatttttaattccttgtagctcacccgctacctccttcttgtgtagcaaacatgacagtccttctgtgcacaaaaggaacaggtaggggctgattgggtccccctgtcgaatgccccttgaagggaccaccggcttagtcagctctccattaattttgacggcgtatctcactgaggagacacaacgcatcacagtgttgatccaatcctgggaaaaaccaagtttcgataagcaacccgaaagataagcccactcaactctatcatatgccttcatcatatcaatcttgagtgcaaaaaaaggatttttgttgtgttgtttacggatggtatgcaaacattcatatgccactagggcactgtcagtgatgaggcgacccggcacgaaggcactttggaactcagacacaatatctgggagaaaaggcttcagccggttcgcaagaacttttgaagcaatcttgtacaggacattgcataaactgattgggcgaaattttgagaggtgactcgcattgtttaccttgggaatgaggacaacaaccgagtcacaaagaccttccgggatctcctctcctaacaagaaacctctcaccgcattacagatgtgttcctctaggataccccaatgtgtttggtagaacaaagctgggaatccatccggccccggagcctttgttgatcccatttggaacagtgctgtcttgatctcctcattagtgtactgtttgcccaattccccattgataaagtcgcctactttatttgggatagcatccaagacttcctccattgaatcacagggctccgaggaaaacagattctcatagaaaacttcagccatgcgcttgatcccttcttgggaaatacatctagagccatcatcacgaaccagctccttgattctattagtccgccttctcgccgatgccctggcatggaagaaagcagtgttgcggtccccttcacggagccaatccactcgggacctctgacgcgccataatctcctctttctcgaaaagttcacagagttgttgctcaattaacttctcttcctgaatcaccacgtcattaactggtgactgtcgcagggatttcagcttcctctccatcttgaggattttcctgcgcacagacccaaaggaagccttactccagtccttcaaagacactgcgacttgttgcaagacactccaaactcccctcagccccacgcatccagcagaagagatcctccaagaattttctaccacctccctgtaatcctccgcccgcaaccaagccgcctcaaacctgaatccctgctgaatgggaattctcctttgaccgtggttccttctcgacaagtcaatagagatggcgtagtggtctgaggatgttgttatcacattttccaccaggcagtcctcaaagtatctcgagaactcgccatttgcgacagcacgatcaagccggaccttgctattactgttagcatcctgcttattggaccatgtaaatttgggaccaacaaatcctaggtcaataagaccacaatcatccaagcaacttctgaagtgttgcatatgtggctctgatctctctcgcatccccaagtgctcatcgaggcataaaacctcgttgaagtcgccacaacacagccacggccccctccactgatcatgcaaccggcgaaggaggttccagaaaaaatgtcgaagctcacgtttgggttcaccgtacacaaaggaaattcgccaaggaggcaactcctccgtagagaccagcacatcaatgaaatgggagttgaaccccctaagagaaaccgtgtaggctgtagtccaaaacagggctaagcctccactaaggccctcgcagctcacagcaaaggagccggagaaaccaagtgaccacatcaaatttcttgcctgtttgtccctcatcttcgtttcagacaagaagacaagggagggtctcaaagacttcactaaccagcgaagttcacccactgtcgcagccgaccccaagccacgacagttccgaccccaagtcacaagcttgtttggttccatgggcagggacttatatttttttagagagggtccctctctcccaaacatctctttaggtcttagcaccgtatacaatacgactagggtcttgtttggtttcatgggctaatgtaagaatttaaacatgtgggctaattttgatctaaaatgaattagcccccctcaaaacattagcccctccaagagatgctaatggagctaattttgtgtgaggactataaaaaccagctctctctctccttctctcccctctctttctactctctctctctccaccttttagccttgaattaactcatggatccaaacatgccaccctagactaatatttagcctaccaatttatgactaaacattggctcttaaaattagccctgggctaatctttccaacaggcatagtacaatactcgtacgtatcatatgcactatcgtgcgtacgagtactcttggcgtgtcacggtcaacatagatctcactgttggcgttattgtgacaatgcacaacttttttgacgtaggggcactgtactactagtagaaatactagcgttgcccaagagattgttcacgtgccacacacatgcggcgcacccgtcgatcgaatcgaggggagtgcacggcttttgagttgtgaccacgcgtttggtcgggcctgggctgaaatcgtgaaagtttgtcgggccggatcgcgggatcgaggcggatggaggcgcgcgcggccttcgaaacgggacgaattctcgccgaccgcgtttgggccgcctgcccggatttgcagaccgttttgctcgtctgggctttcactatgttttgggccgcaaatttctggcctaatgttttcctcgtccagactccagcgacgaacgaacagtggagttgcgaacttgcgatcaagctacagcagcagcttgtctgattttattcgataaccaaaacaaaggggtttatgcatgagtagtacatacgaacgtagcggaattcacgatgccagcatcaccatggctaagaagcaaaaaaaaaaaaagtatgagcgcttcgactgttcgacacgattaagatagtgtccagcgacgtacgtgcatgcatccgtacgtaacggcatatacgtagcattattattctaggtcgtcctcctgggcacgaggcgcgcgcggagcggcttggccatgacggtggtgaactcccgcttctcggcgaactccacctcgtcgccggccacctccttccactcgaactccctcaccatgttggccacgaagtactccaggtggtgcatggcgaagctgagccccgcgcagatcctccgcccgacgccgaacggcatcatgcggatccccttgctgcccgtcacgtccaccccctcgccgtcgccgccggggaggaaccgctccgggatgaactccattggcttcgcccactcccgctcgtccctcccgatctcggccaccatgaagttcaccgtcgcgcccttggggatgaggtagccgccgacctccacgtcctccgccgccctgtgcggcagcacgaagtgccccggcgggtgcttccggaggccctccagcaccaccgccctcaggtacggcatgccgtggacgtcctcctcggtgacctccggctggtcgtcgccggtcttggacttgatctcgtcgtggagctttgactggatggatgggttcttgaccagctcggccatgatccactgcagcgcggtggacgtcgtgtccgtgccggcgttgaggaactcggagcagagcttgatgatctcgtcgtcggtgagcgcgcggttgccgtcctcggggagcttgatgtcgagcagcgtgtcgacgtacgagtgctccaacgtggtctctttgttcgtcgtcttcgtcgtctcgccgccgtgtttcttgtactcccggcgcgcgttgatcagtggcatgaagagctccctctgccggcggcggagggcgtagatcttctcgaggcggccgcggaagaggtgcttggtgatcgccgggaagtaggcgaagacggccatctggctcgtgatgtagatgagcaggtcgcgctgggcgtcctcgacggcgcgcaccgtggcctcgtcgaggcgctcgccgaagcacatattcacgaggaggcagaacatggcgtactggagcgtgtccacgacgtcgtggggtgcctggccggacgccgccagcttgtcgacgatgacgcggtgcacccagtagcgcgccggcgcgaacaggcgggcgcgcgacgggtgcagcgtctcggagacgaggttgcggcggaggaggcgccacacgggcccgtacccggcgcgcgtgatgatgttgtcgttctcgccgaggagcctgctcgccggcacgccggggcggtcggccagcgcggcgccgccctcgacgagcgccgcgtgcgcgaggcggcggtcggcgacgaagacggacactcgcgtccccatgcgcagcgacacgatggggccgtaccgagcgatcagcctctggaggagcagctccggctcgacgtcggtcagcgccttggtcagcagcacgacgctgccgagcaacggcaccgccggcgggccgggcgggaggcggcggccgcgcttgccgccattgccgcggaacagaatgaacgggacgacggcggcggcgaggattgcaccgaggatcaagtacaagttgtccatggtgaaccggagcttagctagctagtagctcaccacgtacgaacactacgagctactgagtgtgtgtttgtttgtcatggctagctctcactctcggcgccaatttatagagatctctggccgatcgatcggagacgaagagaacggacggacggttagaaattattttctacacttacctgccatactgctatgtatgacacctactttagacagttatataaaaaaatcataaaatttgataatatagactataataatataagacgctatacaaatatgcaagtctaaattcgatctacacatgaagaaacaataataataaattttatctgcattgtacgggtactatttattatttgatttttataattttttatattatagataaaagagtaaagtgcattggcggtccttaaacttgtagggttgtgtcgtataggtcactaaactctcaaaatatatatacaggtcccagaacttgtcaaagtgtatcatctaggtcccaaattgacacatcacctctagtatcctacgtggcgatgatgtggcatgccacatggatgtgacgtgccatttttttttcttcttcgttttcttctcattcttcttttttttccctttcttctgctcgggtcacagagaaaggagtagaaagggaaaaaaagataagaaaaaaagaaaaaggaaaaatcttaaacgagacccatttgttagtcaaaatgatgacacgtcatttcgtgtggcatgccacatcaacgtcacgtaggatcctaaaggggttgtgacacactatgacaagttctgagacttggatatgcattttgagagtttatgaatctagatgacacaccactacaaatttaaggaccatccgtacactttactctatataaaatatagtcttgcacgtttgtgtatagacttatatcattataattgatgttactatactttttattttttatataattattgagtcacatggtgctatgctatgacactaggtgtggaaaagtagaaaatccttgtcccggttggttgatcttgcatacgtcggcgtaatgatgtcatgggtttttgaacgatggaacaatggtcaaggccgggaagcttccatctgggaacagtccattttgttctacgggtgcaactgtagtgtgccatcccaaaaaaagaccctaatttccgtgcccaacgtttgaccgtctgtcttatttgaaaaaaatatgaaaaaaattaaaaaagacaagtcacgtataaaatattaatcatgttttatcatctaacaacaatgaaaatacgaattataaaaaaaattcatataagatggacaatcaaaattggacacggaaacatagggtttgcctttttttttggggacggatggagtacaagtactacaacacgtgacatgcatgcgatgcagactcctgaacggtagtacagtccattttgttctacgtacgggagtagtaagtatttcatataaaacattattgcctggccaactgcttggctccacctggaggtgtgtgtcacacccaggtgttgtggtacattgtgattttttttgacgaatcaatcgagattgtcttgggcgcttggctggcttcggcagtatgtcgttgatttgcgttcgtggggttgaccggcgtttggtggggggagacggactgacggaatttagtttacctcggtcgtatcgatgtgtagctgtgctcctggagcctgatggaaatccaaagagatcctttgaagataggaatttcatgttctctccgtctacgaatataaaaatttctaaagtttagcatttctctgcagatataagtatttttaaagcatcgaaacattttaaaaattttgcgaaacacaatgaaaatacacactgaaacatgtcgttatcgcatatgaggcatcaagtgttaacggattgaaacgtatgtttttcatcagaatatagtcatgtaatgtcttgttgtaatatttaattgcaacaaatacaatggtgtgatcggatcgtagatcggataagtagtttagaagaaaaatcattttgaagatagttaaatgcatgcatgaatgaagtggagagagaggagatagagtttatgtgaattttgtgaaacatacagaagacacatcttgaaacatatcgttatcaggtatgagaatataatcacgtgatatcttgctataaagatttaattacaatcaatacaatggtaccgtatcgtagatcggataagtagtttggaaaaaaaatatttaaagttaggagaaataaaagagaaacaaactagcttgatacaatcttgcatgttggggagtgtcaggaagcctgatttttcttctctaaatcgtactgtactaccgaggctaaatattctcctcaaaattcccttgccaaaccaaatgatgcacatatttctacgatgtactctctccatttcaagatagggatacccaggctccgtttagttcttaaaatctttttttcaaatacatcatatcgaatcttttgatacatatatagagtattaaatatagataaaaacaaaaactaattgcacagttagggaggaaatcgtgagacgaatcttttgagcctaattggtccatgattagccataagtgctacagtaacccacatgtgctaatgacggcttaattaggctcaaaagattcgtctcgtggtttccaggcgagttatgaaattatttttttcattagtgtccgaaaacccattccgacatccggtcaaacgtataacgtgacacccaaaaattttctttccacgcactaaacatggcctcatttgggtaggtgaacgaaagaatttttcctagaaaaaactagtactattttcccacattgtagagaggatggacaagacacgtgcactggctgcacaaacgggtagaggtaacaagatatcaaaattttttcacaacactatctagacttcatatatttttaattttggaaaaagtacgaattacctctcgaactattgtggtagtacgatttacccccttaaactacaatactggacatttgacaccccaaacaattaaaactggataaattacccccctaactcgattcgtagtggttttcagtctacatggcacacacatggcgatacagtcagcaaaaatacaaataaaaataggtaggcccacctgtcagcgattttttttctctccttctcccccctctctctctctctctcccccccctctctctctctctcggccaacagaggctgcggctggcgggcggcgggcgggtgaggagccggcgccgacgggaggccaccgccggggatggctgcgggtggcgggcggtcgaggagccaacgccgactggcggtcggcggcggggatggctgtgggcggcgggcgggcgaggagcggagtgtgtgcgcgaacgggcgctgccgcagctcccccgtcggcgactctgtgactgcgaaggcgaacgcgttgctggcaactgcaacggcgaaggcgaaggcggcgacaagatcgaaccgcgagctccggaaggccagcgacggtggcacgagtgc

SEQ ID NO: 37754 - DNA, 7490 bp, Oryza sativa
  unsure (1)..(7490): unsure at all n locations
tgcgcccgcccccatcgccgccgtcgccgtccctcgccgccgctgccgccgccgcgcccgtccaccaccgtcgccgccgccgtcgtcgtcgccgtctacaagggacgactgcaggtggccggccgcgcgtcgggatgctcctctccccaacgggatgtccagttatatctagcaggaatcacctgatacctggtaggtatcatccgatacctagtaagtatcacgtgatacatagcagaaatcgtcggtacctgacatgatacctcgcgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaaaagagggcggcgtgttcgacagttcgacggggtcgtcgaacccctgagggtgggtggaatgtaacaccctaaaaaaaaaaaagaaaggcaggcaagctagcagcagcagttgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctatctggtcccaaaactaatgattcgattcggaaggagtttatattacaaaataataggggaatttacaaaattgtggctaactaatacaacagaagctataaaatgactcaatcctaatgttttaaaattgtggttttactatagacttaaaccatctaacaaatctagacttgaaaactaggttaaaatattgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagttgtggttttactatagacttaaaccatctaacaaatctagacttgaaaactaggttgaaatgaaactaacttatatgattgaactttcggcttcggcaagaactccaaattaactctgaaagaagaggggttgaagcaagggtgagtataacgtactcagcaagctattatatttaagtatgaatgtatgaaataatagtatttgagtagagctagatctatttgcagaaagctgagaaattagaaggagaaagtctataatgtgttgaaatgcaacagtatttaataaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcagtggcacctgttccatgaactctcatcctcatgcgctctgaacgtaacgttatcagcagcgagaggagttctggcgttcccgaggtctttagagagaactggttgagagacccccgtcgtcccaaccaggttttcacaatacacacacagcgcgcaataatcaatatatttacccgcgcctcggtaaatattataatcgccctgctcggcgtaaatttgcctcctgcgcgaggacttaaagaagaaccactatacagaggtaccacctttgttagataacctactttgctaagtctgtccccattctagaattgcggtcgtactcgttcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatctggtttgctatatgttcaagttatgcatttaaaatcatgaatggctaatgcatggaataatagagatatagaatataggataataatgctcaaaggggtggaataataacttgccttgctccaacgcaaacaaatccgagataggcaacctgattatccgatcctcgaaacatcacaggttgccatccaaaagataatagactactaagaaatacgaagaactaaattcaataaaagccataaaataacaagaaaacgataaatggttaggacggctagggtttggttgtgtggtagtcgatgctagagcataacgactaggtttggtatcttctctagccggtgtcaacagacagcataacggttagagggataggaggtttgtgtgggtttagtggggcggaagtgttactccgacaaccgtgagtggtggcggagcggctaggatcacacagagcccgagagctaactgtgcggcgtgctgtggaggtcgagggaatagtgaagctccgaccgctgtacgcatcaaggcgtggggtgccaggagcaacacttcgaccttgggtttgggctttgccgggctttataaccaacggttcgacgtcgaggatagaaaaccacgaatgtccccatggaaggcataaagttccaaccgacggctttttagtggctaaaggggtaatttgggacaaaagaaaatatttgaaaaggcaaatataaattcaaacgatatttgaatagattcaaataaaattataaaatagcaaatttggtgtcaaaagatagggtttgaatttagataaatttaggtccaagttttattggaatcggatctacggtttaggagatatgggcttctaaagattgggttttgaattaaatctagaaaatgagaaaagtcactgtgcaggggacccacctgtcaggcttttctttttcttcttctttttctttctctccttcttcctctcgttttcctttcttcttcttccaggctcccagccgagtaacagaggagggagaggattgggcgccggtgctccggtagccggggatcggcaacgtcggtggcggattgcgttcccgaacaacgcgcatccggggaaggcagtttcaagcgaagggagttagagaggaagccggaacggcgagtggaagagcttgcctccggcggcaaaagaggtggctatggtggcttgatgaagtggttagggaagaggggaaataggtaaaatggattctccttgtcgaggcgaacccgatggtgcaagtatttggttggcaatgctccagtgagggagatcggccgatgactggtgagggcttgccatggcaggagagagagagaagcagagcttcaagctctgttgatgtgaggaaaaggagggtacctcgccggctatttataggcggcgaaggtcggttgcttatggcggttttggaggagtaggtgaaggcaaacacgatgatgcatcggcctgtaggaagggaagtcggcgccggctctgtcttcgattggccgatagtgtcggttcggctcggcggctgacggcggcagcgtgaggtggcggctgacgtcggctgcggttgcttagcagcgacggaaagacggcggcggcagttgatgaacacgacatggcgacggtggcggcgcgacttggcggcgacggaagaggagcttgcggcggcgtgcgccgtgcgcgtgtacgacacgcactgggaggagggggcggttcggctggggttggctgggccgaattgggccggctcggcttagctgggccggcagcccgagagggaggaggaaaatagaagataaaagaattgggccaaaaggaagaaagaacggagtttcggcccgatgacaaaaaggaaaaagtctaatttgaatacttaatatgcaaaactaggttttgcaaagaatttgaattcagaaagaattcacaaaagagatttcctaatatatttgagtgcaatatttagaggtggagtttgagggaatttatttggaagcactcaaataggaagggtgagcgatatatgaataaaatttaatatgtaaataggaaggtgggaacaagatagttggagaaggataaatagggttttagcctcaaaacatatggcatgggtttcaaagaattgtttgaggctaataggaaatttgaatgacaaagatataatctattttcttagcacaagagcaattattcacaatattcgtaataatattattcttgtgccgaggaggaaatcaagccacaggaattaaattgacggctagattggaagaaggaatttggatacaaatttggaaaggggactaaggataggtttggaatcaaaggatagattgacaattaattccaataaatttggaattgcttcggttttggttcaaggatagtgttggaggatttcttggaccatgattcataaaaataaaaaggggttttcaaactaaatttgaataaaagaattttagtcaaaagaaggtttttaaattaaaacccaaaatcaagaaactccttaatttaactaaatatatttttaaaggaaagacacaaaagaaattaaataccagaaagagatttaatgcaggttaattttaggaggtctctttaattataatatcctaggtttaggaggttaataaaaacgtaagaaccggtatgatgcataattagaaaatagctaattttcagtatgttacagatacttgataagtatcatatgatactttgcaaggatcacctaaaacgtgtgtaaaatcatctgatacctgataggtatcacacctgatacctactcgggatcttcccgttagaaaatgggattccgttatatagcagccccccaaagaaaagatggatagtacgcagcgcagcgattcggaagtatgtgtacgacgaggagggcgattctcaatttcaccacatcgagaagagaaaggcggaggctggcggcggcggtggcgacgacgaccttggcagtggccgtccaaggcgatgacggcgacttggactacgccacgatggtcgcgcgcacggctcatttcctagcggtggtccgtggtcgagcgctacgcccggatggtgcacaagctagttctgggactaagttgacgagtatcatgtgtggaatgcgatcgtctcgacatggagcacccgtcggccgcggctgtcgacgatgacggtgacgaccggcctgcccccatcgccacatcgacgacgtgcggtggactgacgcggtggagcggacacggtcagagatcgaggaggcgagcgagcgcgagtgcgtcgcagtctacgagctgtggaggaaaaggtggtggcagtgtggagccgtaggtgggatttgggagaaaacaacacccaatagctgggaataccgcgttagacacttagaaaacgcggtagcaggcagccgtcgtagccgtcgaggaagacctagctcaacaaggcgtcggagacctcgtcgccgcttctgccagctacttgattccgctctagtcctggaggcgcgcgaagtcatcgcggaggcgtggctgcgtcccaacgacgggcaccgatgacacgccattcccggcgcgcgtgggagagggagaggagggagagggagaagatttagctagagacatgtggggcccaccgcccacatgggtcacactcatcgcgtcagtcgggctactatattgtcgaggaccaaagttaacacggtatggtgaatttgaggatgagttataccttttgtttcggtatagggaagaattttagactctacaacaacttaaaggacttaagtgattctttccagcaatctagcccaactggcaagctggcgggctggtcgccgtcgatgaaggcctgttcagttcccactattagggctttttcggattagaggatcttcacgtgattttcggaggaatactgtgcataggaattttttttcctttcttgtcattcagatcatgaaaactgtggttgtaggaaatccaaagaaaagtttcctttgatgctgatttcacatgaaaagtatatgaaaaatccgtccaccttaagctctttttttttattcctgcatgcaaatcccaggcaattaatttcatgttatccgaatgtcctcatttttttttattcctttgtttttcattcttatgtttcacacttagattcctttcctgtttctatactttcccaatcctatatttttcctatcctataatctgaatgaacccttaatcatgatttggaaattccgaaccctggttattttacatttcacaactaatcatgcatatctattcataatttcagaaaagattacagtaaaaagtaccaagtaataagctagtaactagttgatacccccgcgctttgcagcaaaatatgtggataaatgcatgttataccatttctataatgtataacatgcataaatccacatatctctagcaaagcacgaggtatcaactagtgggaacaatattttagctcaaataaatatggaaaaagtactacgccggccgcccccgttagggtanactctcatcgaggtcgaccgaattacacccccgaactcaaaatccagacattgtacaccctccactattgaagccgggcagattaccccccctagctctgtattaggtggttttgggatagacttgctgacgtggcagtcctacgtggccgcacacgtggcactggccccacatgtcagcctccacctcatccaccctctcttaaaataattagtgggacccactgtcagatccccacccctccctatctctctttctcttctccctccccctctctctcttctccctcccctccccttctctctcaggcgtgtgtcaacgggcagtgggcggcggcagcggcacgcggacgggcggcaagcgcggtggcaggcgcggcgggg

SEQ ID NO: 37755 - DNA, 5070 bp, Oryza sativa
ccgaccgccggcctgcccccgcgcgccgctgcccatcgcatcccctcgccggcgctcgcctctccaccatggcgtgccggtgtgcgcggcgctgcctgctgctggccgacgaagagagagaaagagagatggaggaagagagaaagagtgtatgacatgtgggtcccaccattttaaaaaaataaaatgctgactggactgccacgtcagcaagtctatcccaaaaccacctaaaacagtgcttaggggggtaatttgcccggtttcaatagttgagggtgtagaatgtctggtttttgagttcgggggtgtaattcggtcgacctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgccatggacgcctggcagctgttcgtccccgcgatcgccatcctcatccccttgctccggctcatcctcttccgccgcggcgacgacgggagacgcggccgcctcccgccgggtcctccggccgtgccgttgctcgggagcacggtgtggctgaccaactcgttgtacgacgccgagcccgtcgtcaagcgcctgatgtcgcggcacggccccgtcgtctcccttcgcttcggctcccagctgctcgtcttcgtcgccgaccgccgcctcgcgcacgcggcgctcgtcgagagcggggcctccctggccgatcgccccagccaggccgcctcggccaggctcgtcggcgagggcgataccatgatctcgcgcgcgagctacgggcccgtgtggcgcctcctgcggcgcaacctcgtcgccgatacgctgcacccgtcgcgcgcccacctgttcgcgccggtgcgcgcgcgggtgcgccgcctgctcgtcgacaggctgcgggaggagcacggcgaggcggaggcggcgccacgcgccgtcgtagagacgttccagtacgccatgttctgcctcctggtgctcatgtgcttcggcgaacagctcgacgaggacgcggtgcgcgcgatcggcgcggcggagcgcgacacgatgctctacatgtcgagcgagatgggcgtcttcaacttcttcccggcgatcaccaggcacctcttccgcgggcgtcttcagaaggctcacgccctccggcggcggaaggaggagttgttcgtgccgttgatcaactcccggcgggagtacaagaaaaacggcggcgagccgaagaaggagacgaccacgttcacgcactcgtacgtcgacaacctgctcgacatcaacctcccggaggacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatgctgctacctcacaaggcggcggaggacatggacgtcggcgggtacctcatccccaagggcaccatagtgaacttcatggtggctgagatgggcagggacgagaaagaatgggagaagccaatggagttcatgccggagcggttcctccccggcggcgacggcgagggggtggacgtgacgagcagcaaggggatccgcatgatgccgttcggcgtcgggcggcggatttgtcccgggctcggcatcgccatgcttcacctggagtacttcgtggccaacatggtgagggagttcgagtggaaggaggtggccggcgacgaggtggacttcgccgagaagcgggagttcaacaccgtcatggccaagccgctgcgcgtgcgcctcgtgccccggagtacactcgaataattaatccattcctcgattcctagagaaaataattgtgcagtatattatatagagtaaattccttgtttgctcctgaaaagttacccaatctcttacatgcccctaccgtttggaacttacttgattccttctataccccaaattttcgattgaatcctctacatacccctaccgtttgggttccgtcagatgtttgtgttcatgtgtgtgttagcttgtcagtattttcataaaatgcgaaaatgcctctgtcaaccctaggtaacacagggccacatccgatccccaaatcctccaaaatagtatagttcccacacgcacggtgccgcacatcgccagctttcagccatcgttgcacgcgcatcgccgcccttctcccacatcccggcggtggcagcggctctgcatcccgccgcggtctcggctctgcttgcggtcagcggtggcggctgggtccgcatcccatcggtggcgcggcggggtccgcatctggtgggcggcgacggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccactgctcctcgccgtcggtaatgatacgcccttgcgttgattagcaaaatgcgaatagctgctgctgctgctagtgtttcttgattgatttgtttgactttatgcaggcggatgccttgaactgttatgggcttgtgccattatgctcatgatgtaaaaagtaatatatttgtgtactgctgatggtgtatgaatgcttttagatgtattttcattttcttcctattaaatggtgctaccgatcctcttgatatgctgatgaattgcaatggtgtttgagtaaacggctaggggtactgtcttttacccccaggctgtgtcggttagtggtcatgaaagatccaatgtcatgttatatttttttataaaatactgaatgctataacaaaagaaaatgaaattaattttatgcactaattttttagtctcacggaatacatactgtgcagtcatgaatgtttcaaacccagctgccaaacatgttcttagttttcagctcctccaacctcaagggtattatagacattttcaaccaaactaaccagggaatgctgctcaatctaacggtaggggtatgtaggggatccaatcaaaaattcaagggtggaatcgagtaagtttcaggggcatgtaagggattgaataacttttcaggggcacacaaggaatttactctattatatacggtacatatacgaatgtaagggaacaaacggccaaaatcatcgcacgtagcactggcagcttcctttctttaatgaatattctgtgagaaattttacgattctcgagagataccaagagaatatcctatgtgtgtactccctccgtttcgaaatgtttgacgccgttgactttttatcacatgtttgaccattcgtcttattcaaaaaatttaaataattattaattattttcctatcatttgattcattgttaaatatatttttatgtaggcatataattttacatatgcacaaaattttttgaataagacgaacggtcaaatatatgataaaa

SEQ ID NO: 37756 - DNA, 18775 bp, Oryza sativa
atttcgaaacggagggagtacgttgtgagtttttcgctcagtcagattaccttgatgatcctggcatcgtctactctgcagcgttggtgtgtaaaataatgaatggtggaaactggaaagtaactcctctggcattgccggccatctgcacggcgcccccgtgtctcctgctacgcatacgatcggcccgtgcgagccttagccgtaactaattgggccgtttctcgcgaatcgcgggaagtttgcccagcccaagccttaggcgagacaatccagcccagcgtgaggtctcggcctgctgctttaattggaaaaagtatacctgagaccccttatcttgtcgacgatttatttataaaatcatccatgaaccaaaaaccatatatatgacatcagtcaacttataaaactaaatcactctaagtccataggcggttttgtttgacatgacaactgaatcagtgtggaacccacatgggcccacaggtcagtggctacttccccttctctctcccccagtcatccccttctttggcgatagttgatgggcagaagggctgacgcggcgggcgcgaccgatggccggcggggaagagcacagctggcgaagggtagggagaaccggggacagatcgatctgtgccgccgttgccctcatgtccgatcacaaccaaacggagattgctgtgcaggtgtcactaatggttgtgtttagggaggatgatgtggggaggacatggcgggcatggctcggctattccgaagggaggcgatgctggtacggtgctgtggctagcgttattagtagatgttgagaggtgaggggcaacggtgatatgacgagacgatgaaggtccacgaaggtcgccgggagaaatttttcccgagcttgggatgacgcgagtggtggaacatgtttcatgccgagccgccgggaaagaggaatgggagggtttcctatggggttgatgcgagctcatgctgaaggagacacaaagatatggacgacttgccttcttaccggggagatgatgagaggggcgagaggattcgagagagcgtgagatgggaggaggaagaagagcacagggaagaaaggggaaggtactgacaggagcaggacgtcgtcgcgcgtctccggttcttcccacccgtcgtcggccgtgctcctgcctcaccggccgccgaccatgcccctcatgcctgcccttctccacgtggcccgtgcccaagaaggagagtactagaggagagagagaagagaaagtagttactgacatatggttcccactttgacacagctgttgcgtcggacaaaactatttaaggatttagagtgactcggtttcgtgagttgaacgatgtcatatttctattttttttttcggggacgattttgtaactcggcgataagatgaagggtctcagatatacttttttcgcttaaattttcttcacatatacgactgtaaagtttgttgatccacggcattttctatgtttacacattacgccgtgtcctacaccatggtacggtactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaattaattaagaagcatcatatccatatcactatatcgccactgatcattcagaacaaaggttattgtattgtactaggtagtgtttaattaagaactccactagagtagtaagaagcatgcatttggattgagctaagctactgaaacggtgaccctaacgcatacatacatggtgatctaggcccttctgggcacgagacgagcgcgcagcggcttcgccatgacggttgtgaactcgatcttctcggcgaagtccacctcgtcgccggcgacctccttccactcgaactcgctcaccatgttcgccacgaagtactcgacatgtagcatggcgacgccgagcccggcgcaaatcctccgcccaacgccgaacggcatcatccggatctccctgctgcctgtgacgtcgaccccctcgccgtcgccgccggcgaggaaccgctccggcatgaactccattggcttctcccattctttctcgtcccttcccatctccgccaccatgaagttcaccgtggtgcccttggggatgaggtacccgccgatctccatgtcctccgccgccctgtgagggagcaccatgtgccccggtgggtgcttccggaggccctcgagcaccaccgccttcaggtacggcatgtcgtggatgtcctcctcggagacctcgcgctggccgccgccgccgccgccgccggtcttggccatgatctcgtcgtggagctttgactggatggatgggttcttgaccagctcggccatgatccactgcagcgcggtggacgtcgtgtcggtgccggcgttgaggaactcggagcagaggttgaccatctcgtcgtcggtgagcgggcggttgccgtcgtcggggagcttgatgtcgaggagggtgtcgacgtacgagtgctcgaacgtggtctccttcttcggctcgccgttggcgccgccctgccgtttcttgtactcccgccgcgcgttgatcagcggcacgaacagctccgtctgccgccggcggagggcgtgcgccttctgaaggcgcccgcgcaagaggtgcttggtgaccgccgggaagaaggcgaagacgggcatcttgctcgacaggtagaggagcgcgtcccgctgcgcgacggcgatcgcgcgcaccgcgtcctcgtcgagccgctcgccgaagcacatgagcaccaggaggcagaacatggcgtactggaacgtctccacgacggcgtgtggcgccgccgcgtcgccgttctcgtcccgcagcttctcgacgagcacgcgccgcacccacgcgcgcgccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcagatggataacctggtcatcctcgccggcgtcctcctcctcccgctcctcttcctgctccgcaatgcggcgtcgtcgaggcggcgccgcctcccgcccggcccgccggcggtgccgctgttcggcaacctgctctggctgcggcactcggccgccgacgtcgagcccctcctgctgacgctgttcaagaagtacggccccgtcgtgacgctccggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctccggcgaggaggcgcccaacgtcatggaggcgttccagtacaccatgttctgcctcctcgtgctcatgtgcttcggcgagcgcctcgacgagcccgccgtgcgcgacgtcgaggaggccgagcgcgcgtggctgctctacatctcgaggaggatgagcgtcttcttcttcttcccgtggatcaccaagcacctcttccgcggccgcctcgaggccgcgcacgcgctgcgccggcgccagaaggagctcttcgtgccgctgatcgaggcctcgccgggagtacaagaggctcgccagccagggcctcccgccggcgagggagacgacgttccagcactcgtacgtggacacgctcctcgacgtcaagattcccgaggagggcaaccgcgccctcaccgacgacgagatcgtcacgctctgctccgagttcctcaacgccggcaccgacaccacctccaccgggctacaatggatcatggccgagctggtcaagaacccggccgtgcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgcgtactcgtttttatcgtgctaatttacacgttttatatatgaactcctatcgaatcccaatcaaaataagcagagaggtttggactagagacaagacagcatgacttacgcacaagaaaggaagggtgaaaggttcatcttttatctcctatatactatcagcaattcaaaggaaagagtgtttttttatctcttaccagcaaattcatatcaccaattcgaatatccaaaacaacataggtgcctatgaatttcttttaacaacaatggaagaacaactttgagcctgtgaaaaactttaacttgtttacctcctagaaattgatgcacctaaaaaacttgtttagaaacatcttacaaaactaatgtggcacaatgtgattgaatattccttttctcatacccgctataacatatcagatcactaagagagtaatagatttacactagttggagagtgttagagtatatggtagttaaagtcatattaggataggattggtttgtttggattccttctatatctgtaattcttccttatctcttccctatgtactcctatatatatcgcccccctgaggctcaatacaatgtgtccaatattcacagtatcccctcttcctgtactatccaacatggtatcagagcgggcgatctagtgccgctctcacgcttccgccaccgctgcccccgggagtagcgatctcccgagggcggccacatttttttttctttctctgaggtcgttgtcgccagagggatcgccctcgatctccttcggtggcccccgtcctgttcgtcgtcagatcgatctaaagccatcttcagatcgttcgtgcgtcttcgcgtcatcagcatgcagcagtagcagatcgcatccgcggatcccgtcgacggcgcggctctccacgtcgctgcgccgttggctcccggtcctgcctcctctgttgccgtcctctccgtcgacctctctcctctaccgaggctgctgatgccgggggacaggagccacgtcctcgccgatcatccatgccgtggatctggcggccactccaggccaccgtttcgtccgtcgccccctggtcttctccaacctccgcgccagccgtcgtcgacctcgccgcccttctcaaccccggcgcacagggggagggagtgctcatcactgtcgcttccacacggcaattttctgccggcccctgcagctctgctgctggtctccaccacacaaacctgttgacaggttgttcttctccactgtctctcggtgtctctctctgctatgatcctgtgcgtggcagccatgtgaggagagagagactagatggatggtgtgaagatatacagcctattgccttggttgacttggtggtgacttgcgtcagattcaaagggttgtgatgtgaacggctggtatggactgctgctattgtgttgctgcttgtattttttcccctttcccaatcagtgattgggtttgcgtcgcccaccgcctcgttgacatctgcgcgtctccgacatcggcatcgattctgcttcaacttcatcgttctgcctcgcgcatcttcggcttgatcacccattccagcgcccagctacaacgacttgtacaaccgatcatcatcgagcacgcgtctacgccatcaagcttcgggttgccgctgcgtcgcccccctcgggccacagtgccgctgcctgtggtccacacctccactggttgttacagtgttgagacctgagaggcaccctcctcagtgtggcctcaccaccggtggacttctcgccgctgcatcgacatcgagctgcgttggtcccactacttcgccttcgtcttcgtccagcatgattcatcgccagtgtcgccgtatcttcctcgactatacttcgctcttctccggcaactgcgtgctgctccggcaattctccctctacgccgttctcgcgccgcgaccatcctagaggccttctctgctagtctcctccgacattggcgtataatttctggtggtcccctacctagcccgcacggtattggtaacaccgttgtgcgcgtttgtcccgagtcgtccccgggtctggcaaacctggtgtgacgtcttgtccttcatggttcgactatatcggctcttcgacgtcatcttcctcaacgaccgtcgcgatcgtgtccccgtcatcatctcccgcgcgtcctcgcgcacctcggttcacaacgctctcccatgcgtccacgaccactctacggcgtcctatgtgcgctccgcggctcggctacctcgacatcatcggctccccgacttcggctacatcgaccacggctactctacgcacggcttcagcgaccacggctctcccggctccttcgctttggctacatcgactatggcacaaagggctattatccgtgttgagcactcttgccggtttattctccagtccaagtgtccgcgctgctcacgcttggactgaggggggatgttagagtatatggtagttagagtcatattaggataggattggtttgtttggatttcttccatatctgtaatatttccttatctcttccccatgtactcctatatatatcggccccctgaggctcaatacaatgtgtccaatattcgcagtatcctctctttctatactatccaacagagagtacgtaatagattgaccttaggagagtgacagattaacgatttgcgatgaacaaacttaatctctgaccctctgtatcaaaattcaagcacaagcaaccaacacatattgcaattcagtagtagagatttgattggtttatttgttaacctgtacggaattcgaataaaaaactggtgccaaatttgtcagattttgatgaacacggtctagatttaatcgctctgatttatatttaaacaaggaaaaagtacaccgaaggtccctcagcttgtcatcgagttacaaaatcatcctccaaccgtaaaatcagatatttcacatctcctaactaatcaaaaccggtcacaatcggtccctcggcggttttgatcccggttttattctacgtgactgctgagtcagcacaggacccacgtgggccccacatgtcagcgtggccacgtcagcctatctctctccccgtcttccccttcctcctctctctatctcactcattcttgtctctgtggctctaggcaggggagcaaggcggcagcggcggcgggagcaggggagcaaggcgtcggcggcggcagcggcggcgggagcaagggagcaaggcgtcggcggcctccggtctccccccaccctcttcactctgtccaaggcggcggcgacctccacgccccacttcctcaccgacgcgacgagcacctgcacgatcctcgttagcgggctgcccccggaccgctggtgcctgtacagcggcgtgccgatgaagaagctgacggcgacggccatgacgacggccgggatgccgaacccccacccccacccgacgtgcgtctgcacgtacaccagcaccgacgacgccaccagcgcgccgatgttgatcaaatgttctccatacagtaattattcagtaacctgtatagaaattgatgactactatgtgattacttaactaatagtacctgacagaagaagctcatattattagagtctgaatagatggaagtttggaggcattgcttgtcgctgttattcaaatgtctggttgctgataaataacaggaaaggaagcttagaactgctgtataaatgaagtcagtgtgtggacatcttcagtgtagaattttaaccagagaatcttataaggcttgttctgaaaaaggtgatggatgctgtcctcgacatgtattagaaccagttgaagaagctgctcttgctccgcttctccccctcgtcgttctcgtcgaactggtcgacgccgaacgacgacacacacggcttgatccctcccgttcccagcgcgatcaggtacagcgccaagaacaccacccccgtctgcgcttggtgcggactgcggagcatctcatagcgcgcggcgaggaggcgctccaatgagccgaagcgctctgtgagtcgctggtacaggtgtgtgcaggtcgcgagcagctgctgctactgctccagctctgcgaaaccttccggcgtgtgcaggtcgcgagctactgctgctgctgctgctccaggccagcgagctcgcaccgactccacccccaccgccgccgcgtcgccaagctaccccgccgcccgtcgccggccgccgtttctgcctcgccctgccagccggcccgcacgaggggggcggggaggccggcgagctcgcgccccccgagcccgcgcgccgccacctgggagtagctaagagcccccgggagccgccgtccccggccgcaccaccctccggccccgcgcgccgccatgggtgctagccctagcatcggcatccccatgccgcccgtgcgagagcagagagcgagacggaggaagaaaggagagaaacagagaaagagaaagagcggaaagaaagcaggcgctgacatggacaccctgacatgtgggacccacgtgggtcccacgctaactcagccgccacgtcggataaagccagagtcaaaaccacttaaggaactcaagtgaacggttttgtaagtttagggatgtcatatacctggttttgcggttaggggatgattttgtaactctatgacaagttgagggaccttaggtgtactttttcctttaaacaaaatgaatagagagtaagcccaacagcaaaaaacatgttagcccaaaaccaacgaactgcatcttaggcccatttaaccagtcgaacatgttatctcaggcccgtttagcccacaaaattgcaatatgaatactagcagtctagcacaactagctttggctgcgttcgtttctccaataacaatagttggatgaaattttggatactgatggtacacttttcaaactactaaacggtgcgttttgtgtgaaaacaattgctctaaaatatcagattaatccattgtcaagtttataataattacacgttattaccacctcgttttacgtgaaacacttaatatttatcctcatcttcattttcaggatatccagagaggaacacacgcttgaaaaatctgtcacgtgctagttaattagcaaaaccgaataaggtacttataaaaactaaagtgtcattccttcttactaacatatatctttagggagagctcccaccttttcgcctcaaaagggaaaataaatatgtgcgcctaagttgatcctgatgcccttaaatccaaagttcaaacatgtggggtggcttcttaagaaagaaaagaaacctaaatacttggatgtaatcataaagattcccaccgaatcttcaccgatcaattgagattaattagaaatgacgatagccgtttaagcggagaaggacggcttacattattgctggttaccattcaaaacagaaagaaaacagtggcaccagattctgcggttttctacagagcttttttcttaaaaaaaactagacacaatatatacacaaactattctaacacacgcacactcacccttataaatgtacacacgcacaccttatccttatcagcatctccagaagattaggctgtcatattttaatattgacgaagccactgcgggcgtctcgttgtcgagggatacgtcttacacatgcacacattattcttatgaacatctctggaagactaggttgtcatatcttgatgtcgatgaagtcactacgggtgcctcgttgttgagggatacgtcgtgtaccattaaaaaaaacaattagccgtaaatatgagcacatgtgtcaagcctagaatttaaacccagatggactggtttcaccataagaaacttaaccaattaagttacgctcacttcacggagccctttgtcactctcctagttgacaaataagttttcaatgactggtccatacaggaatatgttcttccattatttaattttagttgctaaacatgttttcacatactataagttgttcgtccattatccatttttctaataggcaccttgttttgcatctttgaaagcattttgaatggctgataggagataaaaaaatgacccctttttttcttcgattgtgtttttgcccttctttctgtccaagactactataggataccaattcactacgtgcagctgtcatatgtttttgataaatctaggttacctattaatttagagtaatttagaaattatacactaagttttataagtatgtgatatatttttgttggttttttttaattttgggaaggtaatatgctttgataaatatgggtctcctattaatatgagagtaatataaattttcgacatgacctgcaccaaacagtaatgtaattagagattatacatggttcttttgaaagtaagtgacatatgtatatgaatttaatttattatttggtggtggtgatatgacgataaattcttggcacctattaattttgatttaatcttgtagttatggcatatgtttaagttaatcattttgtatgcagcgagaattgcaatggatcgacgataaatgtaccatgcgtcttgttcaggcctcctttgaattggaggaaaaatataggaaaaagaaaggaattgaaatcctacactatttatgcctttgattcataggaatgagaaaaggaaaaacgtaggaaactttcgtattcctacgattctagaggaaaaacatagaaaatttaagacaaaattggttatatagcatcgaaagttcacctttttttagctccaacagataacggttcactttaatagcatctaaagttcacccctttccatttttaacactttcgtcaattctcgatcgttttctatccgccttgatcgttattgactcagccactcacacgatatgacctttttacccctcattgccatgcattatacatgtacttgtgaggggtagaaacgtcatattgcgtgtgtggttatgtcaatagcgatcaaagcggatagaaaacgatcgagaattgacggaagtgttaaaaatgggaacgatgcgaactttgggtgctattatagtgagctggtatctttcggtgttataaaaccaaaaacgtgaacttttgatgctatatatctaattttgtcaaaatttaacatccactctaacctcttggaaaactttccttgagtctatctctttcatctgattcctgcagtccaatcaaacggtcatttctgtgtttacaattctctgttttacacttgcgttgaatacatttttgtttgtcaaagtttcagaaaaacaactgtaccatatattaaaaacagagatatcagaaatttgcacaaacaaatcacacttcaatgttccctattgatttactgattcatcaaaccaaatgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcggccatgatccattgtagcccggtggaggtggtgtcggtgccggcgttgaggaactcggagcagagcgtgacgatctcgccgtcggtgagcgagcggttgccctcctcggggatcttgacgtcgaggagcgtgtccacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcatcctcctcgagatgtagagcagccacgcgcgctcggcctcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcggagcagccgccacatggcgccgtagttggagcgcgtgatgattctcgctgacgccgaggagcatgctggtggccgtccgcggccggtcggccagcgtggcgccggcgccgacgagcgccgcgtgcgccaggtgccgatccgccacgaagatggagaggcgccacccgatccggagcgtcacgacggggccgtacttgtcgaacagcttcagcagcagaggctccaattcggccgccgagtgccgcagccacagcaggttgccgaacagcggcacggccggcgggccaggcgggaggcggcggcgccgcctcgaggtgacatcgcgcaggaagacgaggagcgggaggagaaggacgccggtgaggatggccaaattatccatcagcgttggcagctgttttcgcttgcgttggttgtcggacgaggctaaactgttgtgtacccatacattttataggtcttcggctcaagtcagtagcagtagactcagtactatgggatgtaatatgttaatcttattcttttaataaaactagctgggtggcccgcgcaattgcgcggctagcatccaaataaaatcatatattttttaatatgattttacttaaaatttattaaatagctatctcattgtcttaagactttgaaagaccaaaccttatcatcctcgtgtttctaattatatagtttttaaaagtcacatcagttgctaccccttatgtcatcttcttctttatttgtttgctcgatctaccactatttctatttattcttcttggaacctttaaaaattgaattttatagtttttagagtttattgtcacattgggtttcgtttttataatttgtagatgtctcgtcaaacgttgtcattatactcctctaccgcccgtccactgtttcttctttttattgtcattgaaattttaaaaatcaaagataattatcatttgggtttatttttactttctagaagtcccgccaaaccgtcagcggctttgccattgtactcctctacagctcacccgcagcctccgttctttattgtcattgagattttaaaatagaacatgattatcattgtttcttttttactttttggaagttccgaaccttaaaaaattagacttgtagttttattatttttataatttttagaagtcccatcaaacgatgccactatgcccctttacagcccgtccgccgcctactctttattgtcgttgtgattctaaaaatcaaacataactatcgttggaattcattttttattttctagaagtcccgtcaatcgtcggcggctcagcaactatactcttatacaccccgcccgctgcttctcctttttattgtcattaacattttaaaaatcgaatatgattatcaatggggtttattttttatactttctagaagtcccggcaaccgccttacttgtttgcttcacggcctgtctgatgtccctccttttaatcgtcattaggattatatttggtgttttattaataatttttatatgtcgtatcaaccgccaccactctactcctttctaggctgttacttaatttatctcgtcatgtgttgtagatggtcttttctttcaatagtctttatttttatcacaaattttagttatttataaattgtatttctaattgaaatcttatttttctttttctaatttcagaatttattttttttaaaaaaaatagttaataccgtattgtgttcctttaatgtttttatttttattttcaatttcagttgtttgaaaattgtattcctacttaaattctcttttaatttttctaattttggatattattttatttttttaattcgaaattttaattattcttgtattgggttcttatatggattcttctttcaatattgcttattttttattccgaattttatctaattttcaattgtattcctactttaactcttcttttattttcttttgctaactttggatttattttattttaattcgaattttaattaatctcatattgggttcttatatggactcttctctttaatattccttatttttaattccgaatttcaggtatttttaaattatattcctacgtggactctcctttccttttctaattttggattttattttatttttattccgaattttaattaatttcgtattgggttcttatatggactcttctctttaatattccttatttttaatttcgaatttcagctatttttaaattgtattcctacttggactctcctttccttttctaattttggattttattttaattgtattcctacttgaactctcttttattttttctaattttggttattattttattttttattctaaattttaattaatctcgtattgggttcttatatggattcttcttttaatattgcttatttttaattcctaattccagctaattttaaattatattcctacttgaactcttcttttattttcttttgctaattttggatttatttttatttttattccgaattttaattaatctcgttctggattattatatggactcttcttttaatattccttatttttaatttcgaatttcagctatttttaaattgtattcctacttggactctcctttccttttctaattttggattttattttatttttatttcgaattttgattaatctcgtattgggttcttatatgaaaatttctttcaatattgcttatttttaatttcgaatttcagcttttttttagattgtattcctacttggactcatctttcctttttctaattttggattttattttatttttatttcgaattttaattaatctcgtgttgggttcttatatagaaacttatttcaatattacttatttttaattccgaatttcagctctttttagattgtattcctacttggactctccttttctttttttttctttttctccgattaatgtgggaatttctagcctccacagcgaacgtggtgtcttcttttcgagctgtcttaataatataatagattttagaacatgttctgtacatacggttttgctaactagcatatgatgcatgttttaagcagccttcctgtttagtttttctttttgactgtcagaacttaggtttacattcgtgctgtggctggaattttatttagaattgatctcaacaccttgggctcgttcttttccacaactaaagactgcaacttagttctttttcattagcatgcttctcgaaccgttaaacgatgtgtattgtaaaaatattaccgtttgaggctaatccatttttctctgtgtcaggttgtgttagctatccaagcgaattggtgtttcaagcgcatagcaatgggagatagaagattgagcttatatggaatagcaattgtgttcgcacatctgaaaaaggggggatgtagcctagtggttgcagtgacctgagtaacaccctaaggttctgagttaaaatcttcatatgagcgaatttcaaattgagttatttgcagtgctaagttctcaatttaaattgttgcatatatccatttggatgtagatgctggataaaaaaaactattctctaacaaaagttgtgttcgccgaatccactttctgctgaacactcatggatgtaaatgtgttatcacacgtgggattaagaccttgtccagcaccacatggcgggcagccctaatgggctatcgatcgcccgccaatgggggt

SEQ ID NO: 37757 - DNA, 1726 bp, Oryza sativa
  unsure (1)..(1726): unsure at all n locations
ccgcccattagcatttccgccacatggcatctcagtgtcgccaccgtcgatgagggagatgggcatacatgcatggtatatcggtttgcactttttatttcagcgaaaatttctgtagcaccaaaatacgaaatttcatgatttttggcattttagaccaaaattatttgaaatttcgactgaatttgaatagactttgatcaaacttaacaaaaaaaatttgacatattttaaaattccggtcgatataatgacttgtcggtggggttcgaaatttcagaattttccgaaattttgaaccaaaatcgctatcactagtcatgcgagcacgaagaattagggaacaattcaatatgaattcgggttaaacccatttatgcccaaaaataccagtccaatccaaacccttttttcttttttttttttgcctcagtccaaaccgctccggtccgttagctcactcaacccatctccacccaaataaagcccacccgtagtgaaaagggtaaaatccagaagaacaccacgcacaagcacaaccttgaaaatctgaagagcacacgaagccctaattaaccaaaacctccgccgtagccgccatggccgccgcggtcgccgccttcccggcgcaatcccgcaagacggagacctacaccgacaccaagcgccgcgacgacgtccgcggactcaacattgccgcggggcgcgccgttgacgccgccgcgcgcacctccctcggcccacgcggcatggacaagatgatctcctccagctcctccggcggcgaccaggccgtcatcatcaccaacgacggcgccaccatcctctcccgcatgcccctcctccagccggccgcccgcatgctcgccgacctctcccgctcccaggacgccgccgccggggacggcaccaccaccgtcgtcgtcctcgccgggtccctcctccgccgcgcccagtccctcctctccgccggcgcccaccccaccgcggccgccgacgccctccacctcctcgccgcgcgcgccgtggaggtcctccacggcatggccatccccgtcgagctctccgaccgcgacgccctcgtcaagtcggcatccaccgccctcaactccaaggtcgtctcccagtactccaccctcctctccccgctcgccgtcgacgccgccctcgccgtcgtcgacccggcccacccgtatctcctcgacctccgcgacatccgcgtggtgaagaagctcggctgcacggtcgacgacaccgagctcatccgcggcctcgtcctcaacaagaaggccagccatgtcgccggagggccaactcggatcggggacgccaagatcgccgtgatccagttccaggtctcgcctcccaagacggacatcgagcacagcgtcgtcgtgtcggattacgcgcagatggatcgaatcctccgcgaggagcggaattacatccttggcatggtgaagaagatcaaggcatccggatgcaacgtcctgctcatccagaaaagcatcctgcgtgattcagtcaccgatctgtcgctccattatctcgcaaaggccaagatcatggtcgtgaaggatgtcgagagggacgagatcgagttcatcaccaagaccctcaactgcatgccaattgctagcatcgaacatctccgcgaggannnnnnnnnnnnnnnnnnnnnnnnnnnnnnnnnnnnnnnnnnnnnnnnnnnnnnnnnnnnnnnnnn

SEQ ID NO: 37758 - DNA, 1597 bp, Oryza sativa
ggctcatgccccagcacgtgcagcctcgccaggaagatcgccgacgccgccaccacggacggcaggtagcggtggaacccgtacgtcagcagcgacccgtcggtgaaccgatgcgccgcctccttcaacagctcctcttcttttccgtcgccgtagtaccttgtgaagtgctgcacgaacgtggacgccgtcgggccgctgaggttgtagtcgagcgcggcgaggatctcggtctccatgcacgacaccatcttgtgcctggtctcgctagtgtagccgcagcgagcggcgaccatgctggcgtcgatcttcctcagggtgtactggtcctcgtacttggccgccaggaacacggtcgttgctgcgacgaggcggagctgtagcggtccaggaagtaggcggcgcgctggagcgtgccgtcggcgagctcgtgcaaccggctgaactcgtccatgaaggcgatcatcgaggcgcgcaccagtgcggtcatccgcccaccttgtgtcgtctccaagaagtacggggagggccgctccacggggttcgtctccatggcacggagggtggcctcgatgtcgtcgtcgtagggcgcgcacagctgcggacgtgtcgtcgtcgctgagttgctggtgaccaccggctgatcggcgcgctcttgcagcagcgatgcgacctcgatcgtcttcttgggtgacaccgggtgatcgctgccttctggcagcggcaagggctcctggaggacggcgccagagagcggggaagatcaccgtagacagggaggaggctgccgtaggtgtgaggggtacggggcgagtccggtggcgccggtgcgagcggagctgccggtggcggtgcaagcggaggcagtgcgccgatggcgcggaggaaggtgtcggtatccaccatctgcggagtggcgccgccggagtaaggatggaacactgggagagctgtttgatcagcaagaagttcggcgaggcagggatgatccatgatcgcgtcctccatgtagggatccaagatcaaatcccccatggtcgccggagcccggaagcgagatcgagggagagcgagaggagtcaagaggcggtggcgggaagaaacttggacggtcgcgtggtggtggccgaggaaggatggtgccgcactctcgccttttatcctcgtgccacgatccgactctgatcaggctgcgcacgcgtgaaggaatccatcaaattcaaagttcgcgcggttttccgaatcaggatcgaactaatgatgtttgattagagaggactaagcgcgtgcgtttctttcctttgtttgcatctccgactcgatctctgtcatgatgaaattcaccgatcatacgatactattatacatacactgacacacacacgcgaaaaaaaaagagcacatcatcacgctaaagaagtccaagcactcaaattcttaaaatccactagaatggtagattaagcatggaagatgacataccatactattatggattcatgcacattgctagagaagttaccttacagtgagcatatgctaacactctatcaaaatcttcaggatttctaagcagctgagcagaacaaaaacatgg

SEQ ID NO: 37759 - DNA, 1307 bp, Oryza sativa
agcattctgaagaaggatatgggccaggggagccggccacagttggaccgaacccccagctggcccaatccagcccaacttcggcatgatagttgtacttctcatcctatgacggttgtggccgttaataccggtggaaaccgtcatcaaaagagacacttggcaagagaaggatgaatatgctatttggattctatggagaatattccttagcatctccactctctcaagtcacctccacactataaatatccctctcctctccctcattcacacacactccaagcttgagctgaattataagaggctctattgtactactttgtatactagaattagaaagagagtagagtagaagaacttggaggaattccggagttctcggtaatcctctcctatttcttttattctgttaattactctattttcaatagaaatatcttcctgagtaatttagatttacttgcaagaattatctattggttagttcctaatcagcatacgagattattgttcactataatcaactaaattataataattgctttagtgagttataaacactagagtagatattaattgcttacatatggtgtttaggtaatttatatctagtaattgttgtgtatcccacaatgcgtaggtggtaacagccctcaagagcacttaagtccttcctgttcgggtacgtagtagagcgacatttgggaacaacgggttgccagtgcctgaagtattgcgctaggattaaaattaagctttccttggacactgtttctcactagaaaatcgtctctattattggctaactttagctttgtgtccttagatgaacatgataagaaagtaatacacattccttgtggaaatcgataactaaaaatactcccgggtgaagtgccacatcggtatcttccatgcgcttgcgaattttatttgaaacgttaagaaataccaacagttttcaccttcaaaaaccgcatgaccaactatgaagattctgctgaagggttttatatctttacagaaactactttcaccatatgataaaggatcactctacgcatgtccaagaggtaaaactgtggtgtttttttgtgcacaaacagatggaacacatgttgggcacaattctcttggggctcatagttcaattgatgatggagctacccaaatagtcagttctgggtagcatattttgatgaaggaatgaagctgataaacaatggttcaattgagtaattgccaccacgctcggattttgcgtactaccttttgtcaacttaactctgtagaaagaatgattg

SEQ ID NO: 37760 - DNA, 1281 bp, Oryza sativa
tgttcaaaattttcaaatataccatgtttgttcatcgctacaattttttccaaacttgcttacagccacagttatcaggtaatgctattaaggcaaggatttgatgaaattaacaataagatagatgtgggcatcaaaagaagggcctccaaatggatgttggcaccttctttaatcaactgtgtatcaaacccgtctggattcatagacttgagtatgactacgtcatcatgatgcctgccgagtaggattgaggacatcagaccacattatgggtactcaacaggccaatactaacataaccagtcatctgttcagccttatcatctgcagatattggaattggtgcccctgcatcaggaagttacagttagatgcatgcccaaacatgatctaacagctgtaacaatggctgaagaaaactgaatggataactacattatattcatccttcgatgcaaacagaaactatttcattggtctccagtcactaattcagtaacagttgcagtggacatggttgacataataaaatcttgatagtgttaagcaagacaaaaaggacaccacattattcagtactcatgagccactaagttttaggctagattaagaatgatgtagtaacatgtatagcacatccaagcgactttacatttcctacaaggggggatttactgaaagatagtgttgctaagctaacaaagaatatatatctttttccattagattttcttatggagtggctcactgatgttcagattccaaagccctaaaaaattagataaaacctagcactaattccagattctacgcatgaagtatctaaagtggatagaccgaaatagcaaaatgccacatcatttggaattattccattgtgaaaatgatagatccacaatcccacaaggctgaaaaaagcctttgcaatcacacgttctaaaagaagtagaagattcaagtacatgaaagatagcatacaagtagaactaataattcagtgcaaaaggttgtctagcagaaaattacacatgtaaattaacaaaaaaaaaactcccttttactcataattgtctaactttggcaggcccttactaatataactgtggtggcctcaggttccgttgtgccaactttaggtggcaatccaaacatgcccttactctatcaaatcaaataaatgagcatgtacaccaagtatgtataccaagcacgaagggagatattatctttgagatcacaggcaagagaacgctccctttgagattgaagccttttatt

SEQ ID NO: 37761 - DNA, 1297 bp, Oryza sativa
cttgatggtgtcgtgatgaggaaaaggaacacattgacaggaagcgaaggacctcgccagaacttatggaggaagtggaggaccatgatagagcttgagaaggaagaggaacacattgatgatgagcttgtccatgcaagaaacaactatgacatatagctattgctgggaaagaaggggtcatggtaggctgagggtcaaggatggatgtttttcttatggtgaatcacaccttattttcatcactatacacgcacacatttgcagtactagttacggtcacttgacatagtgctacattatttctgtcctcaacaataaacaatgcacattttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttttctcatgcagttcaggaaggaaaccacaaaagcggcatagacgttccccttgcgagccatatactatgcatgcgaaagattttattattttttaaagatttcataaaaccccatatttattgtcaaatttgtgcaaaaccgctgatattttgtcttgtgtctcataaccatatattttatggtctaaatgtttcataaaacaccatctttatttaaatttcagttgaattcaatatatctaaaacaatatattttaaaatggtaaatagttaaaccgacaacctcaatcaagcaatcaacaactaaatgtttcatatacacgttatatattttatgtttaaaatttttagtaaatacttgacaacaactccctccgaaaaaaaaggagataaactctaactatctgatacagcagctagagtttactttttttttctttaagaacggatggagtatatatatatatatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaac

SEQ ID NO: 37762 - DNA, 1390 bp, Oryza sativa
gtactaatgatttgctttgtatctgcagcccatcctagtgttcatgtcaaaggttgatgggaagtttcagttcagtcccatcagcgttaactttttgacggaggttacaaaagttgtctttgctatcgtgatgctaataatccaggtgtgtacttttgctgatgtttcttggtgtgcttgcattctgatgatgagtaatttaacccctataaaatgatatgtagagtacacttatagtttgtcttgatggctttggattggtaaaatactctgttagttcattagatcacttgtactcttacatgagcagcctactgaattcttctggtacaattcttctgcgtccaatttcttatagtacattcgtgtatcagaagtgattgcacatttaaaaaaaatggaaggagcagcaaatttgtgctaatcttccaaattgataagctcaactaatgcagaactaaagatcacaacaacagcctttcaagatgtgaaagcagtttcggttgatattctatgtgctacctgcacttcattatctttatgcgcaatttagcttgtcagcatgttcactgttccttgaaaatttgaagtcctacagattcgcaattgctatgctgcaacagatgtacattttatgccttctatatactttccattatgatcctacctcttacttgtttaccttctcgatgctgctttctgtgtggcagtctagaaagcaaaaggttggcgaaaaaccacttctggcacgttcaaccttcatccaggtgatttgttttctgctttcatgacttatatgaaccaccagtagaacttttttacatactcatttttaaataccttttttctttaccaataatttgtttccgctacctatgttctaacataatactgcttgttgcatgtctttttgtgacattgtctgatcatctgactctccatcattttcatatgtaggcagcccgtaataatgcactactagcggttccggcccttctgtatgccatcaacaattacctaaaatttatcatgcaggtgaatctgaagccatagttgtcgcccttctatatacccctctattgtcatcatccatgaatatatatttttatgttgtctgacatttttgagctgattatgcagctgtacttcaatccgtcaactgtgaaaatgctaagcaacctaaaggtacatattttatgcactactcaagtgttgtgcttttcttattagtgtgtatacgcatatatcataccttttgtaatccaaatttctctaggtgctggtcattgctgttcttctgaaatttataatgaaaaggagattctccgtaattcaggtaagcttgaggttgtgttgcagttatttctgactttatatatataggttgcat

SEQ ID NO: 37763 - DNA, 1038 bp, Oryza sativa
cgtacacgttcgtggagcacttcacgaggtactacggcgacggagaagaagagaagcagttgaaggaggcggcgcatcgggtcgccgacgggacgctgctgacgtacgggttccaccgctacctgccgtccatggtggcggcgtcgtcgatcttcctggcgaggctgcacgagctggggcatgagccgtggagcaatgatctcgcggagctgacaggttacaaggccatcgacttgatggggtgcgtgtgcgacatatacagtcaaattgcatgtcctcgctttgctcttttgcaagagtacttcttcgaggatccatagcccatgtataggaagaacaaaagagtctgtaaaagcacaagcatgcaaggcatgaatatgatggcttaaattttgcactgttgcctgtacattgatctgtaaactcaaaattgtgcgtgttatttggttgaaatatatgtgattcatcaattcaaatttataattactagcttttagtactctgatctctctacaattatggcccaaccgtggattcgtggagcacttcacccggtataacagccggggagaggaagagctacgggtgcagcggctggagcgcgacatcgccgaccagtcactgatgaactacggctgcccgcgggctacctgccgtccatggaggcggcggccggcggcgtcgatcttcatcgcgaggtgttcgctgaaccggcccgaccggtctggactctggagcacggagctgcaggagctgacgggtacagctccgaggacctcgttaactgcatcgatcctcgccatgtagaacgtagtgatcgatgaggacaccggtaggagcagagatctcttgtaaacatgttctgttgattgttcatggttgccatgcaatgcaacttgattgaggttttttttggccccctcagcaagatcctaactagagagtctttgtaaatatggcaaggaggttgtcttcatttttttttctcgaacacgtaaaagactttatgttcataaaaccggtccgagatcattatcg

SEQ ID NO: 37764 - DNA, 1343 bp, Oryza sativa
atcgtcttcttgctctgcggctgcaggtggtgatgataaggcgagaggaggaggcttgcgcgccgccgccggcaggggagagacgccgccgcagatgtccatgtactcatcggcgacctcgccgtcctcgagtccgcggggcgacgtgcggcgaacggcggcctcgtcgtcgagcatcttcctcagctcgaacagcgcggcgtcttccgtggagccgagatcgatctccagctcgtcgtcgtcgccgtcaacgccgggaaccgcgcgccagctgcaccggcgccgcatgaagtcggcgacgtgcgacgggaggatccccgccggcagcgacgacaggaggccgaccagctgctccttctgggccatggtcatggcctccttgtccttgacgcggcgagggagcgggcggcgcgccgccgcccccgccgccgccttgcgcaccagcgcctccccttcttgaggaggcctcgcaccgcctccatctccgaccggcaccgcttcctgaggagggaaccggagccgccgtggccgcgcggggaggagcggccgatgatctcctccatcgccggggacggtggtggtgacgaagatctcgagagttctcgctcgctctcgcctggtggtggctgagcaagatgcccaagaacgtgtggccggaatgcaggatcgagacaggacaaaagggcgcgcgcgccgatcgttcccgcctttttatggccgatgggctgataccgtctcggagtaagattcgaatcggactctcccaaaaatccgagtaggattggttcggattcggactggacaccaagcctcgcgcgcttgcgtaggatcacaagctagatggcaatgcgagttggcgagttgaagcaaatggatagagtacaaaatgcagaggttgcgttaggagaaatatgcaccatcgctcacaatcttaggcctatgaacaatatccacagtattgagtgtgatcagcgccatgtgcccgggggaatggtccgggcaaccaaggacgagaaaatttcagatgtgacaactgatgaatagcaagcaccacagataagtttattgagcataaattagacggagaagtcctcgcttctatgcaaatgcttgttggatctccattatatgcaatctttatccagctctccaggcagaacaggcacaaaagacagaccatgcaatggtgaagagatggctcaaggccattcatagctaccatggtaagtctagaaccgactagtttcaatatgtaacaccagtgtgatagtacaaaagttccatataacaacagtaactcattgatacatttgcagtatacatatccagggaaaaaattgctt

SEQ ID NO: 37765 - DNA, 734 bp, Oryza sativa
gtctatctatccaagtatccaagttggtagtaatagaaaatgtcttatccgattttaagttcttatattttagaacgaaaggactacaaccggttcaacatattgacgttgttaattaaagggataaggagttgtaagggattattattcgatctcgatctctccctccccgaaggaactcgatcatccacagccacaaacgctgaaacttactgaaagcaacttggcggccggcagggttgatgtcttgatgatgtgattagaggggctttttggcaggaaaagagggggcttttttcgtggtcacgagcgtgctttatatcttaacaagttgctgcttagagaacagatgcgtgatagctagccaagcaatggtccactgggaatttgtactagtgtacatgtacagttgcatgcagtaatactacagcgttgagttgcatacagtaatactacagcgttggagattagaaggatcgtgtccacaacctaacaatagcaactgtggtttgaggaacagatcactaacagtatcccatgtcggcaaagaatgcagaatagctgacaaactgatatactatacgcttacacaaaaataacaagacgaaaaagaaacaacctcataattttttcagcggaggcttaaaaaagccagaaacttgatcatttatcacgacagggacaccgccaatctgaccgataatccttgcaataatgacccagcaccaacctaa

SEQ ID NO: 37766 - DNA, 732 bp, Oryza sativa
cagtcaaagcatcgtgtgcataggataaatttcttactagaattattttcttcagaagttttgtattagaagcataaaaagagaaacaaacttgcagtagcatatgagcattgacaaggttcatttacaattataatttcaaactgctattactatagacaaaatgattgcaacaacaaatgcactagaatgtaagcaactaaagaaaatatacgctccttcttacaaagttctacaagcataatatgcggaaaaattttatgacacaaccagaaaacatgcacatactaaaagctctcaaatcagattgtaatattaagcatgggagttcaagaatcataattctaagaagcaaagttgcagtaaaacgaaccacgtggccttagacatattcttctggtagtgctggtagagcgcggtggcggtgtcgacatgccaaacggtgacattcttctcctgcggcgaggacgacttctggaggtctgcaggaacgtccccgcgggcgacagcgcggcggcgaggaggcccgggagctcgaacgacctgacgacggagagcgtccggcagtcgtagaccgtggccgaggccgaggccaccgtggcgaggaggcgggacccgtcgctcgagaagtaggtggcgctgcacgccgtcttcgggagcctcaccggcggggcggagcccgtcgggtaaggcgggcccgaccacacgctgaatccatccggctcgcgcact

SEQ ID NO: 37767 - DNA, 609 bp, Oryza sativa
aaaatagatccagcatttagcgatggcccgcgaaaatgggcttttggcatcgtggtccacgaaattcagctcaaaaccaaaccttaaatcccccacactccctagtccccctactcgtgcgaggctcctctttagtctcaactccagaattgtgctctcccggtgatggtggctcctacccccagcagtggtgactggcggtggcagcggcggctcctactctcttgcccccaagcggcggcggcggcagctgctccaacgtagtcttgccccaagtggtgatggcggcaactccaacgtagtcttgccccaagtggtgatggcggcagctccagtggtcctgcccccaagtggctgcagtggcttctacggtccagcccccaagcggcgacggtggcggctcctacggcacctcgagcagcaacatgtgcaatcaaatagtgagtcacatgtcaaattttagcccaaattctataagtttttttatttttcccctaatattttttaaaactgctaaataccttagttgtagctataacccgctatagccgctcttagctgttggagagcacaaccgttaagaggcttagccggagatttagaacattg

SEQ ID NO: 37768 - DNA, 726 bp, Oryza sativa
ctagattcattagtatcaatattaatgtgaaaaatactagaatgaattacattgtgaaacggaggaagtacgtatttttttttagaaaaaagaaaaacttattaacacgttttagtagtagtaactttatgctattgctatatagggtcgacctttaaatttggcacctatttcttcttggcaggaattcaccggcaaaagctagccgaagttaacgcgacaaccgacaactagcagataacttggggttgttgtttggttggggccgtatgttgaggagcaggagattcctgctcacgaaatgcttgttgcactttcaaagttgacattagacatgcatgtagataagctgccataatagcacaaattaacagtaggaaagcaaagttaaccggccggtgaacgcaagttcaaataaaatagccttggctcagtgttcatttcgagcgcgaccggcgctctattctgaattcgagttgggccatttcgacattccctcttccatggcccatttgaatgcgctgaattttctgggctcgagttattgggccaattttttttttttttttacaaattctttcctctgataataactctagttctagctcgattgaacatgatagtgaattactccctccgtcccaaaatataagagattttaagtgaatgtgacatatcttaatacaatggtaaggaaacacatcagcttttacaatactacaacat

SEQ ID NO: 37769 - DNA, 24318 bp, Oryza sativa
ttcctgcagccccatccttataaacatgtgccaaactgcgcggtaggttggaagtacagatatagtgacagctgacagacagagacaaaacaaagttagaacatctaaaataaagtgcagacacacctttcattagagatttagagtattgaacttcttttcccgatctgtcagccaccatcacattctgctgattcagataacaccgtttttcagttaacaaaccgtcatgtaatcttgaattaacaaaaaatgataaccttggtaatacctaatggacacaaatagatggcaacacatttatgatgtgggtgttaacaataatatataatttttcagtctgaacaatgtcttagtggacaaaactgaaatgaagcaagaagtggagaagtaagagcaagaagtggaggaatgtaatgcctgactacataagtttaagtggcctatcacaagcattaaataaattacactttcatgtaaaaccatatgtttagttgtttaaaattgtgaaacagcttcatagttagtttcataatgggccataactttgatccaaattaagacacaaccaagaacacatatagtgaaatcagaaaaggacagtccgatttggttgcagtacctctccgccaattttgctagccgagataatggacatgaaggtgctacagctccatcattccttcttttatataaaagcagtacaaatgaggcatgccacaaatcatcttttattaacatttctgaggattatacagaaataaaattcatagacaatttttagataagtaaataattgtcattatcgaaagcatcaatatatgggatatggaagtatgcatggcattgcgtgcgtaacaatcacatatttatgcagacattttgatagaataaaacataactttctttttttttaggaatacataactttcattcttcaggggcaagcaaataggcagggtccctcaatcaggaaataaataaataaataaactctaactgtgaattgggggaaaagaatcacaagcttttctaacaataaaaaaaactcttaactgtgaattgggggaaagaatcacaagcttttctaacatcagcttctaatttgtattccaaatcacaaaaatgaagggaagtatctgtcctagaagaaaagcaagaataaaacaactaaccctaaccacccccaaaccctaggtaaatgcaagaataacaaaaggtatatggtttatgtttgcaacttcaccctctcttcttccctccatgttggtatcctcggtgaacctttgaaaataaaacctgcaaaggtgaaaaccaaccaatcaattttagccaaaaaaaagaaagaaaaaaacaggaaggagtagagcaaggcgccgacaccgttttatcttttcaatctctttagtttttcacttttttgttgtcacggagatgccaacactgtcttctccttccattgccaatagagccacaacacaacaatcattgaagccattccaagaatgggcagatacagagccaagtttcagtttcactccacaaaaaacagacaatatacatgtgaatcaagatataccgtggatgagtcgacgtgtggggatggcggatctgtgggtacaggctagggacaccctccatttggaaccggccctcactctcatcgcatgttcttcttccctgcggaggcgatggacaacacaaaatagatgaggataaacaaagacgacgacctgaaggagagaggggactgacctgaggtgacgaccagcaagcggccaaaagctccactggatttgtaccgccttctaggtttggagcctgcgacaaaagcgaggttgagcgaagaacggatcggtgacaaggggcgagctcgagagctggcaacgtacggctctcctcttctcgctacagcacccgccttccttgacgtcggttctggcaacggagggcagagcagcggccgttggcgaaggcagcgaaggacgcagcggcggcgctcggtgatggcggcagtagtggaggacggtgctacggcagtgctcggcaacagcagcagcagcggagcgaggcggaggcggcagcgacggcgctcggcgacggcgacagcggtggcggaggcagagacggctgcactcggtgacggtaacagcgcgaggggggaggcggaggcgcccaaagacggcgacgtgatggcggcggcggaggaggtggaggcggcgcgagggggagaggcggaggtggccggcgacggggacggctggaagcggaggtggcagcgcgatgggtcggcggcgacagcgctcggcagcggcggcgggggtcgaggcggtggcacgagggggagccgagacggtggcgcgggggggagccgagacggtggcgcgaggtggcagcgcgggagagggagcgggcagagggagagggagcgggcggcggcgggcatggtagaggttaggcaccggcggagggggaagcacaggcagggtggaggtcaggcggtggcgaagaagcgcgggtgggtggagagcaagcgccggcggagaggcgcagacgccggcgaagaggagcgaacggggtggagtgcgcggccgacggtttgttcaggagaaggattaggagtcgacgacggggtgcaagcgctaatccatgtgttaatccaactcacgatgtggatcgttggatgagaggatccaacggttaagaaacttctagctatacattttttggtggatgaaggaaaaaagcaatcaagcaaatagttatatgcctcatccatacattattcaatcacccaaaattctagcatcattgcacaaaacaacaagcttatgcaattttgtagatttagctagtcggctaggtactcttccaatgattatacctaatggatgcattactaattgacccagaagacaaatgttcagacgctgatgcaagtaaggtaaataacatttctctaactcaagtcataacttcatttaagccaatgtaacatataagcaattgaagcatatcacatattttcaatcaaaaacaattataggaattcagcaatttgctacctcttcacttaggaaggaaaacattacttgctcatttaaaagcagaatagctattcaaaaggcatcacagcaaaagcaaaagcttaacccaccatttgattgcattcttcaacaactattgtcaacaattgtgttagcttatatagattgattattgcttttgctatacagatatattaggctaaaaaatgtactaataaccactaattagaaaaaaaatgttggtacttgttattggtatgaaaaattataggttagggattacattttttcacattgtataagcatggaaaggaataaaaaaaataatgatgctttgctttttttcagcagaagaagatagtctgacaaatatcttaaacaaaattatgttaacggtaaagggaaaagtgtgaatcattgacaactttcttaatagaccaggcattgtaaagcaaacaataagatgcaagtaggtgaatacgggatcccaagattaaatgtcctttcaaaagaatttacatgggttaagtggcagaataattcatttcttaccattgaacccagtgaaatggacaggctagcaagacaaagaaggaatatagcttctgagaagtaattgaatggaaataagcatcacagacaatagagaagttttattgactattgtaacatcctgaaaattcccaacaataaaaatcactaaaatttcgaactttttaaaacttttgcatcatgctggttgttatgattgctattgcttgccaaaccgtaaatgatcacaaagaaagtaaagaaaagatctacatttaagcaatagatataatttatgagaatatgttatttattattaaccctacaaatattagtgcacaagaaagcaagccaaatcaagtataagtcaaatattaatttctattataaatcatggatcaaatattaaatatttgaaccatgctgatggcttgatgccatgattagctaaaagaaatagtaaaatcgaatctaattgatttgaatccaatctcacatgaaatataagaacacatgaaatgatgatcaccactataatgatcgtgtttataaataagtaattcaccagcatatatagattgatacttagaacattttaccgagttcctcatgacatgaacatcagtcatataaaataatagccatataaataaattaagctatatatatatatatataagaatatgtgagtgtataattgaacaattagattaatgttgtaccgagtctcaatctatatttatagaatgaatagacccacgtaaaatgcattgttatacaaataagttcattcaatgtgctattgtaataataatggccacaataggatattttaattaattttagagccctcaaagcctccaaaattatctaggttaattttagaattagacctcatttaaataatgcaatagaaaaatatatatatatatatataaaagaaataaaatatgggtaatattaaaatttggtacactttcatctaaattaaaacatatattaggtaaactccatttgtatgaaatctagaatttatgggacaagttttaataggaaataggccccaaaattggataaatagaaaaaagtcactgttcattagcccctaggtgttcgatttggttcctagccatcctagctctcttcctcctctgccataccgcgcctagccgtcctcgcgccccgcgccgccacgggctgtcaccgtcgccgtcgcctcgctccgccgctgtcgccgcgcgccgtcgcgccgtctctcaccccgcgccgccatcgccgtcgcgttccgtcgccgctcccgcgccgcgcgctgtcgccgtccatcgccgcgcccctgtcccgtcgggcccgcgcccctgccccgccgcgcgcctatcacgccgccgtcgcgtcgcccgtcgcgttgccaacgccgcgcgccgcgagccatcgccgtcagcctcgcgccccgagccgccgtgcgcccgtcgctgccgccacacgccgctcgcctgtcgccgtcccgcccgtcgcgtcgccgctccgagccccgcgccgtcgcgtcgccgcgcgtcaccgtcgcctcactctccgcgcgccgcgccgtcccatcgccatcagaccgaccacccctccccgcgcctatataaacccctctccggctgcccattgcttcccacactaccctcaccacctcccctccctttcccctctctttcccatccccggcgtcgccgcctctttggaagccaccaagccgccgctgagccgacgcgccccgccgccgcgctgcgcctcgtcgtcgcgtcgtgctccgacgtcgaccccgccgccgcgtctccgtcgaccccgccgccggtcaggtgagcctcccctttccccaccgcttgtcgtcgcgccgcgccgcccgccggttctagccgagccgtgagagagagagagaggagaaaacagagaagagagagagaaaagagaatggaggagagaggttagagtgagccccacgtgattagtaaatagtaatcctccccttgatctttattagttaagtcccttacatgtggggtccctatgattaaaatctatgaaaattcacttatatatatatgtatgttgtgtccatggcaggccggtcccacgggtcagtcaatgtaaattatggaataaaaataaatgaattaggaacagtactgtttcgcaattattcaaatttgaatctttacactagcataacttattcattttaactccgatttgaatgaaacttgatcctaaattcatctaaattcataagctttccaatggtatataattcattatttaataaaatatatttataattattaaacaattaatatcaagatgatgcatagtagtcaacttaaaaatgtgctaataaatagatttgataatgtacaatagagtagatgtaataatataggcctttaacatgttttgtcactgtagcaaccacataaattaattataatcattgtttcaaattaattaaagcataggaaatgctagtgccatttattaatacatgaccacatataattatacccataacgtccaaactatatataaataatgtttagcctcatattttgtgactaaaatatgaacacatgttgatgagtctttaacttgtttatgagaaataataccagagcttgtatgattaaaccaccaatatgaaattaattaacgatatttccaatacagtagtatatgtttaggttggaaatcgacccttaagttgtataggcagtaactcactcataaatccacttaaaatcacatgtactatatagcttaaagtaaatagcagctattcaaataaataattcaatattaagatattgtgcactaatattgtgcactcacatatactatacaatccattatagctatacgttgtaatattaaatcgcttgattgcatattttaaaattaaggaggatatatgacaaacatgtatagtggataaatactaattataaatcttggcctcgtataactatagttcaattgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataatacaaatgattcattatttgattgatcctaaatccatctaacaacagaacctctggtatgtaaccgtgctatttagatagatgcatatatagccataatccttccatagccatttgatagactaaaccaccgattagccaaatatatatgtatcccataaatgctatgttggttaactcctaaatagaccacgatgacaatagaaagattaagaaactttagcctttagcatgattgggatccgttagcaaacacgaatggtatattttgttgtgcatatttgattgttgtttgaatattggtttttctcgcgtattatagaccttgtgtatcggttagtcgtgaggcaacatctgcaacttccaggaggtgaaggttgatcaagattatatcaataataaggattatcctgagcaggcaagtcatcactattccttgaacatgttgatcccaattacgaaattattttatttataaataagattgcatgcaatgatgaacatactatttgtgaatatgccatgccttgattattgtttacccttattcccttgtaaccatgattacgtatgagtccctagccaactatgacaaatgcttagaaatgctactctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggagaatttaggtggtatccggaaaaggctagcaccgtccccggtcaattaaggaccgagccatgaagttaagcatgaaacgacccccgtacaaccgcacttctcgtatgggtatagacctagtggaatagatagctgagcggaggcagtatccatgcatagtggtttcttgatgtgtgaggtaggggctctacggtggggcagccattggtagaaccgcgaggcgggtgtctacagtggtgtcgccatcggtaggactgccatgtgagaatttaaacatagttataacttaatgcatgtgtgagtctttccttcccgggtgcgccagaactcctctcactgctagaaaccgtgtacgcgtagagtgcatgaggatgtaaagttcatggagcgggtactgccaatgcgaggttatcgaaatgctttgctgtgacgcgtctcatgtgttgggatgaggctcatgtgttgggcagtcgcggagtgtgggtaaagtatacatccactgcagtgtgagcaaaccaaatctattcgaatagctgtgctcgcgatgattgagcaccgggacgtgtattacacttggttagactctaaattcttaacttgtgtgggatgagatattgcatgatgatttttatgctgttggagccacttcctgagagacgggaaggtggacgtcctcagaaaaccatgacgactcaatggcgggaagctatccttgggatcacaatggatggtggacagaaccgtcgttgtttaatgtgaacactggtattaaaatttgatcagtctatgctaggtcttaggcttgtgaaaagatttgcaaaacttgctttgtgcaaaggaacctgaagccattccttgaaataccctctatcatatgcatcgttgctgtggtggcttgctgagtacagttggtactcactcttgctatttatatatcttttaggagagtgttgaagagaagtccttgttagtacgcttgcgtacctgacaagatgatcggagtgcagtcttgttctaggtctcgttcccaagtcggctgcctgtggcatgtcaaccgggcccttatattattttgtcttccgctgttgttctctgatagttgttggcctacatagccctaatgtaagtatttaactcttttagcctgaattcattcgtgatatgttgtgatccaactatgtatgtgtgtaccaactactgattcatggattggtacggataaacacagaagatttccgatttccaaaatcgggggtctacaactatttttgcagtaacagaatattttcatatcaggaaccttgtgccactattctctgtagtaaagaactgaaatctaaaggtatagtacaacaagatgtaaacttagctcaatctatctccctatacacactaaaagtgttgttttctcattttagattaaaaatgacatgccattttatttcttcaaaccacactgattactttcctaagtgggaaagatatcatgcttaccttagcagggtgattggagatatgacattggtacgcatctaagcaagagctccttttgtgacaatcaagaaaaagcttccacatctaagagattttcatttattgtactccctccatcccaaaaatcatttggttacagggagctattgctcttttatgtttggtatataatgttagagatgcatgtggccattattgctatgcttaatggactattataaatagagataacaaagcttagatagatgcctaagatttcaattcgatctaatcccactacgccagatcctcacacctgtgacggcatatctgtgacgggcttaagtgttggtcaatgatgagggtcacctttgacgggttctgcgggatgccgtcatcggtgagccatccggcgacgacccgtcacaagtaactagtcacctgtgacggtccaaaaatagaacccgtcaaaagtgaggtaaagtcacctctgacgggccaaaaatatttagcccgtcacagataactagtcacctgtgacggtccaaaaatagaacccgtcaaaggtgagctaaagtaacctgtgacaggtcaaattttgtgtgcccgtcaaagatcacaaaaaaaaaattcactctcctcacccttatcctcttcttctccctactgctgagtccatccttatcctcttcttctttctccctcccttctctttctctccttccgggcgcctcccccacagcagcgagagatcgagcgatgagagttgggcaacgaggcagccgcaggccgctcgtcgccgccggatggcgccctccctcctcgcagccgcagccccagatggcgccctccctcctcgacgccgcctcgcccttcctcctctacggcgccgccgccgccggtggcagcagcaggctgctcgccgccgccaccaccggtcaccgtgccgcctcctctctccgcgtcagcgccctcaagtactgccggatctacaagccctaccaccggatctagaagccccggagctccggtcgctgcctccttcaccctccgccccaggtcgccggtcgcctcatctccaccatctcgagctcctgggcatcagatccggtctctatgtggttggggaccaccggatctggtcacccccatgctccggccaccgccttcttcgtctactccgccgccatcgtctcttcgtctactccgccaccgagctcgggtcgccgtcgcctccatccacgtagtgctgaccgccgtttcttcgtcttctccgcgcccaagctgatggcaggtggaggcccattgttctgttcatgatggacgattatgcttgccttccttgtgttgttcatgttgctactgtgattgatgattctgcttcttgttgcgattgtgattcctgtgatttgtaattgggacaaatgtaatggagacgagaagaattgcgatgatttttttgatttgtgaatgccagatgtgatttgtgattgtccaaatgaatttgatggtaacctaggaggatggtgtttttttttcttttttccccacttttcacaccagtgacggctcctaattttgaccagtgacatgttaaaatatatacccgtcaaagatggcttttacctgtgacgggttttggttgagaccggtcagagatgactctcaccagtgacgggttttagttgggagccgtttgaggtgactcttacctctgacgggtcttcacccgtcataggtgaatcgaagtcatcagtgaccactaatctctgaccagggctaaacccgtcaaaggtgagggtttaggcccgttagaggtgacttgatccggtgtagtgtccataggaattctcatgcgttgtcaacaaaggtagttaaataggccatatatgcaagtcgcttaaccgaattatccaactactataattacagataagttatgaaaaaaccataggattcaaatcctccgtatttcctatattccaaaagagataggaaatgaaaactctactttaatcagaatgaatttgcctaccaatagaattgaaatgaactcatagtatgtagaattgaaatggttgggtagtcttacattgatacttatatagaaaaaatgcactaagtctattcctctataaaactaaactaatgtagacaattctctatatacagaaggcatgggtagattgcatgttcatttgctcctgaaactgttgacagttactttcgctacttacatgtactatgaaaggcagtttattatttatgcaagatatatgagttctaaaacaaatctatcgtactactccatgaattttatccatctaagagttttatccttgacgacaccgagaatgcataggtgttctgtatacaagattagaacttccttgataacaacaagaacatgtgagtagattgaacaatatgtcgctaggctgctagcaagggagccagtctaatgcctttatttttacacaaaccattaaaacttgcatcagtctaatacctaatttactttgtctgaaaagattattataacaaaataataatacaaatccatcacccaataaatttatgtatgcaaaactatgtgttacacattttcaaaaaaagggacgaaaattaagattcatcacaatcctaaattaactataacacatgttttcacaactgaacttatcacactttaaaaaatgtgagcctagttcagaatttagaacctcaagctgcagttagaaatatagagaaaatgtttagactaaaaagtgctactccctccatcccaaaatataagaacttttagccctcaagatttgtcccacaatataacaatttctccaccaacattctcttcccaaccaatcacatccctccactattctcttgttgcactgatcttcctgacggattgccttgtctaccagcttctcaaagttagcataatccctagagatcagctggttggtcagttcatcattaaggccagaaagaaacttctccttccgcttggcatcagtacgcacatccttcagagcatagcgcgcgaggcggttgaactcatgcaggtattctgtcattgtcctgctgccttggttaagtgctcggaactccctcttcttctgtgccactatcccgtcaggaacctgagctttcctaaagctacaacagaattccgcccaagtgacttctgttccgactagacgggtaaccaagtagttatcccaccaagaagaagcatgaccctatagctagtgagtggcaaaggcaaccttctcttggtcattgcactacagaaggttgagctttttctcaatggcatgaagccagtcatttgcctccattgggtcggtggtgcttgagaaagtaggtggcctgatgctacaaaactactgtggcttgtattgaggaggaccacactgttggttctgctcaactgcgtctgctattgcatctattgatgcacctgctgcatcatcatagtcatcatctgcgtctggttggccagcacttgagcgatagttggattctccagtggtggaggtgggccgttgcctggcacaccattgacatgagcagtctgttcctcactattgctgccatctcctgctacacgactgccagtcctagtgttgaccatctgaaggggtaacaggcaagaaggggatataaaaaaagaaaaacaaactgcttagaaactaagctttgttacattataattaaactgcaattgttcttatctgacttaaaacacttaaaagacagcaaccaagtccttattaagatagccataccatatgcacatggtatcgacaaccaactaaccctcaagcgaacaggcctaaacacggaaactaacaagcaaacgaactgcgcaaagagctaaacaaaagggtaacgagctaagcaaagaggtaaactaaagggtaacgagcttaatgctcggagcggctcttgcggttggtggagtcgtagccagtcttttgctcgtctcccagctcctctaagcgactcctggagtccatcaggttggtgttgccattggctgcctctgaactagagttgttgttgccactgggtgtagaaggtaaccatctactgctgccactagctacgcctcggaaagctgaggctagagcgaaggtgagaactggcgctggagtggaggctgaagctggtgcaagagcgggtgcgggtgcaggagctgcaactggcgaagatgaaggagctggagctggagctggagctggtgctggtgctgggactactggaggtggtggaggtgggtgcaccagtagaatgcaaactggagctgtgtgttaactgcagaatttagagataaactcaaagtcaaagaacaaatcgaggaagatttggagggagatggaattattcccaaatttcgggtgcgcatcgactggaaccatatcgggtagaaacggagtcgaactaggttgagcccatatagggtgacatgagccgatacgggtatggctgagcttgcaccaggcctagattggattacaagacattgccgtgcgaggaaagagtccattataagcaattatttctattaattaggtatattaatgtgggtttcttaaagatttggcaagagtctgccataaggacttgtttgtattttttttgtaatttaggaaagctttgagtcatgtccataatggacaagtttttactatgggtataaatatgtgcccataaccatgtaaaagacaacaatcgttcaatacaatcttggcgctttgccagcttttcttttagttcttttcgacgagttctttgctttgggttagggcatcgatttcgatctactgacaagaggtaatgcttgtctcagagatttgtattattaaggttattatgtcgctttagatattttaatcttactaatataatcattgtttatcatatatatcttagttaatctatgtcaatagttcattttatatgtatcggctagttcttttctagggttttgccggtatcggttaagttgtttttgttaaatagattaactaaggtatcctgaaaatcagccaatgacttgattgtctagatatattgcttcttttcatacttaatgctgcatcagttaagtttgatctattaatatgtgatttgaatatctagctcagcatgctttttgattgccaataagggtagaatcggggtctcagccgatcttacctaatatagatgttttaatatgtttagttaatctaatcatgctttacatgttatatctatcctttatatatatgtatcacttaagataaatatactggggcaactgtgttcttacccctactttgtattctaattgtgattttaccctttttttagggtttgcatttttgccattacttttttcaaacgaagcttcagtttacccatattctgttaacatcaggtaactgtgtcaattcactcataaaaagacatgtatacccttgaacatttgtccaacttcttttagaattttgatagcattttcacacaattggcacggttgcagaacatcagcacaaagattcatcacaaattcgtcgcaagtcacaaatactatgagatggggaaaataaaaggaaaatcaagcagcaaacgacatggcattgtttgtatttgtggacgagctgcttgtcgtgtgtcgctattgccggcttgccgcaccatgctgctcgctgctcgcttgcccgtgcgttgtgcaggagctgcctcgccacagccttcgccgccgccttcccgtggcgctgcgccagattcactgccttcctgtacgctgcgccatcccgctgccaagcttccctgctcgctggcttgctggtcgacagagccgccgctcctctccgctgcgcgctggctgcggggccgctggccgccgcgcctccctgtgcgtgcacccgcggggccgccacgctgctccaccctgcgcgcgctgttggtatttcttaacgtcattactaaaaatataattcccagcaatggcgcagaaatactcctggtatattacggttacagagttcatccgcaagcgcacggatataccattgtagcatctcacccaagagtattccaagggtatcgtatttattttattccgtgggaagatcatgtagagagaactcaactaataagttatatattatttatgataatcatattctaagcaagggttaagataatccaagagtagagtgacacacaagcattactactcattctcataataaatcatctaagctaagtggaaagaaaagagagaaaatctattcctatacttctaatatacatagtatacatacattctagttaactgatatactagctaataccccctatccgatgccctcctggtacttcgagaagccactcctaactgccgagttccttacgacagcccatcatgaccatacaaccggggctaaatacggaggaataccctccccagggaattaacataggattatatatcggcgcggaggaatacccgtactgagctgtcaccatcagtggtccacctctcatccgcaatatataaccccaaataatgatatcccataatctaaacactatgcctaaactaccatatactactctaatatcattgtcatgacatagagcaattgcataagcaaacattatacccgcaccaaagcatctcccagataagctagccgtatattcaatataacatgaacataatgtaaattaggtactcatatactcagaaagtatttcaataccataaatatatttagaagagtattctaataaaagtacaaagcttacaaaagaggaaaggaaagctactagagccatacccgagctcttccgaaggcttccggactcctgatttctactctattcctattccactagctagatactactaaactaaacttgagagaaatgagagagctattgcttgaggagtgtgagtgaagtgagaaggtgaagtccttttataactgaactatgacggttgtgacggttggaatggtcggtaatacgtaccctccaaccgtcattggggtttcatctcaaccgtccagccaaaacctggattcaacgaaggcgagggaggttcggccaccgaacctggggccggcccaatccagcccaatttcggttggcggccttctccgttattcttctccgcagacttgtgaattttggcccaattcatcgtgtcaattctgagttcttggcccattcatacacaagtctggttctcgacatcgtctaattgatttatcgtctgagttgatgttgattctcctccactttagtgtctatctaagtattgttctatcggctatgatataaacacatctaatctctaaagatggtcaatctgatttatatacaatccatattgtctctataagtttgatctataccttttgtctatgattcaaaaaagattgacttcgagattagatgattgtttgcctctacagccgatacatcatacttagggtttacttgtattattttaacatcacacctaacagtcgatcctgtttaattgcatcggctagtttaaagacaatacgtcatcaactttctagccgatcggctatcgtttgtggttctaactgtccgctcaatggcgagctcccacactaggttcacttggaggttcacgacattcctaccgttctacccaacatggtggtgaaaacaataggaggcaccttcaagcatgcttgtcagagggccgcttacatgatgatggccaggataagggagctgcacgaccataacctccacaacactgcttaccactaccaccctggtcatggcagttttgctgacgtcagcaccttcaagtcaccgtctgaggagaacgacacagttgacgaaaaatccgcgcttggccaatggttccggaactgtgttggcgcgaaataagtcgacgaacacaacgacctgggagattttcttagctccaatgtaggtctaaaggttgatgagatgcgggcaggcctttgctcctgcaagtgacaagatatacaaataaaaaatcaatgagccgattggccgacaagccgatggagtaattccaaccgattccgataccagccgatagcgatagggttttgagctattggctatatgcttgatgtagagtctgaaacttgatgtaaataatgatataaagacaatcggctgatgatgataaataaaatataatccagtagaaaccaatcggctaacaatgatatgatagaataagcaacgattcgaaggttaaagcatgaatcggttgaaggtccgatgtcataaaatcaacgagattagataaatagtgaaacatgtgttgcgattggctaaatccaaatgcgacatctagatacctcaacggctgaaaccccgatgaaaccctaattggcaataaaaaagcagggtaaaatatagggtctaaacacgacttagtagatcaaatttaactgatgcagcactaagtatgaaaagaaacataatatctagacaatcaagcccttgactgatttttagggtggtagataccttagttaatctaatctagcaagataatttagccgatatcaacattaaccctaaacggatctcagctgatatgatcaaataaagatgcttaactagattaactaagatatatgataaataggtaggaaaatatatcaactaaaccagagcaatccaagaggttgaatgtggtgatgcaaccttgaacgaccgccaatgtagccaatataattggcaggggctggcggaacgtaggacttacccctttgccggagatcgaaaaccgatgcaaccccgcatctggtgccaagttccgccgcgataagtaaaaacctcggtaaagagggtggagatgcgctgagagtagttgtattgatctgtgaatagtttacaatgaccccaggtgtacatatttatacccatgggtagatactagtccttctcggacaagaaagaaactttcctaaagataaaaggaaaacataaagtccttattggacactaaacacagtttcctaaagataaaactaaactaacagactcttcctaattaatagataaactgccatgccgcatcctccttgaactcggtcacttctggataagtttcttttaatagattaatttccttaaccgaatatagtaagaatccgactattggcgacttgataattcctatcggccgattctaggactctaaagccgataatgactctagaccgatcatgactttggagcttagcaaatttcactgttaatagacaccacctttggacgcatgtgctttgtgatgaagagtttatacaaggtcagtgctgataccaacttgttacgcctagaaattcatgaaccaaaatccccaagcagaatgttcattggaacccctgtccaggaccggccagggtacacaaacgacaaaattgatacacatatccacgtcttacaaacataataaagttttacatatggaatgaaattaaaagcaagctaaactagattacttgacgctcgcaacgtgacgactccactctcactctatatgcatccttgacggcaacgacgagcctacttctccgagtaaccttcatctgaaaagtactctgcctctgaggtagggaagatagagcaagactgaatactacctaatgtactcagcaagtcataccaagaggaggtatgatgcaaggtaattccaaaggaggctaggggttatttgcataaagtgcttaaaagcagaagttgaaagtaggaaaactactaaagtaaattaagcaatattaatcatctatgtcaaacgctacacaacattacaacaggcccaaccaaccacctgaactaaaccagttccatttaagtcgaattattaagggtgagactaatcacggtgagtctggttgatctcccataaccgcgggcacaattatccgaatagttttactctgattagaggtgtacaactatacccacaagacacagccccacgacacgtttccgtgcgctgacatgccaccatgatataccagaaagagactgtgacaggacccatcgcataaccctccttaaccaatcatacccacttcaggttttgccaccacctttataaccatggcgggctacccatcctgtgcctaggtgaatccggaagccgcaaaagccatcacatggcccatccaaactccatcacgctcacccttccggcggtacgtcagctagggaaaagctacactacaagcccagccattgaccgcactggcttgtggtaagcacggtaattcttccagcgtaatccacgaaccggtccttaattgccatgtccccgctaggccctccgacgtggccaacttgtagaaactaggacgccgccacaagaggatgagaatctagagcgtgcttgcgccgattgctcgagtgatttcgacaaggggatacctaaacgatgtctccaacgagagaagcgatggaaaaccgccgccgccatccatcaaggtctcaaaagagctaagactaggctttcgcccggcaaccacccttgagcggtgagacggcatgacaacgcccttaggagggggaatgacactcgagcgccatcgttgtcagtccggcaaaggccgggctaggatttcaaaagctgctcaccacctacgagtccatggctgacgcaccaatgctccaccaccacccaacctctaccgacatgtgggacccctccactggcgctcccgccggccagccgtcgtgcgccgtagaccgcgccacacccaccagcagctcctcctcataccgtggtcgcctcctccaccaccaacagtgcctcatcgtgccacatcggtctcctccaccgccggatgcgcctcatcgtgccaagccgacctcctgccaccggccgcgcctcaggcgccaaactggcctccaccgctaccggccgcacctcctcacgttgtgcctttctgcgccgagccggccttcgacccctcctccaattgctgcgcgccagccagatgcagccgtctgccacgcccctggctagccatccgagaccgccgtgcctcctcccgccacagccgcagccacggtcgccacagcaaccacagccacagccgccgcagccccagtcctccgcctcctgggctccgccaccgccgttgtcgctccaccaccaaccgcgccgtcatcgccaccccatcgccgtgaagaaggccgccgcgagcatgccgttctccaccttcgtagcttctacggatccgacagcctccgacgcccgccaccgacgtccactcaccggcccgctcgcaccggcgacccgcctcgagccgccggcctgccacagcctgccgccgggcacagcagcactgcctttgtgcctgctacgaccacccgtgcctccgctgcctactgccgccaactccgcaccaccgaggccgccaactccatccacaacctccactcagctgacgctgccaactccacgccgccgaccccgccaactcgacgacccggctctccgctgcccggagcaacagatccgaccatagggggaccggatccgtgcattccagcgccggatctggaagctgccatcggatcttcctcggtgttggcgccttgccctgagctccatcttgctggcaccccgactgccttgaccgcaagcgagggagagagagcccgccgccgctgtccttgcagccacctggctttgccggcagcggcgagacgggggaggggaggagaggggtggaggtggcgcggcttgtttcgccagccgcgccacccccggggcacagcgaccgggcgtcttgaactactgaaaaaagatcatgatcatagccaccatggtactttcctcatagtgagctagttgatctaagcatggctaagcatcatattagatcccaatttatcaaaggcatgtggtaaacaacatatggctgagtaataggaaccatccacatgacaatgtaaaataatgcaatttaaatagaaagcaagatgtttgcaatataggtataatatgttcaatgagggatgcatgacttgccttgctcctgtgctgctagaacctctgcaaccacttcataatagaagagagcgtcgaaactaccggaatctaagcgacaaacaaagcacataagcaaaacaggctataagactactgaaacaggaaacaaaccacttttaatggattctaggcatttttatgaatttactgagacttgaatggacttaaacggagctcggatgaattagatatgaaatttagaagattcactatgtttttactataaacagaacaatccttaatcaattactgcgtattaaagccggatgttgatgtcagcaaggggagaggcggcaccgacacgcgggtcccacccatcagtgacacaatgcccggtccactgtggaacgggaccaccgcgacagtccattgccggtccacggggataggggctcggctcgggacgagccggctaggtgatggcggcacgggagcgagcggcaagtggcggcggcgcccaccggagagcagcgatgtggcaaggagagagaggaggaaaagaggagggcctcaccgacgatgacagcgaccgacgcggagcggacgacaacgaaggcggcaaggggtgaacgggctccggagcaaccttgggaaggagatgagaggggttagagggagagaaagagagagagagagaggccacggcggcaagcattgccagccgtagacggcaggcatgcagagctcaccggcgaaccgagggaggacggttccggcggtggaagacgacaggggaacgacggctgaggtagctctcgacctcgcgaacccgatggaggcgacagcgcggcttggcgcagtagctagcgacggctggagacgacagcggcgggagtgatggtgtgggcgcgatttagggcacgggagcaagcggcgaaagagggaaactgaggaggggagcacatgtatcatttatatagcggtggggagctcggatgtggcaagtagggggcagattttgtgacggacgtgggagagagagagagacgacggctggattcgaaaatcgaatcccgccgattttgaggagaaccacgtgcggcgagagtggtggaggtggttccgggtagtggggtgcatcaggtgcgcggagagagcggagtggggcgcctccctgacttgttattttgagatgtaaaccttagatataaattttgtacgtttcaacccttggaaagtggggtgtgtgatatagaggggcacgggggccttcgggactctaagcagagtagctcctgaccgcgaacccctgccctgccacgcggttattttaaataatagctaaacaatgttttctttatgtgacgagaatataacctcgggtccccaaggaaatgggtacctagttctcatttcaccaacagtggttaatgtgcaaaatgggcctagcgttagcaggaatcatattgtatctgatggctgatatttgagatgaggaacgatcaaacggctatagcatttttgagtaaattccctgtatatcattggaaactcactcaatcctgctcatatccctaatatttatctgatcccttctataccattaaaattttaacttgatccttctatgattatactgttatattttctttcatttcactgttaagtttgtttgcaaatatcatttatcccttgacgatgtaggtttgaatataaacttaaaaaacgattgaaaattaaatttaaaattttgtttgaatgcttagtatgtgcattttataaaactaatgagactaaataattagtgcaggaaatgttaacataaaatttgaaaataaaaatgtaataaattgaaatttttatttaatattttaataggataatgactttttattgcgaacgtcataaaaaatgaggagcatccgtaaaaaagaattgtgagcattattagacccatcttgaatactcctcatttgtagaactttttaataaataaaataaatacatattgtttttctttcattaactaaaaaaaattgtgataaataatgtgtcgcataataaactcataactataataagtcttatgtaataaacttttacatttcaataatataattcataaattttaatgtttattcatgtgtaataattatttttttataaaaattagacggtcaactaataataaactgacgggaggggcatggaataaatcaaaatcaaattttgggacttcaaaagaaattttctcttttttttttatgatgggactatacgtaattgcagatacaaattatagggttcaggtacaaatccgatcctattatagggttcaggtacaaatccgatcctatcaagtgcgtgcgtgcgagggattgtggcttgataggatcgtccggacctgacgggagaaggcgtgggttcgtgcgacgggacctcgattcgtccatccagcttccactacccctccgcgcgctgcctagatctttcctctctctcgcaccctcttattggcggaggaggaggagggatggtgcgggaggttgcggagagctgtgtcgacggggtggtgatggagatggtggcggcctactgcggccgcttctacgccgccaagccggagctcgccgcccgccgcatcgaggccatcggcttccaggtcggccaccagctcacggagaggtaaacgaatctctctctctctcttgctggatggatctgctgctgcgcccctcccccgatctttccggcgagtccgccgacgagggcctcagatcttctcagtcggcagtcgctatcggttcttgctgactccgataaattttgaaatgttgcttttagtcgccctaaataagggcttattaatcagatttcgcaacaatatcgagccttagacttgatcgcgaagcacttcttgtctttgggagcaggagtgcagggccttgcctacaatcaaaatttgggttaattggatccgctattataaatttcacggtttagaaaaataccattactatttggtaccattgccattgcaatttcataagtattatcactacagaccttttcataacattttttgttttttaagaccaaattaccccctcttcttccttcttccttcccctctctcctctcttccagccgacgaactcgtatgagttcagcagctcatgccgcaggctgcagcgctggaagagccgccgcgcaggacactgctgccgatggagctgaaggagagtggcatagagttgtgag

SEQ ID NO: 37770 - DNA, 1244 bp, Oryza sativa
cgtccttcaacagcaggaaaccaaccatgtgcaagaaatgggaagaagaagaagatgaacagcagacaggtcgggtagctctgaccagctgctgcagtttcgtgtatatggggctggtggccggcgccaccgggaccaacaccatcgagcaatggcggttggctcggactaggtgctgcggcatccagatccgatgagcctgaacccaacgccatctttggcacagccgactcgagccagcctgtcccaatcggcaaccccttgcactgaacttgcagcaagaattgagagaaagaagatgtacaggagagatggaaggacaccaaggaagaagaagagggcattttggtctaagaattttgttaaacacattgaaggggtatgtagtggtatattttcaatacctggaaaattgtaatggcatagctcttaatagttgaatggtaatggcatatgtcagaactgaaaaaatgctgtgaaagggtatatagcggcatatctctaacacttgtaaaattgtaatggcatgatttcaaatagatgaataataatggtatatttccaaactgcgaaatttacagtggcatagatccaattaacccaccatatatattccacaattccaaatgttcattccataagttttaacttcagtacatgtctagtatttcgaacaggtcacttgtttaaccgtttactgatgtgtatacaaatttgtaattctagacagtttatctattctcttgactggtactgttgtatcagcctttattaatagatcgcataactggatgccgccagcaccaatgttctgtcagacagggtaaaaaatatatcacatgattacagccatacggagtatatatttttatttaaacaagtacaactcttttttactgcatacctggctttcagtgtagggatccgaaaatgttatcactttgaactgcagtatatcctcaaatatggtgggtactggataggttcatctcatatagccttggagatctagataacatagatcattctggagttaattactccccggcattcttcttgaaattgatgatatatttcctaaacttttgtgtgtgtgtgtgcgggaacttcaaaggactcaacgagctgaaacagttgattgaagaacctttgtaccgatactttgattcatatgcgacagagtttaataatgcttacattttatcgtatggacattttctcgtgcaatatgtatgctcattatt

SEQ ID NO: 37771 - DNA, 1351 bp, Oryza sativa
ctgcagccctttgtctgagtttagtgtctgaccttggcccttgcaggttgtgtaaacaatatactcctgttaccatttaaggttacgatttattctctacaaattcatactaaattcatattatacaagttcatgcttaacaattgatttggatttctaggtatttataaaatccagattattttgtgaacgtgaacatggaatgtatctaaattcagcgtgtggacacagccatgccatgtttctcaagtcagtttatgaatatatccttgcgcacatagtttccccctatttttactcttcttaaatatatattatacgccggtgacgacgacggcactatacccatcccgtggttgaacctcaatggccagctcggcgacatcgtggaccgtgccgacggctcggacgtgccgttctctgtcggcggcgagatgttccacgcacaccatgccgtgctcgccgcgcgctcgccggtgttcaagacggagctcctcgggtccatggcggagtccgccatgccgtgcgtcaccctgcacaacatcgacccggccacgttcaaagctctactacacttcgtgtacatggacgccttgctgtcgccgactagaggcggtgccagctcgacgtcgacgacaaccggatttttcaagagcttgctcatggcggtggacatgtacgcattgaagaggttgaagctgatgtgtgcacagaagctgtgggggagcgtgtcagtggagacggtggcgacgacactaggctacgccgagacgtaccattgcccggagctaaagagcaagtgcctcagcttcttgatggcggagagcagcttcaagaaggtggccttcactgatggctactttcatcttaggcaggatttcccgttaattatcgaagagataaaaaagcggattgagagttaaaaactttacatacatctatatcaatctatactgatataaaaaacaccagttttctatttagtacacccatacattcctaaccgttagatcctctcatccaacgattcacatcgcgagttggcaataatatgtattatgataacgtgccttacacgtgcacgttcattagtgattataaatggagtaggttatattaatgatacttcacatatgcatgaattttatatgaaatacattaatgcataacacaacatacagcatactgccatcaaaatattcaaacataccactaacataaatacaagtttaatcttctaaattattcaatttaacagtacacgctgaatcatcaatagtggaggcagtaacaataaaatgttaaagtgtagcacaaccgctatgttcacttgcctttttgacattaaatc

SEQ ID NO: 37772 - DNA, 6283 bp, Oryza sativa
cgcgcgaactgacttttggggaaagacactctgaaaagttggatatttgctggtcacaacatattaaaataatatttttcggttgaagaggagacgtcaaagtactgaaatgcccttgggcccacatctgatctcccctcctcgatcctgactccgtgcgacaagttcgattaccgttgcgatggatttctctggcggcggcgtgatgttgtcggagatgtaccagagcacgtggcggcggctgctctcagcctgcgatgacgtggccagtgtcggtgccaacctcgtcttcctactactcggcaccgctcgtcagcgatgtctgggattcggccgccgccgaggacgtgcggcaggaggtaacccagatctagggcttgtccgcgcggttgggacggctctggcgatcaatccgcgcgctccccgctgccatccccgttctctcttcccgaccgcctcgccttcctctccctctctacatgcccacaccgcgtggtcctgggcggcggcgtcgaccttgacttcctcctcgcggtggtgttcctcactatccgtgctcacttgtcgcgcttccggtgcaggaggatcacgaacggcaaagggaaccccgcggacgagtaacccctgctcgcaaagccgccgctgctgtctgaggttgcgatgccccgtcgagggaggttgcggaatggggtcgggctagtgaagtccgtgtgttttatggccgcgtcgctcgttctgctcatgctcgtggacctcatggcttgccacgaagtgtgttcttcgcagcacagttcatggcgtaccttgccattgtggggttgtcatgacagagaaggccgtggcggtgacggcgcgttctcactcggtgcacctccgtctcttctgggttgggtccatgacactggggaaatggggtagacccagcgcccgtggttgcagactgtcccactcgtgggcaaagtcagcgagaggattaatagataagaaaaatgtgagttctaacatgtggacgcaagggcatttcagaactttcacacgatttctctcttcttcaaccaaaaaatattattttaatgggtgcagtgtccactagcaaatatccattgagtgtattcccccaaaagtcattttgcgcagtgtcctacagctaaaaccgctaagtcacgatgtcctgtagcaaatttgcctaaaattaatagctaaagtttaaaaagtttgaccgaatattttcctaaacgtcaaaaatatatttatgctgggactatttcttcacagagaaatgatactcacccaaagtggtccaagggttggctaaaaaagttgataaacatttttttcacattgaaatacattgtcgtaacacaaggtttaaagttggcccctagggtttagggtttacaagggctgtgaactggaaaacaaattaaataagcatatttaaaaaaaataagagtgtcatacctcagaaacttaatcaggtagaagagattgctctactgaagagactgcaccatactctagtgaaggactgtcacgaccggaaataacccaacgggcgttccttacgtgcgtgtattattccttgtcccaggaggcaaagtacatcaaaagttgatacaattcagagtttaacaagcggaagcgtaaatagttaatttattacatgggcggcgaaggcccggcacacatgaagacaaacgaaaaacagcggaagactagggtgacgaccacaggcgcttgacggcaggcacgagctagacaccaaagccttcatcatccaggaactcctcttctgggtttgggaaaaattgagcaagactgagtacaaccaccgtactcaacaagacacacccacgagtgcagaataaatgcaaaggagtacaatggagtaataatatagggggttagggtttgtagtaaacagcattagaagacacttagttgctcaaagctacttttagaaaacacgatcctagatctatacaatattattaaacaaggccgtgaacccacacgaacctgccttaacccaaggcctacgatgattcagaccgaactggcaacccgaccctgggtcccagctcgtcccaagccaacccaggccaacctttccacattttagttgttaagcaggcttttaagaatttaaaacactaacttgggtacaatgctaggcttgcccataaccaagggcgcggctattcaaatagattatactctgatcagaggtgtacatctttacccacaagacacatcttactcacgtgtaaccacgtgccacataccaccacggcatatggacggaagacatgacatagtttccaacccatcctagccatagacaagagtaccgacccaaccccacctacggccggaacctccgggacaggtaggcaggactgagcccctagcagcaggacaacagccctgtgccatgacatctcgactaaccgggccgcagctcgtatagccttcatttgtcctagagatgtccatcgacccccgacttcgtccatctccatccgtgtacttttgtttataaccagactgatccacaaactaagccttatccactagacatgtggaagtacggtagtgctttgcaatagaggcccgaagaccggtccttatgtggccgaggtgctactatcaaaaccatgcaccccgagcccagcctaaaaccattttgagggttttgaatagagggggaggtgtgcatccaattccacaataatccaaccattccacaatgtccaagtgatatgaatattcccaaagtctagagttataaaaccacctaatgttgactaattgaacagcgaagcatctacataaattcatactagtggaaccatgaatagagtacccactagttggggttttgtttaatctagggtgaacaaggtaataataacaataacaataataataaggtcataacaaaggtaaataagcatggctaaataaaagagtgataacgcgggaatttaaataaagcgataatgcattaatttaaatcaaaataatttcacagactaggattcaatatgttcaaagatgatgtgacttgccttgctcgctttcccaaacgtcggcttcaacctccacgtagagcggatcttccgaagctgcagcgtctacacgaccaacggaaaggaaaaagtcttttactctaataaactccatataacaagcaggaacaaagcacaaaaatgggttcttgacttcttaaggaaaaattagaacttgaacggtccaattccgagttcaaatggccaagttatggccatttgaagtttatatgctctttaagtgaatatttgcgaatttcttcatttaaattttaatttaaaaagggtttattgcgtcagccgaggggagggggcgcgcggaccgggtccacgggagtggggcccacgcggcagcctcacggtccacggtggaccgggcgcacccgggctcacaccggccggcgccgtgggccccacgcgtcagccgcacccaagggcgcgggcggctgacggccgggccccacggcgtgcccggaggcggccacgtcggcgcggccggcgggaggcggcgcccacgcccctatggtcgccggcggcggccataggcacggcggagcggcggccaagagaggggaagggaaagggagaggaggcggcggtccatggctcaccccgggtcgacggcgacggcaaaagaggctgccggagcgcaggaaggcagcggcgcggctcgggtggacgaggacgacggcgctccggcggtcggcgagctcggcgaggtggtggacggggtcggcggcggtgcggcgaagccggaggaggcgacgccgaggcgggggacggtcccggtgagcggagagggccgaccggaggtcgtcggcgacggaggagagagagggcgacggcgcgagctcgtttccggcgaggagaaggtgcggcaagtggcggaaacgggcgagggaggcgcggggagggtttaaatagggttgggagggagagagggcggccggcggggaaggaaaccggcgcgggggatccggctgccatcaatggtgccggcgagatttgcgggagcaaatccggccgtttgaatacaggagacagagggaaaaatggggggaaagggagaggagatcacggggaatgatttcccccacttaattgcacgcgggaacggccggaggcggcgagattcgcggcggcggcggcgctaggcgcgggcggggcggcgggaggaaggggatgacaggtgggccccacccgtcagcgagggtggcgggcgggcctgcccatcagcggcgcgcgcgaggggagaaggccgaatgggccgcaggggagaggagagagagggggagggagatgggccgagccggcccattagagggggaggggtttttagggtttttctttttataaaaccttttcaactttgtttatttcttaataattattatttgtgctctgaaaattccactaaaatttatttacacattttaggtttttaggaaatatacaaaaatcctccaagccttatttgacttttagctttgcacattttaatttttggaggctttcacaaggattttaatctaggcataatttaaaggatatattttttgggtcgttttgggacgtgacaaggactcaattgagtatcacaatgaacgatctcttaaactagtaaaccatgtatgtgcaggaaggcaacagtccagtcatcatctagccaaagagattcaatgaattggaggtgtgaacgtgtacttatggcattcttagaagatatcacatgtactggaaaatgcaatccaatatgcatgggctgatcttatcttgtatatgttgaaataccttttccctagtaacagaagctggaggtgccaattgcaggtggaacaacaacaatgaccaggcaatgaagggcatcatcctagtgagagaaaacataccttccgaaagatcagtctggagaaattcagaagtagacatctcaattaaggataagagttctctcataacttctctgaatctgttatcagttcaatactttggcccatgtcagattaattcttgagtcagtgctctattaatcccggagaacactcttttactagtgaaatttgagagaggcgttcaaaaagaagtagagagtaagcagcagacgatggatgagatattggctgtgaagagaactaagaatatagcccactgactgagcccttcgcaagcccccacagttccatcaactcttgtgcattccagtctctggtgaagcataaatgacaaatgatgccacaagttcccaaaaattcatataagcaatgcgacttgaagatatgatgaatgaggcctcttcacaacaagactttgcaattgcctctgaaacaccagaggccaagaacaaataattccatcatcttgttatttctttcagcataatcccttgaatcaataatctgcaaacccaggaagtttctgtttcttgggtatccaaagcagattcaactcagttaaggtaacacaatgtaaccaacgcggattcaccaaagcttaacattaactcatctatagcgctaaccactaatttaagcttctccaagcagaggttgcaacaatcattttcttattatcagccaaccatatataactgctgttaatttcacacccaccccacctagttcagccattattgacaatgggaatcaacaatatctgccaaaaataacagattatatgaatgtagcgttgtactagtacgattgaaaaatgttatggtgcagattaccttgttgtactacttcccttgggctggatgataggcaaaagatggctacatcaagccaactcaaaatgcttttcgccaaaatcagcgtaacaagaagcttcattcaattttaattttcctgaaaacggtttgataattataattttaagctccacaaaatgattccatgtttgagtgctgaatcagagaaggtaagactgccaaatacactctcccctatccatttccaagtgcaaaggatctcagcagcaacccatgctttagagaatgaaggaacagttgaagtagtatcaattgattgtgatatgttgtaacacgtatttccaagagcacctaacaagcttgtcaacaaaagcaacaaattggcggtgtttcaaaagaaaataacctaacaactgccataaactatatatttttttgtcaggcactatgctgtcataaatttcagaacatgaacagaatttgtaaagatggcagtaaaaggcat

SEQ ID NO: 37773 - DNA, 13099 bp, Oryza sativa
agatgactctacactcaatacacacgatttgcaggatatattaccaaatataaaaccttgattccatttggtcaccacccaatatcagtgcgctgctcttttggaatatcagttgatacaggataaccgatcagcctgcaaacccaaaaaggatctcctgcggttgtaccttcaaaagcatcaactggcgcacccaacgccaaggctatacctcgcatgatctttcttgaaagatctacaagtaaattttcataacaaatgctgtcactcataagtaacaaataataaatggatcaatagcatacatgcacaaataaagatttaaactaagtatagaagttaacctcttagaaggctgatatagttttccagcagtacatcaaaatttgatggatatttgggcctgcataaaaataaatgaaccggttatttgaattttgatagatctctgacctaaaatactcaaaggcagtctaccaaagttcagaacttcttcagtaatagctgaagtaattcaacaagcaataattctgtggtacctagtaccaactatttaatatgcttctagtaacaaaaatacattgaagtatgcaagtacaattgtagccataacttctattttctttactataattcataattctacccatattggaacataatacatgttggtactagataaaatattgtaaatataaattttattccctcacattcttccaaatagaggtgtgctataagctaaattatttatattgtgagtattattaaaatatgcaatagatcaaaactggggtattgttttatatcaaagtcaagtacataatatctgtctcgcatatgtcaaataatacagtgctgtaggaaaaaaacagagatggagagttggatacataccacaaattagatcctaccattggtttagcaaggtctccatatttaccaggttcaataggcgtgtagcactgtgatgttttttcttccagggattaactcaggaacaaattaatggatgataaaaaaataataaagagaaaattaaacttacatcaattgcttcatgcatgtcaggtttacccttggtaatattttcaccaactctttggtaccctctgacagtaaagacaacaaagttatgttatacaggaaggaggattagaaggatccaatgtggaacaaggaaaaatgttggaaacttaaaaacaggttgaagctgtcattttatatcacacctgtatccactctgaggtgtcattttaatcttgagtttttcctcataaggaagctgaaagaacttctgtgtcacatccctaacttgcttcattagcgagtcagcaatcccatggcctttctgttagtaacatacagacaccatttgattaggattgatattgtgtagctagtctgctgtacccattgtagtaaactgatgctaaaaagtctgaagtaggctagtaagtaaataagtaaattttaccacataaaagaatccagcctccctgcaggcatcgtccaacatttgcacaacttgcagcaaatcctcgtcattgaccatgctcggatcatcaatctttccgacaaggggactaatgtctgacaaatgaacaaagatagaggaattcttcaaatggagatttcaaagtacaagcatatatcatctcatcccaccaagtatctttacacaaaattctacaaaagctgtatctagtatcctttgcagacaagcagtcgtaatctgtggttaattgaactaactgcaactggtggtggcaaagcaggtaaaagaaaaaaaagaatcccacgcaggattccagaatctgaatctgaatcttaccgatcaaggggattgccttgaagtcagaacccatggtgatgcagggagagaagccgcctgtggggacacgaacgcggcggcggtcgggcgatggcgattccggcggcgggcgggcgggcgaagagtggcgtgatagtgcggttgggttgggttgggttgggttggggattttggattgctgcgatagcggggtgactttcgacgtcatgtgcggcgttttatagaaccaaagtgtaagaaaaaaatgggaaagtatgtagtggaaacctatacgattggattgcccgaaaaaaatgatgcgatatgcggtgcgctctgacccccgacccgagtaagaataggattggattgccatggtcaatttggagacgaccaagcaaagcaaaaccacttttcatgtactctgtctgccgtaccataccatacggcgagaaatccgagattttgccattgccatcgccacaatgccactatgtttacgtcaaaaaagaaaacaatgacatctcacacaaaaatacccttggttcttcttcccttccggctgctcgccggcaacgaagccatggcgtgggatggagggagcaagtgtcacaccccgaagttcttctcccaagtctaaattaattaataaatagtctcgagaaattatttgtgaagtggcaagagagaaaccttaatttaataaatgcaaataataatcggaaatgacatgtgaaatttttcttgagttctacgtgtcaaaatacgctaacaggatttttagtggaattttcagagctttagaaataattttaaccaaataaaaatgagcacgagcaattatttaatccctgaaaattcatttctcctttttctttttctttttctttttcccctcctttttcctaatgggccgctggcccattctctttccccctccccctaccagttgggccggccgaagtccaaggcccatcagccggccgcccgagcccctcctcccctcgggtcaccgacaggtgggcccgtccccaacctctggctggcgccgcccgtgcccgaaatcgctgctcctgcctctcccgcacctcccgggccacgccgccggcgtcgccgccttccccgcgccccgctccctctctccacctccccactactccggtgaaatcagcccactcccagcctccccgagccccctcttcccctatttaagcaccaccgcccctccctctctctttttccccatttcgccgagctcccccgtgccctccttcgccctagcacagtcgccctcctctccgccgccgccgccgtagcttcggtcgccactagccgctgcgctgagccgcgccatcgccgccatcggattcgcgagcccgagggccacgccgtcagcccctccaccgctggagccccgttcgcaccgcacgccggtgagcttcgccatggccgccgccttcggccggcgtccccgtcctctatgatctctctctccctctctaatctttcccattgtgttccttaggtgatcccgaagctcggccactcatcgccatcatcatcccgccgctcaccatcattgatcgtcaccggtgaggaactcctcaccttcctctctctctctctcccgcgccacttagccgccgcgccgctgcctagccgctcattttccgccgctagcgttgcccgcactgccgtgtcgccgccgctctccgccgccggtcgccgccttgtgccgccgctgcgtcaaaccgcgccgccgcgcgccatggccgccgagccggcttgagccgggcccgtgccaccctctctctctccagggtttaattattgcgcaataaatcaattaaggattttttttgtttatagtaaaaacgcagtgaatcttctaaaattcatagaaaattcatccgagctccgtttaagcccattcaagtctcagtaaatcaagaaaaatgcaaagaatccattaaaaatggttttgttctctgtttcagtagtcttatagcctgtttgtattattttatcacgcccagaaattcacgaaccagaatttctaagctgaatgtgcattaaatccctgtccaggaccagccagggtacacaaacgacaactgttgacatacaaatccacgtcttacaaaaatagaaaagattacaaatgcagcggaaaagataaaagcgagctaaaccgagaagcttgacttcagtagcggggtgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggtggtatgatgcaggatataaccaaagcaggctaggggttcttttgcataaagctagcatttaaaagcagtagttgaaagcagtaaaacagctgtagtaattaatcaatattaaccaatcactgtccaacgctacaccacgttgcaacaggcccaaccaaccacctgaactacaccagttcattaagctaaactagggtgagactaatcacggtgaatctggttgatcgcccataactgtgggcacggctattcgaatagttttactctggccagaggtgtacaactgtacccagaagacacgattccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagttggacaaccggacaccccggccgacccaactccatcacgcccaccctcgccactggtgcctaggaaagggtcgagctatacttcagatcaagcagttacccactcctgcttgtggtaagcacggtaagtctcccagggtttcccgtgaaccggtccttaattgccatgggtgcgaccagcaaaaccatgcacccacaacccaccattcggtgtattttaattaactaacaccattgcggtggcaccaaaccaaaactatgctcatagtcagagtctatgtaataatgtgatccccttttgtgtactagttgaactaagcatggctaagcatttcctaaaccaacatctaatcattttgataccccagttatcaatggcatatggtaaacaatatatggctgagtaataggacccatcccacataacattgaaaaagaatgcaacatttaatagaaatgcgggatatttgtaaatagggtacaatatgatcaaatataatgcatgacatgccttgctctcgcactaatgagacctcagcaacgtcttcgagaaactgcggatcgacgaaacggccgaaatctacacgacaaacaaagcacacaagcaaaacatactataagactactgaaacagggaacaaaaccatttttaatggattctttgcatttttatgaatttactgagacttgaatggacttaaacggagctcggatgaattacttatgaattttagaaggtaaactatgtttttactaacaaagaaaaaatccttaattaatttattgcgcaataatacccagagctgacgtcatcaaagggggggggcggcgccgacatgcgggccccgcttgtcagcggcacaaggggagagggagggggcgccggctggtggctcaaggggaggggtggtccaccagtctgtgaggcccaccgggcagcggcacaaggcgggagggggagtggatggtggctcggcacggctcaagccgaccgaccatggcagggcggcggcggcggcacacggcctccgaagacgaccggcggacggcgaggcggcggcggccggcgcgaaggcgacggcgcacggccggaacggcggcgtggctcggcgcttgctggaagggaaaggaaaggagggggagggaaggggtcctcaccggcgatgcgagggaatcgggttccggcggcggcggatggcaaccgagtggtgaccgaggtgcgggcgacactggcgagcgcgacggcaacggtttcacggcgcggcggcggctttagcggtggtggcgcgcggccggaggcggtagtaggcagcggcgtgtagggagagcggtacggcggtggcgaacggaaagcgagcggcggccgaggtagctctcacggcggcgaagctagcggcagtgattgcgcggcgaggcgacggctcttgcgacggcggcgtgcggccggaggcggcggcaagcggcggcgctagcggcgagcggcgcgggctcggtaggaggcacgggagggggcggcgagagcgggaaggggaagaggaggctcgggggagcaatttataggtggagggggaagccgtcgtggccgggaaagcctccgatttcgccggcgacgtggggtggagagagagaatggggggattcaaattcgaatcccgccccttgcgagcgcgcgtgcgggccgggagacgcgggagagagggcggcgatgtggggaggacgcgggagcggcgcggtgtgggcgcgggaggagcggaggaggtgggcgcggtggtttcgacggctggaggaaggggacgaccccgacaggtggggcccacctgtcggcgtcccggagaaagagggcgtgagggaggacttcggggaggggaagggaggagcgggccggcccagcaaggggcacgcgggaggagaaaggtgggtcgacggcccaagaagaggaaaaaggaggaaaaagaaaaagaaaaagaagaaaggatttttcctgggatttaaaattgcccttgctcatttttaattggttaaaattatttccaaggctctgaaaattccactaaaaatcctgttaatgtattggagcatggggaacccaagaaaaattccacaatgccatttccaattattaattgcattcattagataggaaatcagctctaggttaattaagataatttcttcgggcaatttatttaaccaatttttaaagcaagaaaaaggggggaaagcttcagggcgtgacatgtttgctttgtatgtcgcatagattcctgctctcccgacgctccggtgtacttcgagatagtcgccgaggtccctccagccgcagagcaaggcaagtcatgcttgtcacttaaacatattggtcccatattgcaaatgctctattattttccttaaatactgcattgttttataatgttactatgggataattacctattgtctcagccatactattggttatcttgttcctttgttagcttggggatataacaagattagatgttcggttagggattgcttagcaatgcttagctcaactagcacacaatgggagaactacattaatgcatagatttcaaattctaatattggtgttggactagagccaccgctctagtgttggttaactaaaatatactaaatggtgggctgtgggtgcatggttttgagtcgcacccatggcaattaaggaccagttcgcgggatgtccttgaagaacttactgtacttaccacaagctagcgtgggcaacggctgggcatgtagtatggctttcctctagctgacgcatccaggcaagggtgagcgtgatggagttcggatgggccctgcgatggcctatgtggctttcggattcacctaggcatgagaggggactgcccgctgtcttgcgaggagtgggggtgaaacctgaggtgtggtgtgtttggttagagggggtaatgcgaagggtcctgtcacggtctctttctggtatgtcgtggtggcatgccggcgcacagaaacgtgttgtggggctgtgtcttgtgggtacagttgtacatctctgatcagagtaaaactattcgaatagccgtgcccgcggttatgggcggtcaatcagattcaccgtgattagtctcacccctagttagctaatggaactggttagtttaggtggtggtttgggcctgtctcaacgtggtgtagcgttgagcagtgattggttaatattaattaattactacaactgttttactgctttcaactactgcttttaaatgcatgttttatgcaaaagaacctttagcctcctttggatatatcttgcatcatacctccccttctggtatgacttgctaattgcagtgggtagtactcagtcttgctctctgttccccacatcagagttgaagttcttctcagttggagctgtttcgaggaagttggtttcgtcgctgccatcaagggtgcctgtggaatggagtcgcccgctgcaggagtcaagtcgtcaggcttagctcgcttttatcttttccgctgcatttgtaatcttttatattttttttgtaagtcgtggatatatatgtcaacaattatcgtttgtgtaccctggctggtcctggatagaggtttaatgcacattcagcttagaaattctggttcgtgaatttctgggcgtgacagcaagtagcatcaccatcgcactgtgacccctactcgccagtccctcgctccttgcgcgactcccggtgctcgcactccgcctccatcaggccacaaggcgctctcaattgttcccttttttttaatgaaccagcacaagacagtgccaatttaattgaatagagcaggagaaaaacggggcttttaactatttgccactcttacggatgttgcttaacgatttgccactagacccacatgtcatagacacataagggcccacatgtcattgacaggatgtggcaaatcgttaattgccatgtcacaagagtggtaaatagttaaatttcccgagaaaaactaatagaacgacaacatcagctaacaacgtgtccgcaatctacggaaggtgactaggaggcgatcttggaagctcatctctaatctgaagcgctgacaagtcctagccaagatcaacgtggtttctcgtttgatctttggttgtgattcgtaggtgttaagttctcttaatctgttttggattgcaactactgctacgtatcttgacgggagcgactcgggttgttttaatctgctactgccaagattgattcttggaagattctggttgacgacaaatttctgtgcaagtgacgtggtaaccctaactctacgtattgttgcttctttgtttcttgtaacctgttctgcgttggtgtcgccgtctaacatcggtgtgggcgatcaaggggattccggtgaggattctacccgcccgaagccgtttgttagtgggacgtctagggtaggacgatgtttactcaggaacatctgtgtttcttgatcatcgtcgacaggcaggacgtgggcttccatgtcaaaccatgaagacgccggcaagggcgaagtgcatatggtggacaaggatcaagtggagaaggaggatgcttgacttgtttctttcggtcatgcatctaaaccggaagataatcataacggtgcgatagttttgtgtcacagcctaattttccatttcagaatttataaattatttaataaattattaatagaatttatattaaatgtttattaatttacaagtgaagttaaatgtgggaaataaaatttcctaaatataaagcatggctggatttaatttttattaaattctccatgaataattatattctctgaaattttctcatatttttcggagctcaattcctaattttaattatacaaagaacatttcagtaattatttaaataataaattaatcattaaattatctggatattattatattaaatactttgagtgtccaagtatgttcaagagttttcttggaattatttgagcattggaagtatttttaacaattgaaagatcatttcattggttaatttatttggaaaagcaataaaatcatccttcctagtcttgggccgaattcagcccattccctcccttcctctcagcccggccgaaagtttgttttgcccccccccctcgctacagtactccatcttcctcctccagccgactgtctcccgtgccgtgcacagtgtcgccgatccccttccaaaatccggccacctcgttgctcctttttccaaattagttgcgggaatggaatcctctcaatctcctctttcttttccccaaaaaatccccaaaagtttctatggagatcctttccaatttcgcggttcaatctttcctttttccggcgagaaccctagactttcccgagtttttcccgtcgttgtgggctcgatcccggcctcccatggctatatatagagccccctccctctcctctttcggccgccacctcctccttcttctgccgccgcccgaaaccttctccccgcgctctccttctctctccaagcgccggcgccgctccagccgcatctcgccatcgccccggccgtcgccgatcagcgccgccacctccatcggctccgcaacgtcgagctctaccccggccgctgttgttttgcgccaaatccaatcggaggtagcccgtcgtcgtgaaccggagcgccgccgtcgccgccgtgtctccagccgccccgcgccgtcgctgtggtcgccgctgctgctcgccgttgcctccgtcaggttcgcaagaaggagctgcaccccgtccgccccttcgtcgccaccaaaatccaccggagctccatcgtcgccgtcaacccgaagttcgccgtcgcgttttgatctccggcgaagccctgctgctcctcccgtcatcgccaagcttcgccgtcgcctccattggattcgcagctgcgaagtgaagcctgtccacccctcggttgtcgtctctcatcgccggaaagtcgtcaccgccgtgtacagtacctcgccgcccttccaagctggtcaccggctatcttctgtcgccgtccgtcgtcgcgtaagtgttggtaaggaccgtcgcctcgcgctctttctcctggtgccctccgtttgcatatttgtgccgtggttcaccggcaaccgccgctcccataccgttcaccggtgtaggtttttccctagggccttaatttaatctaatcttgtttggccctagcgtcgtcgtcgtctccgtgtgttgtcgctggcgtcgccgttgcctcttcctcttcggtcttccccggtgaggcctcttttctgttccctaggtttaatctttgtgtagctgcaatcgtgtcttcgtgtagtcgctgttgtgcagccttagcccgtgcgtagccgtgtgtgcctagccaccgcagccgacccatgcgccgtcgctgccctagttgcatcgccgctgctgtccaagccgccgccttgcgccgccgcttgctgccatcgtgccgctgcttgctgcgctggctctgccaagctgctgctataccgcgtgccgtgtcgctgctgcatgctgccacgtcggccgtgtcgcttgctgttgccgctgctgctgcgtcgcctttgctgcgtcaccgctgctgcgcctgcacgccgtgcagcgttgccgtcgctttgccgcagccgcttgctaccaccgcgtcgccgccctagcgtcgagccggtcattgccgtgcaccgcacccgctgttgtccgctgctagccaccgcgtagccactgccctagtgcacgtactgcagtcgccgcgccgctgtcgtgcatcgctatcggctgtgccgtcaccctaaccctagctttgcgtttccgccgagccgccgcctagccgagccaagtcaccttagtgccgctatgtcgcagctgtgtgtcacttaaacctagccaccgctttagctcgttgctcagtagtcgagttgtctagccgtaggtgcaaccctaggttcctaccagcctatcgtttgccgtacctgggctttaccgtgaatcgtgtttaccccaccagtttagccacagccgttgttgagtcgttcgctcgttcgttcgaacgaggtgttccccgtgcttcgttcgtttgtccgtgttgagtcgtcctttaatttagagccgttcagagccgccgattccgttcgccggtttcggttgatcattagagtgatcccgtgtcacgtagaattgactcgttgagttggtatctcgtgaggcccgcttgccagatcaatccaagccatccaatcttggtcaactctatgtcaagattaatcttagccatccaaaatcaatataaatcatttcctctcttttcagtggcatattatttctttttaatatatgtcatctaccaaatataatctaatcttttccggaggttgttttaatcttttatctcagttataaatcatttgtaaattatttaattaatttggaatagtcttttctttaatagatttaattggaatttaatcttgtaaaatttgtaattaattcatatgaaatcggaatgaggtcgttcaagtctctaaattcatctaaaatcatgatctacatgtttgtttactttatatgtactatttatttggagtttcttagtcttttttctcgttttgcgtgttagcttgtcgtttccgtcgtttcgaaggttcgtgagtgcgttggaagtattcaagaagattaattgaagaccctttattgcaaggcaagtcacacagatcccaaacacagttcctttgagcatgttgatcctatatttaaattctctatttatttcaactgtgtatttattttcgaatgtcaccgggtggtgtgaacttattcctttgttatggcctgtttgcattgattactctatattccttgataccttgggttattataatttgattagttgagctttatatattggttcagctagatgttagacatcattgcttagccatgcttagaaacattagcacataattgggataactaatgtttcactattacttaatgatggatatttaatgatagctcacgatggtcaatcgtgattggttaattaattaatgtgcttactaaaacttgataatggtgggttgtgagcacatggttttgatggtcgtgctcatgacaattaaggaccggttcacgagtttcggttgtgaaacattaaccgtgccaaccacaagccagcatgggcaacgactttaccttttgtataagaaggctcattgcggaacaccagactgagaagtggtggagataagcccacgggggtcgctggggagtccatgccttgtttataagggggtgattatgatccaggaacggtgcactgctttaggttgagttatgcgaggggtcttgtcacaatcactcatcatggtgacgtgtctgcgcggacacggtgccatga

SEQ ID NO: 37774 - DNA, 8471 bp, Oryza sativa
ctttgagctctctccctctctatctcaactcctccttgttctttgtgactgttgctatttaatacagtcacagataaaatccgcaagcgcatggatataccgatgtagcacttccactatggagtattccaagggtatcaaatccaagggaacgtgtgtggtcagatcttcctccggttcatccaaggacaccaagcaaatgataggccaggatagagaggatttactagtgaaaaacagtgtcttaggaaatcttaactttaatcctaatgcaatactacaggctctggcaacccgttgttcccagatgtcgctctactacgtacccggacagggaggacttaagtaatctcgagggctatcaccacctctacatccacctcaaacgtactgtgggatacgcagcaattactggataacaattacctaaacaccacgtctaagcaactactatctactccaatgtttataactcacaaaagcaatcactatattttagttgattatagtgaacaataatcccgtatgctattcaggaactaaccaagagataattatcacaagataaatctaaattactcaagaagaatattatattaaattcagagtaataaacagaataaaagaaataggagaagattaccgatagctccggaattcttctgactcattctactctactctcttcctattctagtatacaatatagtacaatagatcctcttataattcagctcaagcttagaagtgtatgtgagagtgcatgaagtgaggtcctttcataaggcagttatgacggttgtgagaaggggaaatgtccgaactgctccgcaaccgtcattgggagaacatctagagcgtccacgccaaaccctaggatcaaccgcgatcaggggggttcggccgaacctaggctgggccctcctggcctggccttcgttcagtggactccctagaccttcctctatccatttctcggagttttgggttgattcactgatgtttcgatgaagtacacaacccctccttgtatggatgcataattctcctcactttagtttgattttcctcccaacttcagcgtttatcatctgcatacaaatatacaccaatacttgtggaatatgagagattaagaacctatcactatgttggatgttttattatctaaactttatgcagatgttggcggtatgggattggcatttatcagccgccaacagtgacttggatctttgtgtgtggatttggagtttgggagcctggtgtgtgtttcttgatcttgagcactaggatttgtccaagagttgtgtggtgtttattactcttggaggttgaggactcctagatggctaggtgtcattcttggccaccgatctacgtgtggttggacaagagaagtttgtgaaggccggatcgcgcctccgcaaggaaagagatacccttagtggaaggaggagtgcatttgtccaacctcatgaggatagggttgaaaaagacccggctctttgcgagcccctcaacggagactagaatcccctcaaggatttgaactctgggaaatacatcggcgcgtaaacctcggtgatatcttcactctctttaccttcttgttccattgctttgtgctatgctcatattgttgttggtcgagctcacctctttgcctgtgtataatctagagctcttaggttgttctcttgtttgtattgttgttgtgcaggtcagatagtctgatctcagttcagacaatccgatcacataggactatccgatctgatatcggacaatccgaccctgttttgttttagcttccgtatttatttttaaaaaccgcctatttagccccctctaggcgacatcaaggtcctttcaattggtatcagagccaagtctctctattaagggctttaccgcctagagagtaatgatgtcgactagtggtttggtagatatggttctttactccttttggatggttcaaattatgattcttggagtactcgcatacttgacaaatttaggaccatgggtccttaaatagagcgagttgtagatgtgagcatttctcctcctaatgataaagagctatcatttgaagaggaagagaaatgcatgcatatcaatgctcaagctactattgttttatttggtgttttaagtgaagatgtatttaaaaccgtcatgccgtttgaagatgctcatctcatttggaccactgtcacaccctgaaaattcaaaatatataaattgttgtttaattggaatttttagaaatgattttaaaagcctagaagagaagatctaatttttaatcaataaattccaacataaaatggggccagataaaatttcaataaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagccggcccagtccgcagccgcccgcgcgcgcgcgtcctcgctcgctgacaggtggggcccgcctgtcaggtcgtcgtcttcctcgcgtcggccgccgcccgaaaccctagcgccgcgccgccgccgtttccttccaaatccggccgctcctttccttctccggctgaatcaaaagaggggaaatgatcctcgggatctcctctaccttttcccctttggaaacatcggctaaatcggcttggaaagtgtttgattcgaggtcgaatcggatcggcttttctctctccgagcccgatctttccttctcgtcgccggtcgccgtgggccttcgccgtcgcctcctagcccctttaaaaggacccccgagctctcctctacccgccgccaccctcgccttcgcctctcgtcgtccgtagcgccctagcgccgagtagcctcgagccgccatcgccgccgtcgctccagccgtgcgccgccgccgttccggtcatcgccgtcgctcgggaagaccaccgtcgtggtcgccaagtcaccgccgtcctcgtccgcctcttcgtcgccgccggagatcgtcggagcaccgccgtcaccgtcgacccgatctccgccgccgctttgacctcgtcgccgtcgccgtccgttcctcttccgccgtcgctttggtcgccggtgagtttgccgtgccgtccgctacccgttggtgtcctccgttcgtgccgaagcgccgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcatgaaccgccgccgtgcgcccggtccaccgcaaaccctagccgctgatgcaataattccctttttcttttcaaaaataattcaaccctttgagcatgttgatcccgtttaaagctattgtttctattcaactattgcatttattttcgaatgtcattgggtggaattaacctattgtttgctatagcccttttgttcttgattactttattccttgataccttgggttattataatttgactagttgagctttatttatattggttcaactagatattagatataattgcttagccctgcttagaaacattagcacactattgggataacttaagattcactattatttaatgatagcttaatgatagttcacgatggtcaatcgtgattgattaattaattacttgccaactaaaacttgataatggtgggttatgagcacatggttttgagagtcgtgctcatgacaattaaggaccggttcacgagttttggttgtgaaacattaaccgtaccagccacaagccagcgtgggcaacggctttatcatttgtatagcatggttcattgcggagcaccagactgagaagtggcggagataagcccacgggggtcgctggggagtccatgccttgtttataagggggtgattatgatccaggaatggtgcgctgtagtggattgtgttgtacaagggatattgtcacaactcctttccgaggtaccgtggtggtattgaggcacatggtgacaataacaaattgataatagagtacaattattactctaattaataagcgaataaaatatcattatagaggtagatagttcctctcaatcaataaagatctaagcagcggaaaaaaataaaataaacggcgcagacggctccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtctcatttgcataaaccgcatttaacaaatatttgagaatttaataaaacagttaagtaataattaatcaatattaatccaacgctatacaacataccctgttgtataggcccaaccattctgaacaaccatcccggctgcacagttctatctccaaaccaggaatgtaccattccaaaccaggagctaatcaaattatttccaattatagcatcatttactatggtgagaagggtgagactaatcacgaaagacattgttagacccgcccataaccgcgggcacggctattcgaatagttttactctgatcagaggtgtaccactgtaataccaccacgtgcctcaataccaccacggtacctcggaaaggagttgtgacaataccccttgcataacacaatccactgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaaaagtgagctaatgtttctaagcagggctaagcaattatatctaatatctagttgaaccaatataaataaagctcagctagtctaattataataacccaaggtatcaaggaataaagtaatcaagaacaaaagggctataacaaagaataggttaattccacccaatgacattcgaaaataaatgcaatagttgaatagaaacagtagctttaaacaggatcaacatgctcaaagggttgtttgggatctgtgtgacttgccttgctggccttggaactcttcaaattcttctccggcgaaaacagactctccggaaacaacagaatctaaacaaaaagaagcaaaatcaccaaaacagcacataaacaagcatgaacagtacatatggatatttttaacatgtagatctcaattttagaaaaatttagagacttgaaccaactaaatccgagctaagatgaattagttatgaatttttgaagattaaatcggattaaaacacttaaattgattttaattgaattatgacgtaataatgaattatttttgaaaaggaaaagagggtttattgcgtcagcggctagggtttcggtggaccgggcgcacggcggcggttcacgcgaacggacggccgagatcgatccatccaaaacggacggccgagatcgatcgggtccacggcggctcacggaagaggacgactatgacgtcggcggtgacgtcaccaccggcggcggcggctcggcggctcgggcgcgcatgctcgccggcgaacggcggcacttcggcacgaacggagagcaccaacgggtagagcgcgacgcggcgaactcaccggtaaccaaaggagcggcggaagaccaacggacggcgacggcgacgacgaagaaacggcggcggtcttcgggtcgacggcggcgatggcgctccggtgatcttcggcgacggcgaaagggcgaacgaggacggcgacgcgacggcgaccacgacggcggtcttcccgagcgacggcgacgtctagaacggcggcggcgcacgactggagcgacggcggcgacggcggcgctagggcacacggcgctatggcgctacggacgacgagaggcgaaggcgaaggtggcggcgggtagagaagagcttgggggtccttttaaaggggctaggaggcgacgaagaaggcccacggcggccggcgacgagaaggaaagatcggggtttgaaggaaagagaccgatccgattcgaactcgaatcaaacacattccaaaccgatttagccgatatttccaaaggagaaaaggtagaggagatcccaaagattgtttcccctcaatcaatttcaccggaaacaaaaaggaacggccggatttggaaaggaacggcggcggcgcgaaactagggtttcgggcggcggcggccggaggttgacgatgaccctgacaggtgggccccacctgtcagcgggcggacgcgcgcgcgcgcggcggcggactgggccggactgggccgaggagagagagaaaggttttgggccgactttcggtccaaagccaaaagaaactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaaattccaattaaacaacaatttatatattttgaattttcagggtgtgacagttattgtgtgcctcggctgattcctggacgagggttcacacacatgtaagcgtttggaattttggatagaaattccgggcgtgacaaccacactcaaggagagatacgacaagtccaaatgtgatgattccaaatgtgatgatgtactctttttggaagaagcacttgaggagtgttcaacttcatcaccaaattgcgactaccttcgatgatcaagataatcatcccacaaccaccttatcatcaacacatgactacattgaaggtaatgaattggtgtgtaaggttgatgatcgtccaattctcccattggattccaacaacaccgataatgaatttgtcatattctattgtgttgttgactcatgcatctcacctagccccaagtatatgtgtgaggatgatatggataaatgctctacttcatatagtacttgtggaactaacctttagaagggagaagtaaatgagcgccagcggacaagtgaagaatccacctcaccaagatgctcatcttctatttccaaagatcatgcttgctttatgggagaagatggtgacttcgagtttgatcacttgagcaagaaggatattacaattgtgataaagctcatggagaccattaagaagcaacaagcatgcctcattaagaagaatgaagatatcatgagtctaaccgaagaacacaagaaacttaaggattttcattcttcattgattatgaggtatgaaaaattggaaaatgaatttgcttgtgccactaattctattgcttgtgtagcatctttggagaagcaaaatcaagagcttaaatctcaacttgacgagatcactaacaagtatgtggatttacaagaaaaacatgatgaacttttgtgttctcatgagaatcttgtggattctcatgccatgctagaggtatctcatgaggtgatagttccaatggtaaaatcctatgagcctcatgttcaagttgatctcacttgtactaaccctagttgctcccaagcaaatatttccccgagcactatatgtgacttggattgtgtaggcaaaagggagaagcaaatagattatggacttgtgtgcattgctcaaccttctcaagataaccatgagggcatggtgaagaagcttgtggaggaatcaaccgtggcttgcaccaagatccatcaaagggatagcaagtccatcaatgcttatatcaagggacgaaatcaaaagatgatcaagagttccattacttgcttcaagtgcaagaaagtgagacatcatgttagagattgcccttggaagaaaggaaataagttaaacaagaagaaggacattcctcacatcaagtgcttcaagtgcaccgaagtgggacactttgcctcaaggtattcttgcacattggatgaaca

SEQ ID NO: 37775 - DNA, 3252 bp, Oryza sativa
tagtggcaggtttacattgaagatgaatatatgtctatgtatatataccactttgagaattattataagaactaatatgaaagaaaaatcttactatcaatcttaatttgcattgatatatatcccagggtgaaaatttggcatggagatgtcaagtgctatttgttatgtatatctatatatcaaggcccagcctatatattaggcccatatagtccctgaggactctatatatattgtcatccagagagaaaaggattgtattgattctaatccccaaggtaagtaatatggtatcagagccatggattagggttaggtttgtaatcatctcctacccacgatccatcctgctcatcacggcaccatctcaccactgtcaagcctccttccggtcatcatcgaggctttgcatcctctgcatcatcctcacgtttgggagcccaacctctggtcttcatctaggaacacgctctgcaatctgctctggactgaggactgctctggtttggatttaattggtaactggtatctttcttgtttggcggctgcggcggctattattactactatactacatcttgcacctcatcgctgcatttattattattatccttcatggtcacaacaataatgagtggtctttttgtgtagagactagctttgaggggtgatggttgaccttttcatttaaccgacgatccacctgcgcctaaaactggtgataaaactaatgatactaatgcagctgaaattaaaagttggaaaattaatgatggtaaagtgatggctgccatttttaatagtgttaagcactccttgattatgagtctgtccaagtttcaaacagccaaggctatatggggttctctgaagcaacgttatgttcaagatagtggtgctcttttgcatactctcatgcagcagactcatgccattgagcaaaatggtatgtccattgatgagtactactctgcatttgatcatcttattgacttcaatggtgcctacctatacaactgctgcatgtccagcacaccaatttcttgaaaagtttcttacatattgctttgttatgggagtaagagaagattttgactttatccgtactcggctgcttcacagttcctctactctaaccatggcacaggcattgtctgatttacttgctgaggagacacgcctcaaatctctacctgcaccatctgtgtcagtttctcatggtgtgttagcagcttctcagaggtttggcgcatccagaggtacctcttcaatgccttgtaagcattgtggaaagacaggacatagtgcagagaattgttttgctcaacacccagagaagttggctgagtataactacaacaaaaccactgttataagacatttgacttaagacactctgtaagttgtctcaactttgagaattacgattaaaatagaggcgacttttgagacgctttacaagttggagacatagtttaagacactttacgattagcataagactacatcgtttagatatgaatattgagacgttttcagacgtctcatttctaagatgtgtttagatatgaatactgagacattttcagacgtctcatttctgagatgagtttagatatgaattttgagacatattatatgcatgtcattgacatcaaacaatacaattattatttacacagaaaaaaagaatatttgaatcatttagattccatcggaaaactacataattccttatcatcttcatcacataatattataattatttaatcatttaaatcatgagggtttccgagactaaaataatattataataatttttgaatcattcagactcaataaagtctctctcaaatgattaatattataatattatttgaatcatttggactgcattgaaaaacatgaaaaataatgtactcgtccacagaacgtacagattgcgataatggggcactaacaagattaacgtgaataattaagcagcaagaatgtgcttctttgttagataggataattacaaacatatacacgtacttggttgatagaagtgggctggacatgctgcaaaccactttatttgttgggcgcacgatttgctttgttgggtgcgtatttgtgagaattcttggacgatagtctccgcaacaacatcctgaacaataaccctcgtgaacaatccccttggtggcggcgacacaactcacgccaacagattgcgcctccgcatctcgcagcgcctcctccgtcgtcgggtgcggggttccgccgccgctcgcgacctgaggggcagggcctccaccggcagccgtgggcataggacctcctccgttcggcagttcaccaacaggtacagcttctccgccggctggcaagcccaacgcatacaatccattactccatcatcaccattcagcagccatttggtccttttcccttttaagtctttatttggattgggttttgttatgtgttttcccttgtcatttagatccgatgaattttagaattaaaatcttaatcgcttatctagcactagtagtactgctagtgcggctatactggtgcagattcatcagggtcactagtgaccaagcattggagtacattatccctgagaggcttgtgagcttgaatgcttgatagtactaacagattttggtgcatggaacctgtctgggatgtacgacttccagccacatcgctgactatgaatgcaaacaacccttaaacttatatagctattgaattgaacttgatatgcagaacaagtattattctaattatctctagtgatgtgatgtcatttggctaactctatttacattacatgcttacatatattttatgcattatgttttcgctctgtattttttattttttaaaatatatatagacgtatccccgtatcggtgtttttaagaaaatgacgtatcctcgtatccccgtaccgcgtatccgtatccgtattcgtatccccgtatcaaggtaacatagatattacgtagaaccaagttaagacaacttacgagagagtggatccacgcatcttatgaaattttgctgtgaaggtggttctgaatgctagatatcagttcccaaaagatgaaactacctttcaccagtggtattttaaattatggttatgaaatttgttaactattaacatagttatttctatgcgcatcttaatgtccttctcaaatcacccaatcaatttcacattcttttttgtataactcagaattg

SEQ ID NO: 37776 - DNA, 870 bp, Oryza sativa
cattaaaatggagaggtcaccttgtgtttatcctgacaccatattttaacaagaccacgccattgatatccattgacaccttttgggacatattttaatatatcgtttagagtcctcacatcaggattaaagtatcttccctttaaacggcttttgtaagatctccaccctttatcagctttcattagaatccagtctcttgtaagctgcttcgtctcagaagggtacacaaatttcatctttaccatgaataactaaaagttagatctgaaataagcatgataatatttgtttacattaattaaaaattcacctccacgtcagcgactatgctctcctttggtcccacaaataagtcatggtcccattttggaatgtccaatggtgcaaatgttgaattctgtgcaagcttaccaagatacgagcctagaacagaacctgatctatcatttggaataccatgttcatccgtctctacaattacctttccttgcttcagttggtccaagttttttacattaaaatttcctagaacccgtcgtacctccccatttggccctacatttaggaacagttcagctatgggtgataggaaaaatcatatatatagacatatataggaagaacagattatattaattggtcttttggctgcaagaggcaactccgtgattatgtcatcattctctgaaaggtcttgctcactatcttctgtgggttgtacattccctgcatcttgagcttcgagatgcaaattatcgtcattgaattgtgcatctgcttcatctagagcttcaaagttgtacagcaaattttcttcttcagcttgcacatgtcctgcgctctgtgcatctaggttcaacttccgta

SEQ ID NO: 37777 - DNA, 923 bp, Oryza sativa
tgattgcctgaaattaaggagagaaggcgatgtactaacctagatcgattcaatgcgcaacaaagaaacagcaagaagaatcagcagaggttaattgacccacctgtgtgcaaggaagaacggaggaacagcactgccgggcgccggcggcgggcagccgtcgtgtgcaaggaagaacggaggaacagcaccgccgggtgccggcggcgggcagccgtcgccagattgggttttccaattctgttacaggagagtactatggagatggagaggtttagggatgtggcgtggaaaagtaggtccgtgatatatatacagtaagctttccaaaaaaaaaatgccgccaaaaaaatcagcctaggcggcaaaacaaaatatatttaggaacggcagtcgatatatataccgcgaacgcttcgaaaaatatgccgccaaaagaaatccgccttaggcggcaaaacaggaacgctactactactactacacgtatctttacaaacatacgtgtagagaatctcaatacttgttgtggtctattggttaacaggtgtttttctgtgacatacatacattgttcgagctcaaaagttcgttgtatttttgctttttttactttgagctggatttgcatgactttgcttgagattttttttaaaaaaatagtaaataattttgtatgttcatctcagatatttttaaatatattcatgtcagattaacaatctgaaaatatatttttatttaatctgggtttgcatgactttgcttcagaattttttagtattaataaattaaagtccctgtccatctcagatgaataattccaaaatatattttctctaatctggatttgcataagttggcttgagattttttttggaattagcaaataatagtttgtattcggaattggtcaggggcgg

SEQ ID NO: 37778 - DNA, 8418 bp, Oryza sativa
ccccacaccaatattacaacttcatcattcatcaatattcataatcacaatattcacaatctcaattcataaatgcccattttaaccggattcctaagtttgtaaagatgtttgaataataaaccacataaaatgatctcaaatatgtctttcaataatattatgtaatcatgcttaaaagcatttaacatctacccacgagatgttaaaagagtaagacatcatgcatcaaaatttaatatgaagattatatcaagttttctatatgatcaaaattttagttatgtcttgccttgcgccttaagattttccgcggcttcagcgtagccatctgggtccacgtcagctccttagattcgatagtcgaactagttgtacgatctaacttacggatatgaaaagatagcaaataaagcctataagcaaattgctacaaagaaacgatagaaccaaggaacaaataaaattggagctaggcgagaggagaaatgaatggttcaaaataaattttgatttaaaaataaaataaaagagaggtgatggtttctataggttggaaattgaataaaatcgaagaaaggataattttggataggtggggtttatttggtggattcggtttctagtcggtgctagagtaaagtagcacaatggctagatatttggattggttagccgatgctaaggatggacagcataacggctaaatatcggctcgtatagtcgatgctacaattaagcagcacaacgactagggagttgagagattggtgcaggtttacggaatagtgatactctacaatcgtgagtgatagcagagcggttaggattgcacagagccaaaagctagggtgcggcgtgctgtggaggtcgagggagtagtgaggctccgaccattgtatgcgtcgaagcgtagggtgcgaagagcaacacttcgaccttgggattaggttatgccgaggtttatgaccaacggtttgacgctggggattatgaccacgcgaacgtctccacagaaggtgtaaagtttccacgacggctgtttagtggctatgggatgaaatagttgaaggttttagaaataaaaggggataaataaatcaaagaaatttaaattcaaaagggggttttaaaatagattaaagaaataaaatttaaaatgatattttaaaagaaataaagaaaaggtaattaaataaataaagagaagatatttaaagaaatcaaatggataatttaatatttaaaggaatcaaaaggataaactaattcgaaaaggctttttaagtaaaacaagaaatttaaaattaaagggatttaagataaatcaaataggtttaaattaaaaaggtatttaaataaagaaatttaaataaaattttaaaataggaaatttggtatcaaaataaagggtttgaaattggatgaatttagatcaaagaatttctggaattggatttgtggtttggaatatatgggctcctagagattgaaaaacaattaaatgaaaaaggaagttactattcagtggggcccacttgtcagggtcttcttcttcctctatttcttcttcttcttctctcctcccgtcttcttcacaggcacagagaggagagggaccggggcgcggcaagggggcgcgtggaggagggagatggcttcggtggccgggctcgacggcgacggcggccgaaggcggcactaggagtggaaaggcgaccggtggtgtagggcaaagggattggcagctgggtgaggaggatgttgggaagagagagagagtttggggctcgggtttggatggggaaaatggaggagttcgccggtttatataggcagaggaggtgggttgtgggagagagattgaggggttgtttggttcttaactaacattgccataactcactttaggcactgttaggcaagtttgccacactttttgtggcctacaaattgtaagccacacttgtggcaaagttaggcaaagaattaagtctatgacatgtgaggtaagatggtaagaaagtgtggcttgccataactatggcaatgaaccaaacacaaggctaaggaggtgtggcaagttgaagtaatgaaccaaacagccctgaatacggcacggctcggcgtcgaatggaataaaaatggcggcgccgggtgtcgagctccgattggcgacaaaggggcggctcggtagtcggcgtcggcttgcggtggcgcgtggctagtgatgcggcgcggcgttgtgcggcggcggtgaagacggtgggcgacggcggctgagcagcggcggccgcggaatggcgctggcagcggtggctgtgggggagacatgaggtgcccccggtttcggtaaggtggcgacgtggcggcagcgggtggctgggcgggcgcaaaacggcagcggcatcgggaattggcgagacggcgacggcgccgtggttgtagacggcggcggcggcacgtccacagctaggaaaggaaggaaggaagggaaacagactttcctgattgggctaaaagagggaacttcggcccaaattaaacagtagcctttaggaattttacaaggagggttttaaaagattttattggagataaaatttaaaagagaaaagtttggggtcctttgaactttataaaaataatttaaatataaagtttttaaagcaaaaaggagtttgaaaaattttaaaataaaatcaaagatatttatttttgatatatagattttaaaaaggacaaaaataaagatgctccaattttaaaagaattcaataagaaccaaaagtaaaaccttcgcaaaagattttctctaatattttaaaatagtaaaatgagaaggaaaggaaatacaaataatttaatttctaactttggataaatttttgggatagtggcaatatagatgaaagggataaataggactttagcccccaatatatgtggtacgggtttctggtgatttattggtgtgctaaaggaaattcggaatttttaaatggaagggattgtaaataggtttcttagcacaagagcaatcattctaggaatatattattctttgtgccaaggatatgatcaagtcataagaatcaaattggtggatggatcaaaataggaacttgatcacaggataatttggatcgattaaaaggaaataaagttttttggggataggtttagatagaggtctgatccaaaataaattacaacaaaaggagagttatattggtttaaccccaaggataaaaatggttaatgggatataacaaagagtcgggtcaatcgggaaaatattggcccaagtagactgtggaatcttgaatggataatttggaggaacgagatttcaagggaatatatttgtgggagtatagatttggactcggaagtatatgtggatgggaatttctacaggaataggattggtggtagattgataaattctaaaggttgggtatgttgactcaaagggggattgaaaaggatattttatggactctgggaatatttaggtggggatccaaaggaaaggtatcgacatttcatgtactctagagatatttgggtagagttcaaagagagagtattaactttgaggaaaatggaaattgtactctagggaggttagaggatgacatttcatgtattctggaggtagttgagtggagatcaaaaggaaagtattggttttggggaaaaataagaattggtatttcatgtgtttgggtagagatcaaaggggaagtatttgatgcaagataaaactggatttggaggtagtgttgtaagctctagatgaaaaggtattaactctagagagattgatatttcatgtgctctagagatggttgaacgggaattgaaagggtatttgttggagatgttcgggaatagattcaaaggataatttagagccaaagttagagattaaagaaaataaacagagaggttttgtaaaatttaaaaagagcgattaactttgcaattaaagtttaagtccagaataaaagaaaatattaaaagcaagatcactctaatgcaagaatcgagaagagcatgacttaaaataattcgcaaaaatttttcctgaaattttgagtccgttacactttccgagacatcagactatctgatgttaaatcggagtatccaatattttagaagaaaaacttcgtcctcaaacagagactcaagttccatgaaatttcggagtctctgtgtcatcggactatctaatccggcatctcatactccgatacttagaaaaactcactcgataggattttttcaaatcaagatagagagtgaagttctgtgaaaaatcagatagtccgatacatcggatagcctgatttcaaatcggatagtctgatgttgctcaagtaaaaatgctataactttttactccaaactccgatttcaaagatcttggactctatagaaagctagttttgtgggctatcaaacccaacataaaacatggtccaaaatcttcaagagattttaaaaaaattgcaaagaaacccggtgtaagtgttgtgacaagtgaaacaactcaggatttaaattttggcttaggtttttcaactcacacaaagatgaagcattttgagcactagtattcaaccaattatatgcatgtggtatccccttaatagtacggcatcctaaactcaaatgtaaaaggaaagttataccaataggaataccttcacaccaatttatttcttcacttggaggattaccaatgtcaaggtcatttgatcatcgggaagatctcatcttcttgatctttggcatttcatctttcatttctcaaatgattgatgcagataattcatatcttcaaatggcctcgcacggttcatcacgacacagtcttcactcgcccttcaccaccggtttcggttcgtcggcgccaagccccttgcttgcccttcaccaccgcatggtccatcgcagctgagcagcgcttgcgcttcaccgtgttgccataggtagtcacttcatacccacatcttcaatatcttctctttaattctcatccatcgataagtccatttcctagcttcttcatcggactaatcacttgcttatacacttaataagtgcattagtcccttaatcgtttgtcatcaataaacaaaaacccactaggagcatagatgctctttcagttacatatatattttataaaaactaagaattgctaatctaattgtataattcaaatatgtttcataaaacaataattgcaaaaaagaagtacatgtaattcttgtgatgctcgtgactttcattgagttcgggtagaatcatcgagagtttccacagtattcggtgcatcgtactaccgtactctcagggttatttgctcagtgaattatagtcgaaaatacccattgttgctcatagttcttgttctatgagtgatagcgtgcaccataataatcaaaaactgcttccttgtgccaccaaaagagtgttaattcgtgcatccacttagcatactctttcattagagtagcttggaggtaccaacgagagatagaaatgcttgctcaatcacatcgagttagtgattagaacactgatttgacggtgtcatggagcttctaggtccattataatttctacattgaatgtatatgtcagatatactctagatttagcaaacttctagttcacgatgtcagtcatctttaattaaaattcccgcaaataattccaatatattttatgcaattctatatattttaccgcaaagatattaattaaaaataataaaagcattacaaataataaataatcataaatgtgataaataaatttcataatcataaataacagaaatataatttcagtggattttgcaaatttacaatgccattcaaacaaatattccaaatacatagggtgatttgtgtattttctagaaatttcagggtttaaaatgcaaagtttccaatgcagaggaatatgcgattaattttcggaaaccacaggggcctttttgcaaatcctctagagattctttctttaccttcttttctttccttctcgcttgtctttccttttctttccccttcctcccctgatggcgccggcgggtgtactggccgatcaggcggccggtggcggcgcggcgggtgcagagactagtgaggcactgcggccagccgtgggcgtcgcggccgggcgacggcgaggacaaggtcgtgcggcggctcggtgcgatgcggaggttggcatggcatggtggggctatgcggcagcgcggggctcggtcgtgcggcggccaggggtcacctcccccctcctctccacctgtctcttgtcactgcctccacaggttcaaagattaggctatttttagggaatttttggatttgctttttatcttgagttcttgtttttcccttgttttgttatgcatccgatttgattgtattgaagctgtgaaacactgattttaaaaggtgcttgtgtaaggttggattcttatgctgattcttttgttatgacttggtttccattgtccgattctgaggatgcaaagtaacgattaggtggagcgactggtgcaacccctaacgggtgaacgcgaaagtgacaaacaaaaaatggacggtgacggttggaaaattacgaatcttttaattagttaagattaggatatttaaattacatttaataacgaaacaagttataataaatggtacgtacataatttttcagattaagacaaatcgttaagaattatgatattctttaaacctaatttatactaatttaaataattccgtatatttaaactatagaattagtaattcattataaggatcattaagatacttaccaaggcctccttcaggatgtgagtgtaggatcgaatataagaaccaaccctaccagagagatgaatggtaggaacaccaaagcacagtattagatctttttatggagaaataattccaatcttttttggaattaaaatattaccctaaacttgacgaagttgcgccgatcacactattagatcgctgttggtttgaccgcagtactctcgccggtctgactccctgcacatcgccgatctgaccgccaattggaccacctccatgtcaccagttagaccgcataaaaactccggtaaaaccaactctcttccggagtttgctaggtcagaccgatcacacccctacagtctgactggcctcccagtccgatcacgcatcgtagtctgaaatcactactcatcgtattttcaaataaacacccacctttaacaattgtatattaaatcaacatcttgattctacagtgggattagaggaattttaagaaaattgaactaattcaaatgaaaatccttgctataaaattcatgcgttcaaggaggcataaactaaagataccctcgtcaacgtggtctggccattgtactcatgttcaaaggaggaaatttaactatttgccactcttatgacatggcaattaacgatttgccacaccctatcaatgacacgtaggtcctcatgtgtctatgacatatgggtctagtggaaaatcattaagcaccattcgtaagagtggcaaatagttaaaagccccgttaaaaggagcttgtgtactagctaatggttacacttaaaaaaaaaattggctcgcaggattggtaagcccatgcggtacattatctttacgaaacggatagctctacaaacaacaaaactatcagctatgatctattgtttccacaacgtccaagttacaaaccaaacacccctaaacagggtaaatcgatgaaaccataaaaatgaaaccataaaaacaggtaaatcgtgactgtgcgcgggcatcacatacaagataaaacattctccactgctagacaacaaaattacatggctctagccagtatctcaggagaaatattacattttgtcttctcttgttcacacgaatcacaaaattacacccaatcttaagatgtgcacaaaggaaggtatgatgaagtcagtaagtaaagaggtgcctctaagaacaaagagaaagaaaaaggagcagctacaaggcgtatttcccagggtattgcgtgcttgcactctttaatgttcaaaccgcttgatcgaacaagcaggcataaaatctgcagctcatgtttttatgcgcacaacaaaagaacctgcaatatttcacataatagtcatagctgcaaaaggcagagggaatttatggtacaaaactacaaatggagaaatgtgttataattctcaaaactgcaatcatcaacgaatagtttaacctagagtcatgtactccctccattccatactactataagacattttagttttgttataagtcaaacttctcaaaccttgaccaagtttatagaaaaatatgggc

SEQ ID NO: 37779 - DNA, 792 bp, Oryza sativa
  unsure (1)..(792): unsure at all n locations
cggctgcntatgtatgctggtgcaccgcccggcggncgatcttaactagtggatcccccatcaagcatatagccactagctcaaaaccctatacaggtctggtggtatcggattccgtaggaattactctcatctgctatggggcccatcagctcatccgattctttatatgaatatctcgacacttgcaagatcaaacccaagcccgcatctcatcaaccttaagacctacatcggagctaataaaatcgcccaggacgtcgagttcgtcgacttagttcgcgccaccacagttcctgtaccatgggccaaacgcggatacctcgtcatactgtgtcttactccacaaacagggacctgcatgtgctgactactacagaactgtcatgacaagggtgagcctagtaaacatggttgcggagatcatggtccagcctctatattatcctgcccatcatcacgtaagcggccctataacacgcatgcttgaaggggccacctattgctatcaccaccatcgcctgtagaacggtatgaatgttttaaacctccaagtgaacctatcctgccaactcgacatacgtccgactggtagaactactactgatgccgtaccggaagaaaggtgatgacctatagtctctaatctagtccatgcagcttaaaatagatcgactgttgggtgttgacgacaagaaaatacccttactctcctcacactgatgaatctagcagttaaaggcaaaccaatgatgtagacctccaagaacaatttattcttgagtcgaagac

SEQ ID NO: 37780 - DNA, 923 bp, Oryza sativa
  unsure (1)..(923): unsure at all n locations
ctgactgggccaagcacttgattggatgaggcctcaggcagctgggtaaaggccgctggcttcaccgtcgtccttttccccgtcggcgttcgcatcaaccttggtcggggtcggattgggccccaccccctcccaccgtcgacgttttgggggtcagcgtcggcatcagcctcggtcgagttcgggctcaccccccctcccccttggcgcacaagtaagccctcggtcgagtttggcattacagtagcttttttagcaaaacatttgacaaacccccggcgcttgcagttgcaggttgcgtcccgcggcttcctagcgcaccctgtatatacaagggacaccggcctctgccttaccccaaccaccacaccaatctcctcccatttgaatcctatctaacaaatcgcatcgcccaatcggatcggatggcttccgctgccaacgtgaaacttgaggatctcggcgccgccgtcgacgagctcgaccagatcaggcaagtgcttctcctcctctccccttcaattggttctagtcagcctcgtacgtgaccattatttcatccccatttccttgttctgatttcccacccgtggaagttatcctccccggtacacagccaaagattttnngatgttaatggtggtggtgtttgcagcagcggatcttagagctcatcacctcgtggagcacacttcaagctcgagcgttccaagctcggtcatggacgttcaatcactgcttccccaagccatgaccatgagtatctccacgcctgagctgctcttgcccctcggcgaggggactctggacgacgtcgacgacctcctcacgcgcgagctgcgcgtgccgttcttggctctgggcgccgccgccgcgccctactccggcaacggcagcgacggcggaaaagcgcgcgagcacgg

SEQ ID NO: 37781 - DNA, 317 bp, Oryza sativa
cactggcttctccacatacgttaaatcttcgcgaacttcaatttgctctgagtcggcctgctcggatggcactcgaaggcatttcttgagttgcgacacatggaacacatcatgcacgttgcccaaggaggcgggcaactccagctggtaggcgacttctccgcgtcgagcgatgatacggaagggacccacataccgaggcgcgagcttcccttttgtctgaaacctgtgcacacctcgcaatggcgtgacccgaaaatacacaaagtcatccactgcgaattccagatcacggcgacgggtatctgcataacttt

SEQ ID NO: 37782 - DNA, 613 bp, Oryza sativa
aagctttggagaagatgtcttaggtggagtcctggcttataccccagttgagcgcctgtgaagatggagccgtaggcccggtagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgagcgggaaaaggcaattttcccggtcgcgacaggggtcgatggacattctccagggcaaatgaaggctacacgagctgcggcccggtagtcgagatgtcatacggcagagggttggtgccctgctgctaggggctcagtcctgcctgcctgtcccgggggttccggccgtaggcgggattgggtcggtactcttgtctatggctaggatgggttggaaactatgtcacgtcttcggtctgtataccgtggtggtatgtggcacgtggttacacgtgaggaagatgtgtcttgtgggtaaagatgtacacctctgatcagagtataatctattcgaatagccgagccctcggttatgggcaagccgagcaatggacccaagtcag

SEQ ID NO: 37783 - DNA, 8045 bp, Oryza sativa
ctttgagtgtgctgggccgttgttgcccgtgtaataattttatatacgcttccgcttgttaaactctgtattgtatcaacttttggtgtaccttgcctcctgggacaaggaataatacacgcacgtcgggagcgcctgttgggtgatttccggtcgtgacagcatggttatccgactggttataggggataacttatatctatgaaatatgtaacggatcatgacttgggtattacgttttcttgtatattatggaacggcctaaagtcctggtttgataagattgtaaagtagatttaggaaaccaataccgtattggttaaggtttctatcttgtaatcctaccccccatcttatataaggtgggcaggaggcactctagggggcacatgccacaacctgatcgtcagatcaatacacatccggcggattcaaatccccaaacaggagtagggtattacctctcattgagagggcctgaacctgtctaaatcttttgtctccgcatccatccacttttaggtctcgtgcgctaccccttttattattgccgaattcatgttttgacagttggcgcgccaggtaggtgtgcgtcgagtttttctgtcaagaagtgtgatggaatcatcctgagtcgccggcatcatcctcgctttgagtttcatggattctgccgccgtcgacaccatcttctgatcaaaaatcaatctaccaaagagacatcggtcgagatgctgggcgaacacgccggaaggactatgctcaagttctattcatctcggattcaatttgattttcgacatcacctattcaagatcattaatcagatacatgccctgtcatcggaatctgatcactatcaagccaagtcccacacgacggttatacagtgcaattcagccgtcagcaattcagttcctatcttggacgtgaatgtttgactggctttgcatgtcgctgtacataccagcaagaaccacattaatttaattaaatctggttggatccatgcgtatacatgcacatgcatgcaagcaggagcacttcatcaagcacaagcaatttttcaaccagatcaggtcaagctgtgcagataatacatgctacaattagttcggactttgtcgccgtcgccgaaaatacaagtctcatgaacggttgagtccgattcataaaaggacacgttttcacaactagattgcatgagcatggattggtcgggtgatgcgtggatgtatctagggttcgagctacaggtaaatgtacccgcgccaattgcctccgtcgccgccgactggtctacccgcctacacagttggttggtcacaccatcattgttgggcgtctaaatcttcaccgccggctggccttcgccgctgcggactggtgtttctgcctccacggttggcctattatgctgccgttgttgggcgtctatgacttcactaccggcctacctccgtcgccgccgactggtgtcctcgcctatacggttggttggtcacaccaccgttcatgggcgtcctcgtcttcaccgaccggcttgcctttgccaccgtcgactggtgtttctacctgcacggttggcctattatgccgccgttgttgggcgtctacatcttcaccgctggcttgccttcgccgccgtcgactggtgtctctgcctacgcagctggcctattatgccgtcgttattgggcatctacgacttcaccacggcctgcctccgtcgccgccgactggtgtcctcgcctatacggttggttggtcacaccaccgttcatgggcgtccatgtcttcaccgaccggcttgcctttgccgccgacgactggtgtctctgccaacacggctggcctattatgctaccgttgctagatgtctacgtcttcaccgaccggcttgcctttgccgctgccgactggtgtttctgacaacacggccggcctattatgccgtcgttggtgagcatcttcgctttcaccgtcgaccgcttttgtcgtcgccgactggtgtgttcattgttattgatggacgactttgttcccacattggccacctctgccatcaccaaggggaatattacaaagctaagtcatcattaattttcttcatatgatattttccttttcctctgcctcactacatcaactggttcgccgttgactagtgagtcgggggctacagatgttatatcttatttttcaataattttcataatatttatcttgattgcttgcgaaataatccagtaacagtaaagtgcctatcgagttatgaagttctatcttcctatgctttccgttgggtttgtcaatggatagttgcctttgggttgattccaagcacccgggggctcgttggatggaccgagtaacacaaggtgctaagtattactcggaataaatcaaaagcattgtcgcgaccgagaaaatttgcattttcccgaacgctagtgtattagtccccgtcccaggaaaagccggggtacaccacacaaacatgataccaaaaagcacatctttattattgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcttaatagggttccatttgcaaaagcagcttttagcaaacatttgaaaatttaacaaaacagttaagtatataattaaacaatattaatccaacgctatacaacataccctgttgtataggcccaaccattctgaacaaccaccccggctgcacagttctatctccaaaccaggaatataccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaataacccaaggtatcaaggaataaggtaatcaatgtacaaaagggccataacaaagaataggtcaattccacccaatgacattcaaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgcgaacggacggccgagattgatccgatccaaatcggacggccgaaatcgatcggtctacgaccggctcacgggataggatcccgatgacgtcagcgatgacgtcaccgacgacggcggcggctcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcagacgaggacggcggcgacttggcgatgacgacggcggtcttcccgagcggcggcgacagctggagcgacggcggagcacggctgaagcggcggcggcgacggcgaagctagggcacacggcgctagagctcttccgacgacgagaggcgaaggcgagggtggcggcggaaagagaagagcacggggatccttttaaaggggctcggaggcggcggcgaaggcccacggcgacggcaacggcgaaggaaactttcggcttggagagggggaaaaccgatccgattcgaactcgaatcaaactcattccaaaccgattgagccaaagattccaaaggagaaaaagtagaggagatcccggagattgtttcccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggccgaggagagagagaacggttttgggccgactttcggcccaaagccaaaagaagactttttaaaacctttttcaatttaaattattccttaaatgcaattccatttattaaaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaattatatcgataatatttacattattacaaaggcgcttcaggcctggcaatcaaaaataaacagcagcggactagcgggcctacggctccatcttcacaggcgctcaactggggtataagccaagactccacctaagacttcttctccaaagcttctcttactgaaggggggaaagattgagcaagaatgagtacgaccacagtactcagcaagccacaccggcagatgcatgattaatgcaaggggggtacaaggggataataatatcggggttaagttttgcagtaaacagcatttaaaagtcacttagttgcccaaagctattttataaagactatcctagagctacacagtattattaatcaaggccgtgaaccctcacgaacttgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccaagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttcgcaacagaggctcgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttattctagggtgaacaaggtaataataacaataacaacaatgataaggtcataacaaaggtaaataggcatggctagataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctctggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaggctttgcgactataaaacatgtggaagcgctagcctggaaaagacaggaaggctgcgctgttgacatgcggaccccacatgtcaacctaaaggaccgcggtagaccgggtacacagagacggtccacgggtcgacggaagcggaccccgtgtgtcaaccgaggcgagtggccgacaaacggactctactagacaccacacgggtttcacacgtggaaacaacgcggctaccaagcgggcacactaacacggacactacacggacaagcgaacgactaccgataccgatacacggataccggggccgacaaccgcacaacgggcacgggcgacaccgaaaggacgaggacggggcagcgagaggagagatccttaccaccacgcgacgaggcgaggggacgacaacgacgaacgggcgcggcggagacggacggcgagggaacgacttcagcggcgatccttggacgaaggcgagacgcggccggcacgaggcttgacgacgcggagccgaggacgaagacgacgacgggggctgcagcgaccttgacgaaacaccgaggacggacgaggacggctgacggagggacgaatgccacaacgaccgggaacgacgagaggacgacgacgacgacgactggggctggcgaggaggcgacgagggcagccggcagcagctgcacggaggtgaggacggcgtgggacacgccgcagcgatgcccacgacggtggcagcgcagccagacgacgagccgggcgagcgaccggaagtcgacgacgagaacgaacggagacgacgaagatgg

SEQ ID NO: 37784 - DNA, 11760 bp, Oryza sativa
tgcaccccggattaaaactctccctaatcaattttggaattagccaaatgaatcaagcggatttgagggaggaaatggctagggttcacggaggagagaggaggaggccgggcgggaggaaggagacgaccgggcggtgggacacacgcgcggcgcgcggtcagcgcgcggcaacggcgcgcacgcgcgcgcacgtgcgcggcacgggcgggagggcgccgctcgggttgggcccggaggcggcccatgtgggagggggcggggaggcttgggccgagaggcggcccaggacgagaggagggcgaggaggcccgggagggagaggggaggggagggagctgggccgggagggggagggaaggcccaagagaaggagggagagaaggagagggagagagggaggaagagaggactttggccgcgggccgagagagagagagagaggactttgggccagacttggcccaaagggaaagagagggttatttttaggtttttctttttaataaactctgataattgtttttgttgcttaataattatttccggtgctctgaaaattcaagtaaaatttgagggctccttttagaccaaggagaatttaacaaaaattctccggaccacattcgaatttttctggcacgtattttagtgtttgtcaaattcttttcgaattttaattaattctattattccttttagggaatgatttttatttcgggatgaatttatcaggatgtgacaagcatagagataagataatttattttctgctcttaacaattgcaaaagtactcgagtagtaaactctgatccgtgaaactttgttctattaatgacgaactcatgtcactcgtatgcatgtctgggaagcgcctaggccaactcccggtgcttgggggctatgactagtcgggcagagtgtttaaacgtaaggagtcatctgctcggggaaatcaagattgacgagaggagaaatacatatttataaatattttaaaatacttgaattttcctcgagtattatatttacatcagatactagtcatcctatatgtttgttctgcaggatccagatccagatatgcataaaagggattcatggctttaagcttatctcctacaggaatagatcagtcagaacataaccatcggcttgccatcgtcgccgccgactggtgtcctcgcctatacggttgggtggccacaccgccgttgttgggcgtctttgtcttcaccgactggccgcctcgtccgccaccaactggtgttttcgcctatatggttggttggttacaccattgttgttgggcgtctacgtcttcaccgccggcttgccttcgccaccgccgattggtgtctccgcctgcacggctggcctattatgccgccgttgtaggacgtctacatcttctccaaccggccacctcgtatgacgccaactgttgctatcgtcttcacggctggccacgtcgcagccaccgcaaataggcgtcatcaccttcaacgcaagctgtctacgtctgctgccgactggtttcttcatttccatggctgtaagattctgccaatgttgattggccttatcgtcttcaccgccggtcatctcgtctgctgttgactagtgcccttgcctctacggttggtttatactgctaccactactgatggacgtcatcgttttcattgctggccgccttgtctgacaccgactggcttgttcacttccacggttgcgcgccttcgtcatcattgactggcgtcatcgtcatgatcggtttacctttgccgccgcccatggtgtcttcgctttcatggttggtctattttgccgccgttcaaggacgtcttcgttttcgtcatcattttacttcttccatcgccaactggttatgccgccgccgacttggtggagcgacttcatcttcattatcttcggaaccggcaaaccctattgcctcaacttcgcaagttttgctacttcaccaaccacgacgtctacaagatcttcgacatctcggcacacacttccagattcgacgccgtgatattctactacaacaagtggttctccaattttcaagaattctagtcggacatcttcaacacgtatcttcactcaagtaaagtctactcgacgacaagctacagttctcgactctatcacctctgatgagcaatatcatcttcatgttggtcatttcatttccatgccgactgcgtcagctattgccaatggataattttgattatgacagaaggacaagctataaatgctcaggggcttatcaacttcaacacaaggatcataccttcaagttggattttgttctgagattattttctatgctcgaagactggaccaatcattattccccgtaagggctatcaaccgaatacttgcgccagtcgggattcaatttttatatctattttggagtatcccataagggataatcactcagatcagaagctattcatatgagctacacttggtctatatcaaccggaagaattattactcgggagcatgttatatgcgtcatcctttaaagggtgtcgaaggcatattttttgtcctagccctaatatgtttgcagcccatatttttaggtgtggcctgtcacgttcttttagggacttaggtactttttgcttcggccaaagtgcgcgtgatcaagtgcccaataccttaaaatccttttataccacagttattcaactttttaggagttggtacaatgcactttaaaaggtgcccaacagtgaagtttttcatagctgccctgctgacttttttatatagttaaggcgctgtttgggtttatacagcaattgattggatacaatatcattgctttttgccacgtaagtgtgcatttttattgaccaatattatggcttaggctgattatatattgtggtcatttttcaggcgattggtaaatcctttatgagtttatttactcggattttataccacatatgccgtgtatttccaggtgtggtgaaaccatgtgtcttttagggacttaagcacatttgttaaagcagtgtgcgcattgtgtgtgcttaatactttggaaatttctttattcgcagcatacaagcttcttttataactgttttgctatatgaattttccatgatgtacacaactttaggttgctcgcatcatattttacaaagcaatcggtatatcactcggatcatgttgttcggggattcacgatgcatatgctatatattaatattaagtcacttggttgactataattattaaaaacctttcagttggttggattatttattccttgactatatgctttgtttgttcaactaaccacatagtcgggggctacacctattaggtgcatctagtcgatgcacctgactttatttttcagccctccacagtcttctgatttggtaaaagtactcgggagatcatggcgaagatgattgaagcactaggctttggagtaatctagtccgagagaagattatcttttcgactgtgaaggtctcaggggctactgtggagattatgggtaccctatacccacacggcatggttatccgactggttataggggataacttatatctatgaaatatgtaacggatcatgacttgggtattacgtttccatgtatattatggtacggcctaaagtcctggtttgataagattgtaaagtagatttagaaaaccgataccgtattggttaaggtttctatcttgtaatcctgccccccatcttatataaggtgggcaggaggccctctagggggcacatgccacaacctgatcgtcagatcaatacacacccggcggattcaaatccctaaacaggagtagggtattacctctcactgagagggcctgaacctgtctaaatcttttgtctccgcatccatccacttttaggtctcgtgcgctatcccttttattattgccgaattcatgtttcgacaggtattataccttgattatcttaatttttataagtgcctgatttcagcgtactcaaggtaaaattcaacgcgattggagcaaacgacaactgattctagtggtttatttgctccatcggactgtcgacctacacgtgcatgatcatgtaaccaatatacaaagagggaattagtgttgcatgagaagtctattgcaaatgacgaatgattaaacgttatacgaaaatcaacaagattgtcatactcatacattttaaaacggaaggagtatgacgcagtcttagtctttgcgatcggtttgcctctctcctgcacgctgcgtaatatattttctagaagcaatttggaggccaaaaagggtcctagttgacccgatcgcgatattgtcagccgccgctagcatgcagtgatcaaagatccttgccattaattaagtacacagtagtacctttaattgattatattatggttaagacatcgaacgcacgtatacctaatcaaggtaaacacacacatagacatcaattaattctctccatgagcatctttaaaaattgaatctttaatctttatgttgtgttattctccctattttccaactcatttatcttatttttcacatccatgctttccaaaatgctaagtgatacatttttttaaaaaaaattctacatgcatattgctttaaacaatcctatcaatctatttttaaccatttttaactaatacttaattaattatatattaataaactaatatattcttcatgcaaggaagtgatgttccaaactccactcccaaaagcagcattggattaaggtacaaagtcatctcatatagataaaaaggaagtgttttacataaaaacgaggtagtattaatgtataattaattaggttttaattattataaacttaaaaaatatatttatctaatattttagagcaacttccgtatagaaaattttcgcactgaatgtaccatttagcaatttgaaaaacgtgttacaaatatccaaattttcattcaacctttgtaacaaaacccaaccctgaagttggtagttgcattaattgctggattattctcctgtacgtcgtgctctgcccgttgtcgtcttcacttcgctatctcgtcttctaattaattaacggatttactaattaattaagcaactcgatctggaagatgccttcctgccccacgacccacgggccacggtattcaatctgacccacgactccgacagacggtatacactagctacgacacattccatggtacgtgattaatcaggtggtttatactaaaaggaggaggagaagaggaaagatgttaaaattcgcagataattaatcaagcacaatttagatgatgtgaaatctgcagctcattgttgtccagttctcactttcgctcgacgtggcaagacacaacggatccgagcaataatccactaaacccgccaattaaccatcctgggaacgacgagcaccacacatattcttggtcgtcgtgcagaaaagtacagtgaaggaagaaaaaacaccaaaatactttttcttgctagtacgcaagaaaaagaacggaaagcaacactttaatgcaagtggtcagtatttgattagcttatagtataagtaatctttttcttttgtcccttctaaccaactctgctcctccatttccaacacatcctcgatcgatcccctttcccctcgtgtgggctctacattggaggaatcgagtatggctttctttctttgacaaaaagtagaaaaaataatcagccccatcgtttggcctaaacagtcaaagaatatgccaaaatttagattttttaatttgattttgaaatgcttttaacgtaatttttgttaatgttggcttttaagtcgcgacgaacaaatctacaaaagttttacttataaattaattttaattttttaataagccaaataagccattttggaaaaaatgggcaaccgatgggagccaatgcatatataggcgagacaatgtcggcaatcacttttagatcattcggtcagaaaaattcgtaaacggtatatccacccattggacacgtgacgatgatgtcaacacatgttcggcaaagaaaacaaaatcattgcattaggatgcaatgattttctaagtttaaacaaaccgttgttgttggctgttcgtaaggcttcattgaccatctatacgtctatattttatttttctttataactttagccgtcattagtcacacactattctattttttagagggagcttattagatctatggttagttcttctaatctggatagaagatcactagttaagacgtaaacaggaaaacatatatagcagtggtggatacgtttacaataaattataaaatatttggtattgaatgaaaagtgattataatgttggtctatttgtaactttaatccatatgcacaatctaaagtaaaatacacatttaaagcttgtttgagagtttagttttatttctcaggtgtaaaataaaaacacctgtagtttggtgtggcccaaaaataccactgaaaaagagctgaaccctactcagctctagcaagcaagcatgatttgcgtaaaggtcataactgattttttttaaaaaaagagtataaacattgtcatatacagaaattttaatgagaaaccaattgaaactacatcaaaattatacacagaacatgaaaattatggtcatccaaacccttaagagtagctgacagcagaaacacacaagagatcgaggcatatttcataaatttgtgaacataatcaactgaccccatttcacaagcacacaagaaaaatctctcatgtgttctgtgcccatttcgcaacctcgatatctcgtgtttctgctgtcagctactctgcgaagtggggacaatcggaggtatatttagtgggctacgggccatccaagcaccacttgtacattaaaacctaatggaataagtctatcctccctccctcatcacccttgatcaaatcgtctccctcagccccaaaaccgggtataacacctcctccatttttgaaaaccggtgcaaatagactcctttggtggtttgggaagcggtttatgcaagtggggcccacatgtcggtgagatatgaaaaaaaaatacggtgggcccacatgtcaagtccttttttttttcttccccacctctccatccttcttctctccctctctcttcataggcagcagcaggagagcaccgcaacggcgcggtggatgatgagtcgacgacgcaaacaccatgaacgctatcgctcggagcagagacgtggaggcgtcgttcgccgggttgccgactggcgaggatgacgatgacgacaacctactgtagcacgggtgaatcccgtcgatgtatggcgcctcatctgtgacctccacgaacctcaggttccaaaggagcgtcgtctcccccgccatcgccttccatagttgcgcgacgaagctgccggtggagaggaatgagaaggtcatcgctgaggcccctgatccaaaccgggggagagagaaaggtggaaacgggcaatgacatgtgggccccacccgctgactcaacaagtcaaccgtgatcaacctgccacgtcagcaaaactactttccaaaccatcaaagagtctatttgcaccgtttttgaagacggaagaggcgttatatctggttttgtggctgagggaggtaatttagttagcaacaagagataagggaggcaaaatggacttattccacacctaaaaaagatttaggctggtattttacattgctatttggccacaaacagggcttccaagttggcccttaataatgatattttcaccggcgcctccactccaatctgtatgtacggcactggaaaaaacgacagaaaaaaaaataaaaataaaaaccggaccacgtccacgtgtacgcgaaaaatccacaaatagtagcgaacacatagtactgatcaacttgtggagctcgatcgatcgctgtccagtttcgcgccacgtggcaattggcaaagatagagcgtatgacatcggagcaagcaaaccactcgctaggctagctatcaaccttagcagccaggaagctgggatcgagaagcaaggagagagagagagagagagagacagcatggaagcgccgccgccggcaacgtcgagcaccgtgtgcgtcaccggcgccggcggattcctcgcctcgtggctggtcaagctcctcctctccaaggaccactacgtcatcaacggcaccgcgcgacctcggtaagaaaaccttcgattttatctctgtaagaaattttctgaaacgaaggatcgctacaagtagtacaagatgattgcaataattttttgagctataaattgagaaagtatcgtgcaggtgagggcaagaacgcccatctgaaggcgctggagaacgccggcgagagactgcggctgttcaaggccgacgtgctcgactacggcagcgtcgcggcggcgatcgccggctgcgacggcgtcttccatgtcgccagccctgtcacctccggccgacccaccaatcctgaggtcagtagcttacaccatcctgaacctttcagacaaaattaccttttctttcagaagtttcagtcaaaattactgtactatactagtttggatttgcttctagttccaatgtaatcactccgatgacatatactactagtactgaactaggttcacttagaagcaaaaagtgtttttaacttttaagatgtgtaataaagtcctacaaaaattactgtgatgcaggtagatatcatcgctacggctgtaactgggacactgaatgtgttgagagctagccacgaagcaaaagtgaagcgagttgtggtggtttcttcagttgtcgcagtgttcaataatcccaactggccaacgggtgagcccttcaacgaagacagctggtcagatgaggagacctgcaggaagaatgaggtactaagttgttattaagagtactgatgaagtagtgttatgtcgtcctaacattttctacttttgtaacatgcaatttttggcatgttgggttaggtgggcatatgcaatttttcctatgcactctaggagagagaaacagtctgaattgatttttaaaaaaaattaaaaaagactttgtcttgtcctatgcactccactttatatagataaacaagggcacaatctgaattttcttttcctgatatttggtacaattttttttcctttttggcaatgcgtgcatggtttgtttaccaatcatagagacaatttccttaccttcagtaattcatgctacttctttgtcaaatgcactaaaaatcaattaattatgctgtttctgataggagtggtacccctattacctttccaatacactggcagagcgtgaggcttttgagtacgcggcaaaaactgggatggacattgtaactatctgtccggcgttgataatcggtccattgatgcagcctacagtacctacaagtattgaagtcttctttcatattataaaaggtggataggaattttcttatttcagtttgccttttacattcaacaatagtagcggatttagtttaactgaaaattcccgtatgatgttgtgttagacaataatagcatgcatgatatctcaccacttgtttcatattttttccttttccaatatgaatcatgcaaagaaattgctataatattttcgtagctcaataattaaacatcaagctactttactctgtataataagtgtaataagtgttgcgtactgaaataccatactgctcttatcggtggtggagcaaaaaaatatgcaagctagggctgaatttgacaatttcagttagaaattatatacttccaaattttatttacaattcactaaaggatttacttggagttttggagccaagtattggactcgaggccaagttgccccaagcctggctgcgcccctgtttctaatgcaggagacaacgagacggctggaaacagactcgagactctgttggatgttcgcgatgttgccgatgctattcttttagtctatgaaaactcagggggatctgaacgatacatatgcagttcaactccaagaaaactaagtgatataataaacacgtcaaagagcttatatccagctttcaattatccccaaaagtaagcttaattatttttgtgttccttaattagtacatgcctgaagtgtgatatatgcatttttgtttattcgtgatatatgtagagacttattgtgttgtgtttttctttatcgaagtggatgaggaacaaaacactaggtttagttcagagaagcttgagaagctaggttggaccttcaggcccatggaggaaaccctcagggatagctttgaatcctacattggtttggggattctgacctgagcgtcctactggcacaaccttatgaagattctgtaatcagtgataaacaatcagctggagatataatttcgttaatggaggtacatgattgaagactccaacgttcaccacaattgtttcaatgcttaagaactcgtatgatgcaaaaccgttaaataatgtaatatcagaattgattgttttcacataatatcataattgaacgctcgtagatgaggtacgtactgtcacttgagatctgctactggtttccgtctcttaaaacgtgtgttaggggacacattcatagaggtgtgagtgtgatgttacgtgtgtaatggtgtgtgtgcgtgcatctatcgtgtaatataaaaagaaaaaaaattattagcacatgactttgctcaatcaacaatttttttttccgggacaatagaaggacgccgaccaactacactcaaattaagacaaaacactatattttacagttttatatgaatcaacaactcagaaaaaagaagcacaaagcacgctatggtgcaaagcgctacaaactacaccggcataacacacagcagcagcataacccaccgctgctatgctctgctcaaaattagtaatatttatatttatattttattattaaaatatattaaaataacaaaataattttaaataccgtactaatttgaccaaactaatcagtgtgtaatatctatattatagaagtgtcaataattaattattttttaattttaaattttagttatttctaaattatattcctatatgaattttagaattttaggctcttctttcaatgtttcttatttattaattctaaagttccattatttataaatattattcttatatggactctaaacctttctttcaatatttcttattttcaaattcagagttttacttatttataaattttattcccatacggactctaaaactcttttttcaatattcctaattctttcagagtgattttctcaaaactacgaggggaggaggaagctatcggcatgattgagggtaggggtgaaaacggagcggatattatccgatccgatccgctccgaatccgtccgatgtgaggatacggtaagggtttttagatatctggctggatgtggatgtggattttgtcatgcgaatgcggatgtggtatcaacgatatccgatggatgtggattattcgatattttaatcggattatccaatgttctgtttggcggataatccgcaactttcaggccacacaacaactctatttagcttattttacatcgggcggcccatctagcacatctagtgtaacctaatccaatcctcctcaaatctct

SEQ ID NO: 37785 - DNA, 3993 bp, Oryza sativa
ctcaacggcacccgctgattacgcacgagcgttgcaagaattttctgccgtcagtatggtgattcccggccaggcaccgccacgtgtcagtttcctttccaccgggcaccgccaattgtcagttgcctacccccacacaacacacacaaatcccactccccagcacaccaaaagcccaaaagaaacggttttctcctccgcctctgctcgatcgaattcaagcgacggatcagaagatggcggtggagtccggcgagttcgtggtcgtgcccctccttgcgcatccccaggacagcgcctccgagccggggcccttcaccgatcaccgcgcgccgttcgccaaccgcgacacacgggcacgcttgaccgtggccgtggccgacaccaacggtgccgacgtcttggcgcgcgagcgcggcgtgccctcccgcgaggccattcgggttcagaaccgcactccgcctagctgggcgtacgtgtccgagtccaacatcctcgcgcgtgagaccggcgagcccctcctcctcctcgacaagcaccgcactgccggagtgggcgtggccgtcggcttcacgcgtgagcacggcatgtcattcggtgatgccctcctaggaaaagaatctccccgccaggctctgcaacccttctatacaatttcttttttttttcttttacataaaacataccgtttaaccgtttgaaaaacgtatcaacggaaaacaagaagtatgcaaactcgattagctatttaggtaatggtggtcgccgccattgccttcgtcggaagccggtaacggacaacatgaaccgcggcggcggatcggatgagcacaacgacgtcacctggtacggatgggtcggggcagaaatctccgaacccaccgacatctctttgacatagttgggctgctcggcggagttgggccaagcggtaacaggctatctagggggatgcccaccaaagtgcgggcctatctgcaaattatactgggcttgttttgccagcttaattatcgattctcctgtaaatcctgccctaggtggatctgcctacaattagctctatcttttggtttactatgtttgtaagccaattttcaatacttattttaagttgattttgtggatttttcatcatagtttattttacagtatttgcttgtgaatcactctgtacacatatataaagatcttaataaattatattcttagttgataatagtcatttagacatgcatatgcataagcgaaaatataatagtcccttcgtaccataatataaggtaatatactattccctccatctacttttgatagtcatatttcatcttgacacacagaccaaggataagtaattctacttatcatccatttaaacatgctattagtcatttctaataaacaagcgattcattaatatttacatttctcgatgcccatgtagccaatcttgtgtggaagaatggagagtcacgcattaaatccgagaaagttattaagatgataggttgttgaattgaaatatgcccatcaaaaatattttttttttcagatttggaaatatgactatcaaaaatagatggagggagtataaaatataagggattttgcaatcccaagacatcactttattcttaagggtagctatatttatgacgtcatatttctcactaaaaaaatagtcggcatgaatttacattgtaagtccctaaattacatacataattttaatgtatttataatataagtttcaaaattatatatgtaagtagagtgtaagtagtgtgtaattttattttaaatcaatgaataaacatactgaagtctatgagatgcaaattaattcattatattaactaaattaagtaggtggtcccactgctaatgaccgtacgtacatattgattagataagctatacatgcacaaacacgaatcgaactgaagatcgggtggccaaaatattcgactgtgatgggcaacaaaatgtgaccccaaatatgttattctttacctaccaccttttatactagtttacttaatccactacttttttactattttattcccccgcctatcaccttccgtactactttattctcctattcatcaccttttgtaccatgtcttgtccttttaccacttccttaattttgtaaaaatggcataattccttatattattagacggagggagtaatagcttggttgtgcttgctcatgtggcgtaatacaacctagcatctccaagcttgaccgtcaaaataaaaacagtccctcaaatcttttgctctatataaaatcagttgttgccaaaatttaattttagaacttgattttaaagtttttttaatcaaagtttagttttcaatactaacttttaaattgctaatgtcatatatatatatatatatatatataagttttacctataatttttattattttgctaatatatatgtcgcacgacgtattttcagcagacgcccaatcgatgggcccacaaaccgtcggtgctagtagcaggtgaagtggtaagaaatactgctaccactattttcaaatgtatgatggtaattagtaccgccgaaccaaaagattgagagattacttggggaaggcaagtgcgcaaggaaaaatagaaaaagaaggctatagtaaagaatatttttcacaacccatgcattggatcatgggcttcttccctaattaagagtttgggacaaaagttgaggatctttttctcgatctgcgatcacatgaagcgccaaaagaataatcccaagcatgactcatccatctttgatttgctctttgttgttcctcagatgactcagcggccgtgtttgtgaccagtcgtgagtagaaactagtataacgtagagtactaagtaaacaattggttcgttttcttggggagcaagagtactatactatgataaaatgattaatgcacacgcttctcgaatttacaagtagtgtggactttccatatatgagtataattttaaattaattttgtaatagttattatttattggttctctaaaattatcaaaaactattaatctattcaccattcatcatagaacaacaccccgtagcgctaacttgtgttattttaacactactagaaatgtattattgacaataacgcaaaccataggtcagcataggtcagcgctgatgccgatcaggtatcaaagatgtaaagcaagatgtctatctacgatattactgaacctgaagaagaaaagaaaggccaagatactaaaactatgaaatatactacttcttttcccctacggttataagctactatgaaattttgaattttaaaacttaattttttatgtttttttatcaaagtttattgcttaatgttgacttttaaatcggtaaggaaacatgtataaaagtttattcaaaattattgctaataagctgtaagggttatgatcaacatatggccactaataggagcctttgtttgcttgaagaccgtaagcaaccacttaaaaaatatttataggagtataatatgtacgtgcgtaggttgttcaaaaatcaattaacaacttttctgcaaggaaaatcaatttgcacttccttgcaaaaacaaagggaaagtacaaccactctagaacaaccaagtagtacatttcttttgcatgtatacaaaaaagatcggagggagtatctcggtggtgggtagagtagtaagtgtgttgtactcgtactagctagagtatatgcttgcttggcgccacgcaagctcggtaacgaaaacgacatactctacatgcaagaggttagactattgtgcagtgttgcctagctccttaattgtcatttgcttttagcattagccccttggaatcgactcaaaccgcgggaagaacagatcgatcgaccgcggtttaatttggcggcaatttgcacagatcagaattcagaattgaattgaggggatgcttcccgtccaccgggggacg

SEQ ID NO: 37786 - DNA, 2189 bp, Oryza sativa
ataattacaaatgtaaatacaataatcttattttcagaaaataaaacttgtttcatattaaaagatttgttggtcaaacatttttaaagttaaattttatgcacgatctggcaggtattgtaagattaatttactatatatacgtacaaccgtgactaacttggattttgattgtatatatttctctttagtctcgaaatgtataccaactttaatgagagacctccttttcactcgctcttgtggacacaacaaatagataccaacattaaactgtttcccagctgccctattaaaaatgtgaagttcaattttagtcaataacgaaagccctattgttgctccaaaaaaaagatttgcggcttccttaattaaaaatgtatatgaagtaacttaacagttaagattaaaccatttatgtggctgcagctactggataaggatatggatttagagagacaaattttattttaaaaagatcctactttctactgaatttaataaagcatatattaatttagataaaaaaacttacaaaaagaaaataacaaagagaaaagaaagggaaaagtccatttgatctggacagctggcagttaacaatgccctctgtactaagtacgtactgcccctaactacagagttgaagttatccttgtggaattatatggcatgacgacagacatgtgaccgtccactgaaggggattgctgctgcgcgcgtacgcgccagcaaaaaaagagctggcgagcactccctatttttagtcttaactacttaatatacttaatattaataatagtaattagaaaagattttgaaaattctttttgggagctttttttattaacagattaaaattttttgaagttagatttgaaaactttcgatttaagtttcaaattttaaaaactttcaactagattcgaaaactttcaactcgagatttgaaaactttcaactcagatttgaaaactttcaactcgagaatcgatattcgaaaactttcaagtccggatttgaaaattttgaaaacttttaacttgagatttgaaaattttcaactcgagatttaaaaactttcaactcgagattcgaaaactttcaagtccggatttgaaaatcttgaaaattttcaacttgagatttgaaaattttcaagtcgagatttgaaaactttcaagtcgagattcgaaaactttcaagtccgatttgaaaaaattgaaaattttcaactcagattcgaaaattttcactcgagatttgaaaatttcaaggccagatttgaaaattttcaagtcaatatttaaaaactttcaactcaaaacatttgaaaaaacacgtgctaaaagatttaaaaaagtaatatgaaaaaagcgcaaaaaaaagtgaaaagaaaacacgaaaagaaaaaacacagaagagaaaacggaaaaaccggcgctagcggaaaaaaaattctcgcgcgcgcgtgtgggccttgtgggccgggaatgcgctccggcaacgcacgcgcgcgagttagtaaaaccgtccactgaaaacctgtaaactatgaatttataacaattctttcggttgccccgtttctttttatttaaaaaaatcttgggaattcattcatgggcaggtattaataattaatgtacaccagtaattatcacagggagtggaaccatctttgtcgtccctttgtttctttggtaccaaatcatgaaaaggatatttataataggtaaaagtacgaattacctcctcgaactatcgtggtcgtccgaattatcccctctgaaccacgaaatcagacatttttcaccccaactatgcaaactggacgaattacccccttgacccaatccgcggtggctttagcctacgtagcgtatacgtggcaatctagtcagcattttattttatttttaatggtgggacccacatgtcagacccctctttctctctacccctctctctttctctctctcttcctctctctctttctctctctgcgcagggaggtggaggggatgggggagaggcgggcgtcggcgggtcgacgagctcggccggctccggtggcagcggcagcggcggcgatggcgtccgcggcgggacgtggagcaaggcggcggcggcgacttccttccccaccgtcgcggcggcgtggagctcaaacacgccggcactgtggc

SEQ ID NO: 37787 - DNA, 4729 bp, Oryza sativa
ccgctcgctagcccctttataaggacccccgagctctcctctacccgtcgcctcctttgccttagcctgccgtcgcgtctagcgccgcctccgcgtagccctagtcgccgccgtcgttgccgtcggttcagccgtgtcgcgcagccgttgcagccgccgtcgtcggtcgccgtcgccaccatcgggttcgcaaggtcgtcgccgtccccgtccaccgcttcgccaccgccgaagaccgccggagcgccgtctccgtcgtcgacccgatctccgccgccgcttcttcctcgtcgccggcgtcatccgttgttcttccgccgccgttttggtcaccggtgagttcgccgcgtcgcgctctacgtcttggtgctctccgtttgtgccgtagagccgccgttcgccggcgagcgtgcgccgtccgagccgccgccgccggtggtgacgtcatcgctgacgtcatcgtcgccctctcccgtgagccgccgtggacccaatcgatctcggccgtccgttttggatagggttgatctcggccgtccgttcccgtgaaccgctgccgtgcacccggtccaccgcaaaccctagcccgctgacgcaataatcctcctttttcttttcaaaaataattcattattgcgtcataattcaattaaaatcaatttaagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaatatgatctacatgtttgtttactttttatgtattgtttatttggtttttattagtcttttccttgttttgcgtgttagcttgtcgtttccgtcgttgtgaaggttcgcgagtgcgccggaagtattcaagaagattaattgaagaccgattattgcaaggcaagtcacacagatcctaaacccaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgggctttatatattggttcagctagatattagatatgattgcttagccatgcttagaaacattagcacataattgggataactaatgtttcactatcacttatggttatatttaatggtagctcacgatggtcaatcgtgattggttaattaattacttgccagctaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatattgaggctgtgtcttgtgggtacagtggtacacctctggccagagtaaaactattcgaatagccgtgcccgcggttatgggcgagttgagcaatgtttttcgtgattagtcccacacctctcacaataagtattgatgttataactggtaataatttgcttagctcctggtttggagttagatctgtacagccgggtatggttgttcaggatggttgggcctgtacagcatgggtatgctgttcagtgttgattaaaatttctgattaattactccactgttttacttctcttaatgctttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccggaaggagaagacgtttggcttataccccagttgagctgcctgtgggagtggagccggagcttcgctagattttattttccgctgcagttttcttcttggtgaggactaagtgcctcttaagtaagtatttatcattttagttaatttgattgtcagtttgtgtacctcggctgattcctggacgaggattttatgcacaaataagttcggaaattactagtgaatttccgggcgtgacatcctccaccgccgttgcctccctcttccgtctctcttgctcctccttcccgtcctcctcccaacgccgctccaactcccgacgcgcgcctccgtctgccgtcccccgtcctccccccgacgcttccggccatggccgccgacgcccgcctctcccctatcccctccaccttccggcgcgccgcgtgcgcgctgattgccggcccacccccgcgccgccgtccattgcccttccccacgccgcgccatgcgtgccggccgccggcgtgagcgccgctgccgctgaccgacgaagagagagaaagacagagggaggaagagagaaagaggggtctgacttgtgggtcccaccattaaaaataaaataaaatgctgactggattaccacgtgtacgccacgtaggccaaaaccaccgcggattgggtcgacgggggtaattcgtccggtttgcatagttgggggtgaagaatgtccggttttgtggttcaggggggtaattcggacgaccgtgatagtttgagggggggtgtaattcgtactttttcctttacaatatgcactatcaagtgcagtagtaagcatatttattagaaccggaccggcgggttgcctagaaaaaaacctgaaccaggacgttggccggttcggcctagctaaaagatcggtcagcaggcggtttttttgccgaaccgcacaaaaacccggaggtggttcgaccgctgagggggcgaggagcagaaactacagccatcacgtgaggttagagaaaataaggagaaaaccgctgcctcgagggatcgaacccaagacctccatgttcccgtgaaaacactaatccatagcctgttgatgtagtattgtaacacacatttatttaaacaattttaaaccggtggtttgaccggtcccacctacagaccagtgaaccaagtgccctaaccgttcaatcaccggtctggtcttaataaccatggtagtaaggctgtgtggttaactccaaagtttcgtgttcaattcctaacacacttatatttttttcttagaaaatgtttgaagcgacgtctctccttccaaatctcctttctgaaaggagctttacattattttttaaaaaaataatggaaattgatgaaaaggagagaggtttaaatggtttagttttacataatagcacaaattagagaatacccattggcttctcccactaaactagtactctttccttttcttttctaatatatatgacattattgatttttatcataacagtagaccatttgtgttatttaaaatattcagtatgaatatataaaagatataagtaatgcttcaagtttctttaataataaaccaagttacaataaaatataatatatttagctaaatatttgaagtatgacaactaatcaaatgtatgttaaaagtcaacggtgtcatttattagaaacagagtgagtagttgttaaaaagaatcaattacaacactctttcactcattcatgtgcatgtggcacacatatgcctattcatgttatactaaaaccaatatattgacatgatgtttgattaattcttggggcagaaagaaaacgaaaggagtgttgctgcatcaacgtgtttgaactaacggctcatagagataaacttttgcttttaatggtagctagttgtatgcattgttcaggaattgatcagtgaatgggcgggcccagctcaattcaagggtattcaaatgaatacccaagatttttagacaaaaaatacatatacgaggtatatatttcttatgtacgcagagaaataaagaaaaggaaaaagtacgaattacccccctgaactatcgcggtcgtctgaattaccctcctgaaccacaaaatcgggcattcttcacccccaactacacaaaccggacaaattacccccctcgacctaatctgcgatggttttggtctacgtggcgtacgcgtggcagtccagtcagcactctagttattaaaaaaatgtgggacctacctgtcattctcctcttcctctctctctcaaacaggtcagcggtggcggagcgcggggaggacacggcggcagcgggcggcgccgaggagggggacgcggcagcaggggaggacgcggcggcggcggctacggcaggtgacgcagaagcggcggcggtggcggcgggggacgaggaggacgacgaggatggcgacgaaggagtggagacgacgctcgggcgctggctgcggcggccatggcggagaggtagaccgcggggaggaagc

SEQ ID NO: 37788 - DNA, 5030 bp, Oryza sativa
gatccgtttgagagagagagagaaaagagagaggatgaggagtatgacaggtgggtcccacatttttttaagtaactagagtgctgactagactgccacacgtaagccactagatcaaaaccaccgcggattgggtcgaggggggtaatttgtcgggtttgtatagttgggggtgaagaatgccttgttttatggttcagggggtaattgagacgaccgcgatagttcggggtgtaatccgtactttttcctaaagaaaataaacgttattgatcaaaagaagcccaaaaaaaagcctagcaggctggctcgctcaaatccgaacccaatttgtatggttgcctaatttgtgcattaactgtgttgtgatagcatgatgctaatcgatgtatactttgttggtagattgtacttcatatgttttttctcaaagtatatcacaataaatcaagaaaattgctaaaaaccttgtcgcaagttttaattcaataagcagtactaaaatactatattgttgatcatacataccaaatattatgctcgtgttgtaaaaattttttttaccctatttccatttcgaatacccaatcttaaaaatcctggacccgccctaataatgcattcaaaacgtatatgcaggtccatgaatgcacggcaaaatggcaacatgccaggttttgtacacctggtaacttcaggtaaattggtaaccttaagttggaatatatatttttttcctttctctttggactcgaaatgtacactaattttcttactttaatgagagacctccttttcactggctcttgtggacacaacagatagaaaccaacatcaaacggtttcccagttaccctattaaaaatgtgaagttcaattttagtcaataacgaaagctctattgttgcttcgaaaaaggttttgaggcttccttgattaaaaatgtataaagtcactcaggcccctttgatttgtatgtaaaatataggaattttggaggattttaatcctatagaaaaatttcatgcgaaatcctttgaaacaaagggttaaatcctatcatatcctttagaattcttatgtaataatgtaatggacaatcaaatagggatttcagaggaaatttagcaaaaactctaacctcttcatttttttagtctctctttcattcgattcctatatttttctatatttttcttgtggtccaatcaaatggctatttttcttaatgtattttatacattttgcaattctctgtttgcatttgaatttatatcagaatcctttttaattgccctttttccattcatacgattcaaatgggcaaacaattacgattaaatcattggaatcgattgacatttatgtaggctgtagctagcaagctactggataaggatacggattcagagaagactaaatattttaaaaagatccaactttctactgactttaataaagcatatattaatttacataaaaaaacttaaaaaagaaaagaacaaaggtaaatgcaagggagaagtttttttgatttggacaaccggccgttaaagaagacaatgcgctctgtacagtactgcccctgactacagagatgaaatttatccttctggaattagatggcatgacgacagacatgtgacgttaacgaccaaatttggtaatatcagtatcggaaaagaagattagatcgaagtggaatcagagacagagatcaatctgggaacagaacgggaatcggctagagtccggatcggctacagtcaggatcggtagagtttgagtcagacagggctagccgatacagccgatttcaagaatacgacttggtgtacatcatcgggttgagttattatgcttcaagatgattgccacgcatggatagagtcctgagaaagcaattgtatctattaattaggatattttatgtaatttcattagagatatgtttaggcaaaagtctaccgcaaagacttatagtatcttagggttgttagagacaatagtcatgtccggtatggacatatcttgtaattctcgggtataaatagaccctgagccctatgtaaaagaacacacacacgttcaatacaatttcggcgcatcgccaccctttttgcttttgttttatctcgacgagttattgctttcgggttgagctgcattggtttcgatcttcaacaagaggtaaaacttgttttgacggcttgtgttctcgaagattagtgcttccatctttatgatactctaatcttgtttatgtaatccgtcaagttatcatatatcttgcataatccttgacaatatcattatttaacctacaatcggctaacatctgctaccagaaagcaatcagttaggttaaataacgatgttggcttagattatatgagatatccaccactttatgaaacatccagcagcttgattgtctagatgttgttcttcttttcatacttaatgttgtatcagttgagtttgatctattaagtcgtgcttagaatttcaatctctagcctgcctactggttgccgattagggtagtatcggagtttcagccgatcttatctgatctaattgcttttgctctatatgctcaattaatatgttaaatctgccattcatattaagatcttgttgcatttaagtatattagatttctgtttagtatattctatttgctttaatatcttaatataaagtagtatcggagtattagccgatacatgctagatatatttgatcggctatgctatgaatatgtataatctcattattaatatatatttcaatctaagtgatttatattgtctcggcaaggtgaccgatgtatcccaatcacttgattcaagtatatgtcgatataaggattatatatcattgatatctacagccgatcgagcagatttagttctgatttgtttccttaacaattaccgatagatttacatatgacatcggctcaaagataaatgatatgtcatcggcatttagccgatcggctatcatttatggatttaatcacggtttctttgtctttgtttcttgttgattgcaggatcaaatcaactagcacgctcatacatccgaaggcgagttttggacctacactggagttaagcagatctcccaggcctcgtgttttccatcaacacgcttttggcacgcccggtgggactgatcagaagtcagaagaacagcttccttcatggctgagaaaccaccactgtctccgtcgtcggccagcctgggtagtggtaaggaaaagacccagaaattcggtctgactgacgtccatgaaggaaacgttgtacccatcgatccagagaagttcactcctgaacagaagaaagacttcaatgcaatgatgcagcaagcacgagatcaattttaagttcattcatgcaaacttgtaagggcacatttattcagaagtacaaggtgaaggtggttcctgaggattttgggatcggttcttctaaagagggagaaaagaaacaaattccagacggatcagcccagccgagtaacaaaggtgctactgatggctctccaggaaatcaaggcgatgaccctcaaggggtccatagagtgcaaggtgacggagttcacggagttcaaggtgacggcactcagggaccgcaagggggaaatcttaatcagaatgacaatgcattccaagattttttcaataactttcaagatcgagttgactatgctgtgtataatgctttgattaatcaatctggagtgttgactaataccttgtcaaatatgatgaaatcggtagccgatggttcaatagctgaacatcaagctgcaggcctagtttacttgcaaggcggtacttttccaaattattgaactttgatcaccgatgttcatccacttactcagggagttcctcctgttgcatcatcagctcagccgacggcgccagcatcagctccagcacctgcagcgccatcgtcggctccaggccaattaatcaatcctcaattattggtaagagagcaatcacagtatcctggaccgaatgtgactcagctaacacaagaccaggttgcatctatgtttctacctcctcagaatgccattaattcggctcagcagcagccgattcagcaaacaccgtccaggcaacaggttgtgcagcctattcaacaagcatccccaattcagcaggccgtgcaaccagttcagcagacgccaccaaagcaaccggatttacagccgattcagcagacaccgttgagacagcaggtcattcagccgattcagcagcaagcctcaatgaacgcatcggctgggtttacaatgcctggtggccagcctgtgcagtacattgcaaatcaggtggtcccggaacacttggttcatcatgtgcaaccggatggttcggtggtgcctcaagttattcctgagcatttggcgcgtggtattcggccgaaccttcacaattgccggggggtaatttgagttatcaatatcagcctccatcaccccaagttcagtaccaccaggcaggatcggtgcagcctcaattctacaaccagtttgagcctacaccacaacaaacacctcagcagcgaccatgggctgacgtgatagctgatgtaatgagggagcaatttgggcttaaaccaaaagagactgggaatttgtaccgacaaccttatcctgaatggtttgaaagagttcctttacctaaccggtttaaagtaccagacttctcaaagttctcaggacaggatactacatcaacctatgagcacatcagccgattcttagctcagtgtggtgaggcatcggctgtagatgctttgagggttaggttattccggttgtcattagctgggtcggcttttacttggttttcttctctgccacatgggtcgattaacagttgggctgatttagagaagcagtttcacagttatttctatagtggggttcatgagatgaagctgtctgatctcacgtcaatcaagcaaaagcatgatgagccagtgcatgagtatattcaa

SEQ ID NO: 37789 - DNA, 1856 bp, Oryza sativa
ggattcatgctaattgttgtattccttcacccatgcaccaatgtttgattcaatggcaaggcgacaagatagagatcgtgccagtcgacaggtcagttaatgttgctagtgccgatttagctctttgggagatggatggccttgattgtttatctggaaaagtttgggatgaagattttttaagagtatccgattctgatatacagccaattaaagatgaagaacccaagctattattttgagggcgtcgtggagggttcgaacgtctacaccaaggatacagtagatgatctcgatgacaaacaaggtcaaggttttatgtcagccgatgatctggaggagattgatgtaggtccaggcgatcggccaagaccgacatttattagtaaaaatttatgtgcagaatttagaatcaagttgatagaactcttaaaagaatttagagattgctttgcttgggaatattatgagatgccaggactcagccgatcgattgttgagcatcggctacctatcaaacccggggttagaccacatcagcaaccgccgagaagatgcaaagtcgatatgctggaacctgttaaggctgagattaaacgcttatatgatgctggttttattcgtccttgccgatatgctgagtggatttctagtatagttcctgttatcaagaaaaacggcaaggttagggtatgcattgattttagagatttgaataaagctaccccaaaggacgaatatccaatgccagtggccgatcaactggttgatgctgcgtcagggcataagattttgagttttatggatggaaatgctggatacaatcaaatttttatggctgaagaagacattcataagacagcttttagatgtcccggtgcaatcggattatttgagtgggttgtaatgactttcggcttgaaaagtgctggagcaacatatcaaagagctatgaattatatatatcatgatttaatcggctggttggttgaggtctatattgatgatgtggttgttaagtctaaagagatagaagaccacatagccgatttgaggaaggtttttgagagaaccaggaaatatggcttgaagatgaatccgacaaaatgtgcttttggtgtgtcggctggtcagttcttgggatttcttgttcatgagagggggattgaaattacccaaagaagtatcagtgcgatcaagaaaattaagcctccggaggataaaacagaattgcaagagatgatcggcaagattaatttcgttagaaggtttatttctaatttgtctggaagattagagccttttacgccattattacgattaaaggccgatcagcagtttacttggggggcagagcagcaaaaagctagataatattaaggaatatttgagttctccttcagttttgatttctccacagaaagaagttccttttcggttatatttgtcggccggtgagaagtcaatcggctcagttttgatccaagagcttgaaggaaaagaaagggttgtgttttatttaagtcgtagactcttggatgcagagactagatattcttctgtggaaaagttatgtctgtgcctatatttttcatgtacgaggttaaggcattatctgttgtccaatgaatgcattgtcatatgtaaggccgatgtggttaagtacatgttgttggctccaattttgaaaggaagggttggaaaatggatattttccttaactgaattcgatcttcggtatgaatcaccgaaggcagtcaaagggcaagctatagccgatttcatagttgactatcgtgatgattcaatcggctcggttgagattgtgccatggactttattttttgatggatcgg

SEQ ID NO: 37790 - DNA, 4878 bp, Oryza sativa
tgtgcatcagtatttacaaaatccatctcaatcggcttctaggaaattaagatataaggcgttgaaatatactttagtggatgatgagctttattatcgaaagattgctggagtattgcttaagtgtttgagtgctgatcaggctaaagttgcaatcggcgaagttcatgaaagaatttgtggtactcatcaatcggctcataagatgaagtggttacttcggcgtgcggggtatttttggccgacgatgttagaagattgttttagatattacaaaggttgtcaagattgttagaaatttggtgcaattcagagaggcgccagcgtcggctatgaatcctatcattaaaccatggccgttcagaggatggagaattgatatgatcggcatgattaatccaccatcgagtaaaggacataagtttatattggtggcaactgattatttcaccaaatgggtagaggcgattcctttgaaaaaggctgattctggaggtgcaatacagtttgtcaaagaacatataatctaccgatttggtattcctcagactattacaactgatcaaggttcaatctttgtgtctgatgagtttgtttagtttgccaatagtatgggtatcaaattattgaattcttcaccgtattatgcacaagctaatgggcaagctgaggcatctaacaaaagtttgatcaagttaattaaaaggaaagtttctgattatcctcggcagtggcatactcgtttagctgaagcgttgtggtcttatcggatggcttgtcatggatcaatccaagttcctccttataagcttgtttatggacatgaagccgttttaccatgggaagttcgaatcggctcaagaagaacagagttgcaaaatgatttgacagccgaagagtactatactcttatggccgatgaacgggaggacttggttcagtcgcgattacgagcagttgctaaagttactagggataaggaatgtgttgctcggcattataataagaaagtggtacctaaagatttttcggaaggagaacttgtatggaaattgattttgccgattggtactcgtgatagtaaattcggcaagtggtcgccgaattgggaaggaccattccaaatccataaggttgtgtctaaaggagcatacatgttgcaaggacttgatggagaagtttatgggcgagcgcttaatggcaagtatttgaagaaatattacccaagtatttgggttaacgcataatcggctagtattgccgttacatgatagccggtgcgtttgcatcgccttgagatggccgatattgttatatcgcctttagttgttttattgtaatcggttgaggtttgccgatgtacaatggccgatattgttatatcgtccttagtggtttcatatttttatcaatgcttttgacattgtaaaactaggtgggcatatatatctatcacaatacagtgcaaaatttttgagcttctatcacaatacagtgcaaaatttttgagcaaagtgatattgcatattaatcggaatattttagccgattacaaaattatcgagataagtatcgcaggatagctgatatagctctctgcctaatttgttctacttcttctatggcttgggcatcttgagcatcggttctaggaatgaccttcagagatttggtcatatcagcaacattcttgatagccgattttaacttcgctttttgttcttcgatagaccatgggagatcggctaatttcttgttctctaaatccggttcagcattggattcttgaagttgtgctaagagttcgatcttgcgagcttcaagccggtcaatattggatttgatcgggccttcagataattgatcaagcttggatttttcttcatgaacaagttgccgattggcctggattgttgcttcgatgtatttgcgctcttgacgatcggctaatctgagcttggccttttccagcttaaattggtgttgctcaagataaaccgctggagtaaggatatcggctaactcatcggggatttgagcctggacctcatgaagccgagtcctaattgatccacagtcaactaccaagctgtctagtgatgatgtctctagccgatgagagatatcttcaagagttttcttcacatcatcagacaaaggagctagagccttgctagtagtgtcaacctctgtctcctcataaagataatctctaatatcaaaagagaaaagatcggctaagacctgcagtaatgatttgaagagagttagagatcaaataggcatagtcgatctgcatatgttagttataagaaatttactggaatagttggagcagttggttgaacttcttcttctatgtgatgactccctacagctgatggggttcgatggcttgatgcttgttgaataggaggggaaggaggctgaaaatagacaagtgttatataaaatcggctgaaattaattaatgaaagaagtaagattattgtaccggtggagctggtttagatgtcattggagtcgatttcttcttcacagcagccttccttttctgcaattaccaagtatgtgagcaatcggccataaagtgagatgattacaaaaatggttaaagaagggtgctttctcttgtaaaaggagttggagtagaaggagttggaggggtctgcttaggtgaagccgatggtgttctttcagtatcacttacttcggctacggcttgatcaacatcttctgcgatttcttcttcatccagagcttgttcaatggatggatctaggacaagcagatcatcagctggtttagctttcttttttattttcttctttggagctagagctgaagtatctacagccaatgatctggttttccttttcctaccagcatcgactggttctctgataagcccttgaagaagagctgaagtcttgggggcatcatagccgatgacaggaggagatggcccacgtccattaggaattaatcctggggcgtaggtgatatccctgccactgttgctttgacgaggaggagaggattatgttgtctacaaatcaaagaaaagattagttaagataaatcggctaggcagttattcaaatgaaatcaagtagagtcagagacttacttgagggacaccatctggaaagaggtcttgtcatgtacattgaagctggttggtggaatagatgcaacttccattcaccccaccatctatcaaagtttttgctcctgaacattgctagctctaggttttcaatgctgcccagagggggtcctggaaggttgagcagccgatccatcatcaaggttgatgaaatttcacctcggcattggatcttgtcagcaaagaataagccgattgggagttggcccattccaagctgtctagctgaactcattgggtgatagaattcgtaagaggcttggatgtttcttccttgatggatgccgactggaagaatgcatgggttgattgcagctgtgaagatttctctggatgtttgaaatctttcgtgattaatgtcttcaaatctgaaatctgatgggagttcaaggtctgctgaattttcatagggaaaccaaactcgagcgtctttttgaaagccttcatagaaactacagaaccaatctttgagcagttcggctgataactttgctccagcatcggccggtgtggatgcgtattctccatatgacatacatcggcgatgagtgcgttcttcgtcatcttctataattggctctaatattggaaattcagcttctgtgatggatggccgattaacaactttcatgactattagattcaaccaagtctgcagcagccaccatggtccacttgctccgactactgagccgccggctaacttagctgaagcattattcagcatttgatacaagtagccgaggaggattttgcctaaaggaaattgtttttttgcttccaaggcctcggctacgaactgccagttggttgtagggccacagcttgatccacaaaagaggaatttttccagccacatcagcagaaaggctacatgctctcgaggagtgacgggccctttacccatgtatgctgctacatagcctgaccaaccgcctatactcttggtcttgaaatcgtattggttcttcgtgtttaggctcatagggttagccgatgaggtgacatctagacccgtggtcataatgatatctatgagagttggggtcatcggcccttggttgaataagaaggcattgatagtgttggaccaaaagtaagaagcagctgccattagaggttcatctttggctgagtttgctatggttaggtcaagtgcttggctgattccgatttcgtcccagtgaactcttttgctagccgacatgcgcttgaaccatgtaatccaacttttctcgggtgaagttttctcaagggatggccaagatttgaaggtattcttccaatgattcagattagggttggctaatctaaaggggattctgttggtttcaccagtgataaaatcagtagggttaaggttgccgattgggccgagaaagtaatggttctcatgcgacaaactcggaatcgcaaccaggttggacagatgctacaaatgcaagtagggatggaggagaagaaaacaagataagacgaaagaaaatcaatctgctgcggaagaaagagatctagccggtgggggcttacctttacgtattcggccgatggcgcggcggatggattggcggaagtcgacattgccgcgggcggagatctggccggggacggaattgtcttgaaattgcctgtgcggtgaaggggatcgccagaggaaaaaggaagacgtggttcgcttcagcgatgaaaacggaggaaacggtgtgggg

SEQ ID NO: 37791 - DNA, 817 bp, Oryza sativa
ctcaaagataaatgatatgtcatcggcatttagccaatcggctatcatttatggatttaatcacgatttctttgtctttgtttcttgttgattgcaggatcaaatcaactggcacgctcatacatccgaaggcgagttttggacctgcactggagttaagcagatttcccaggcctcgtgttttccatcaacactatccactgtaaactatgaatttataagaattctgtcgggtgtcccatttcttttcatttaaaaaaacttgggaattcatccatgtgcgcaaatatcaatgtacaccaataaattatcaagggagggagaccatcttttgtcccgaaattcctaatgcgcgatcgctcgcgaggcgcgatcaccctctcttccacgtgtttcttttttttttgcaccacattactttcctattttattaaatttatacacctaaagtttgtacacctcaattttacacatctaaagtttatacacctaaagtttatagacccaatgtttataagccaaaagtttatatacccgattcaaatttaaatttgaattcaaatattttttatatatagtatttctatacatctaaagtttatacacctaaagtttatagacccaaagtttataaatcaaaagtttatatacccgatttaaatttgaatttgaattcaaatattttttatatatagtatttctatacataaattttctttgttttttattttttaaaaatttatggtgtagtaggaagagaagaaagggaggaggaagggggagattagtgtgttaggggggggcgatgggggggggg

SEQ ID NO: 37792 - DNA, 2203 bp, Oryza sativa
tatcgaaaatgtttggctaccgcgcgcccgacgaagagaagaaaatatcaggtgcatttcccaaccaccaccacctcgctcttatctccaaccgatgaccaaaccctcctccctcgcatggttgctctcctgacctgccgcgtggtcctcctcctccggtccaccatccaatggctcaaggcggagccactgacggaggcggccccgcgacttcctgtctcgagcgttgcagcagaggcgccggcaggacgcgaaggggtgcttgccgccgccgccgtggcggtcgtggcgtccgagctaggcctgtgactggtgctcccttcccttgcggactccggcgaggtggtcgacgctccagtgggacagatctcagtacgctccggcgcggtaggtgctggcgtagtggaggagcgagggcagaagatgagattactcgaaggtgaattgcgccttgcttcccactgcacgattgatctcgcgatcgtttcttatgctaaccactagagtggacgatcgaatatgtagatctaggttttcattttgaattttttgatgttttagttcatgtaccatgatgttttatgttagatttgaaatgttgttgtaggttttcgatggtgtttcattctttttatcaatgtatttggatatttgtttcatgttttaatacaatcgaaaccgttgtttcacacgttataacaaaatgtttcttagtgtgaatgattgtgtttcaacatattcagcattgaaacatttttatgtaaggtgtttcaattgtctttaattctttgtggatttgttaatatttcaataattgaactttaatgtttcatgtttcaaaacaaattatttcagtccatgattcaaccgcacgtgtttcatcatttaaatttatctgaaacatgagttaaactagtggtgaaacatttttcttacacgtactgaaataacgtccggaattttacaacaaaaatcggacatccaatttgtaggtgtttcgattgattattttatttgattttatattttaaggacccattactaattttctcgtgggccacccaaacggccaaacctcctcatgactagactcggataggggctacatacatgagaaattaggaggacgagaagagagaggtcgctgctaccagatgggaaggcgagctcatcgtgggctaccatggggtttgattactcactacttgatcaagtataagattccgacaggtagtgaattatcagtggtgatgtacataataaagctagagttgctttattaattaatcatgccattacaaaactcgaaaaggattcatgctttgtcgcggtgccggttcaaagttcgttttacgtacctttcgcattctcgtcgtgatagttagcacgacgacgttgatatgtacacgtgattaagaaaaacctaggagtagtacttgactagaaaattaagctgtcttgaagtccacttagattgtaggaaaatgcaatccaaaatttctaaaaatattgaatcttctagtttcagacttgagttccagaagcttttagtagtatcaatctatggttggccatgatgtacatttggtgatgaagtcaagataggagatggatatctctatcagttcttccttgcttcactggccggctagcttatgggataaattccacagatcctaaatcattagttttgatgctaagcttaattaattagtatcactaatccatcgcagattttttggtatggaattattagggcaggtcacgaatggatcggggagaaattaaccttttctatcacccggttgggtttatgaccttaccttgaattctgatagtacactcggcatgtgttttttttttgtctcttttactgacttattcttaatttgcagtcaaccatgtattggtatgttgatcgcctcccattggaaggaaaaagatagtcatatagtacgatagatttcgtaaaaaatattcccccattccctaaatgtttgacgccgttgactttttttaacatgtttgaccattcgtcttattcaaaaacttttgtgaaatatgtaaaaatatatgtatacataaaagtatatttaacaatgaatcgaatgataggaaaataattaataattgcttaaattttttgaattagaccaacggtccaacgtgtttaaaaaagtcaacggcgtctcacatttaggga

SEQ ID NO: 37793 - DNA, 2892 bp, Oryza sativa
aggaaggggggggaaaagaggacttcttttaggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcaaattttaattaattctattattccttttagcgaatgatttttatttcgggatgaatttatcaggacgtgacaaatccaccctccttacaagaatctcgtccccgagattcgaggaggctagcaagaagataggttgggcggtcttttcttcttgtctgacttcttccgtcgcgtcttgacaaacttccagcaaaacttcaccactcggaactgcttggcttgacctcctgttgcggatggaatcttcccttcacctgactggaccagggtgcaccttttggctgactcagactaggttgcggtagtgcagtgatgcttccgttccagaacttctcatgattcatatcttcggagtcaacctcggacaagttatcaacttcaagttctggggttgttacctggttgtcattaattagaatccaatccttttaattggtttttacttggcccccaattcctcgtattagctcccttggtctccgggtgatagctacttctgctatttgatgcaagggtcaaccactctaactataagttatgcttcccaagagagccaatttatcccacttgacatactttgatgtttttcccaatgactttgctgctggacttgttattgtctgaacgtggtcctgccagacctgaagcttcgttgttggaggtgattttaatctgacctctgtagactatcttcgatcatatcacttggttcataactgggaatagctcccacgaacaagcaacgcggattcactttctttatgttcagtttacttcccattattatcttcaggttgtcctcagttagcattcaacgtattcctttacacctttaaccttgatgtgttctttcccattggatcatctcccaagacatggcattacctggtaaccggtgcttgcacttctcactccgtgtagcatctgataccgagttgaagatttcactccttgccttcatagaaacatttttacctaggtcatctcgcttacttaatgacaaggtgactgttgcggggcagttactatcaggggtcgtccttgagcgatgcaaagcatgtttctgtttatcaatcacctttcggcctacttctttcatgctaaagaacatctttgccaatctcttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttctatccacaggttggttattaactcgaggttagtatatagttcctctgacacgagaccctaggtctcctttgtcagtaaacaattatacacatgatcacatatccgcatcttccaaaagaatcctcttagggaacttgtctgtattacacatttctcccttattacacgaatacaaggcactgccttaaacaaaaagggaaggtgcttatcatcggtacattgtatcctcaacatgaatcatctctaaacatagcaagctcactgtttacagacatgattatatttatgaattacatgattgctgcaaactttcgagtacaccatgataagtagcgaactaaaaaccacaaacatggctgctcattttgattctggagagatatagctggcattgttctagtgactgcatccttgattggttctgtgatgatgtgataggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcgatgcagagaatggttgctaagttttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattgggaacttttcccaaaaaaaagggggtttaaaccccaaaaaaaaccccggtccccaaaaggggaaaaagatactggcctctgtcttgtcagctggtggctggggctgaaattgagcattga

SEQ ID NO: 37794 - DNA, 8806 bp, Oryza sativa
  unsure (1)..(8806): unsure at all n locations
aattcgttgcggagcaagcttctgattgcagggagttgcgtggactgacgtgccggcagctatggttctcggttttgggcacttgtcggcgaaatgacccattccttgacaattgaagcaacagatgtcttcccggactcggcattttcttttctcatttcgattcctctgtcctggcactggagttaggctgaaacggtaatcttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcatggggcattcaccgggtggatggtcttcctcacaatgaaagcaggtagtggcacacgagctggcaacatgaccgacttctccacaacgagagcatgccttacgttccatttcatcttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttttgggatgttggcggtgcgctcactcttggggtgagagctctggactggcttcaactgcacttgaaggtgcatttgacttcggttcaaaaatggcattccaagcctgtgtgaaatctttattaaccaattggtcttggtaaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaacattttgcaaatagcattaggggaaggagaaaaaaggaactttcacaaatagttttatttataaaatatgtccttaggttttatccacttggcttatcctacagtcgagatggctctgataccagcttgtcgcgaccgggaaaattgccttttcccgctcgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgttaatttggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacctttgtttaagactagactgagccacaaactaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccacaaaccaataattccatagtgtccaaatgagatgagaattcccaaagtctaaagttataaaaccacctaatgttgcctaattaatcagcgaagcatctacctaaattcatactagtggaaccaggaatagagtacccactagttggggttttgtttattctagggtgaacaaggtactaataacaatagcaataataatgtcataacaaaggtaaataggcatggctaaataaaacagtgataacgcgggaatttaaacaaagcgataatgcaataatttaaatcaaaataattttataaactgggattcaatatgctcaagggtgatgtgacttgccttgctcgctttcccaaacgccggcttcaacttccacgaagagcggatcgtccgaagctgcagcgtctacacgaccaacggaaaagaaaaggcttttactctaataaactccacacaacaagcaggaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaattaaaaatcggattattgcgtcagccgagggggcgggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacttggcagccgcgagggcgcgcccgcgccccgatggtcaccgccggcgaccaccggcgcggcggagcggcgcccgagagagcggagagaagggggaaagcgaacggcggtcttcggctcaccccgggacaacgacgacgacgagaacggcggccggagtgaagggaagcggcggcgcggtttgggaatgacgaatgccgccggttgttcggccggtgcgggcgaaagcggagcggcggacggggttcgngcaacccattcgggcgaaagcttgaatggaaggttggccgcccaatgtccgggaaggaaggacccgggaagctgacgacgggcgggcggcgaacggagctcggcggcgacggcggagagagaggagcacggcgcgggcacgaaaccgacggcgagagcgagcggcgagcggcggaaacggaagagcgaagcacgagggacgattttatagcaacgggagggggagagacgcggccggggagaagaggaaagccgcgcgacggagatactcgggcagccattaaagacgccggcgaacttcgcgggatgaatccggacgaatctgagggagagagagagggaaaagaaggggaatcgggagagggaaacgcggggagtaattcccctctctttaacgcgcgcggggacggcgggatgcggcggaatccgcggcggcggcggcgctagggcacgggcggcggcggcgggcgcggcgcgaggagggagatgacaggtgggccccacccgtcggcgagagtggcgggcgggcccgcctgtcagcggcgcgcgcgcgcgggggagaccgatgggccgcgggggaagagagagagagagggactgggccgagccggcccaagaaggaaggggggggaaaagaggacttcttttagggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagcgaatgatttttatttcgggatgaatttatcaggacgtgacaacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcacccgagagagaggagggaagggggaaagcgaacggcggtcttcggctcaccccgagacggcgaaggcggtggaaacggcggacggagcggaagaagacggcggcgcggctcgggatgacgatgacgacggtgctccggcggtcggcgggcgaagcggagcggcggacggggtcggcaaccactcggcgaagacgatggaggtgacgccgagtcgggaggaggaccggagcgacgacggcggcgaaacggagctcggcggcgatggcggagagagcggagcacggcgcgagcacgaatccgacggcgagagcgagcggcgagcggtggaaacggaagagcggagctcgggcaacgtttaaatagtgccgggggaaggaaagagcggccggagagggaggaatcggtcgcggagatttcggccgccatagatgcgccggcgatgaatgcgggaaggaaatcggacggatccgagggagagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcacgcgcgcggggaggccgatgggccgcgggagaggagagagagagggagagagaggtgggccgagccggcccaagagggaaggggggaaaaagaacttcttttaggattttctttttataaaacctttttaactttgtttatttcttttcaattattatttgtgctctgaaaattccactaaaatttatttaagcattttaggcttttaggaaatatacaaaaatcctctaagcctcatttgacttttttctttgcacattttaattgttggaggctttctcatgaattttaattattctttgcacaatttcgaggatagattttagagtcgttttgggacgcgacacatgccgtgtgggtatggagtatccataatctccacaataccccacctaattgcttcatgtatctataatatatacctcctgctgaattctttattgatttgatttatcctcatgcccgatggtcatacctgaacggccatgctgggctgctcgcaagcgtacatatatgtcatgtcaagccaaatccaaatcatccatccaagggtgtggtaagtggtagcaaagatcaatattctaccttgtactaggtagtatatatctaaagtacgaattgcccccctccccccccggaactatcgcggtcgtccgaattagcccccagaacaacaaaaccaggcattcttcacccccaactatgaataccggacgaattacccctctcgacccaatccgcggtggttttggtctacatggcgtacatgtggcagtctctacatgatcttcccacgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcattaagaaataccaacagcgaggacgtggcctccagcgtagcggctggcacgacgacactcctccttcaggctgatgtcgatacgctgtcctataccctcgagctgagcacacgcccccctcatccaaggcaagtagcccgtcgtactctcctcgggctccgggcggtcaaccttcaactgacagcagatatcagccatggcactgcagcagctcttgagatacgagttcacccagacctcgcgacctcggagggcctccatggcttggtccttcttcacaaccacgagtgatcgctccagttcggtgatttcaaacttcatcctccagtagtcgatacgcctatcccgttcagcgatgacactgtcaagatctgcaaagggtagaagatgtaagagatgctacctcttaaaaaaaactcgcaagtttaaaagagggatttctctaaaacatcacacccggattctcacgtgggagtccgacttcgccagcctcaggcgggcagaaagtcgcatccaatccaccgtccttgacggcatcgctcggggaaggcaactcgaccatctcgacatcaggatctccgccttgctggacgttctcgggatctacataactacgggagacaaaggaatgcgatagatcaacaaatgactcgtaagaggaatctactgcgtccataaaacaacgaaagcgtttttacaaagaccataacacaagacggagaaaaattactcctcaaaaagagggagaacactctccccgagatccgacacgctctccatcacactctcccgcgtggcattagctgcccctttcgccaagatgtccttgaggtcagcgtcgggaaaagcgagcttcactcacgcaggacgtgacacgcccccatgtggattccgttggagatctcctccgcaatatgggtggcgtgccgtgatgggatggtctccatctcgtccacaagctctgacaacgccgacgtcagcgacttctcgtcaggatgcgtcgggatggaagacttcgccccgcacgacaaacgccagttggtgcagccaggtgaaggtcttgcggagggagtcgcggatggaaaagaggttgtcctatgtatcgttcatcctcttctctagaccttggcgctgcatctcgttgccggccacgagttccatcatcttctgaaggtcctcacgggcgacttcgagctccgcctccagttgcgctaccctttcgtctgccgccgtcggacgggcctccgcccgatctatctgggccgccaccacccaagagctgttgtcgaggaggcaatgg

SEQ ID NO: 37795 - DNA, 6523 bp, Oryza sativa
tgactttagcttcagcttctctcaggatatcagtcccgaacacttggctttctccagcttggtcccacaagagtggtgtccggcatttgcgcccatacagcgcttcataaggtgccatttgtatgctggcttgataactgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgaccctagcgaagtagagctccgctagtttattccctccataggtggtcttcacaggaatgaatcgagctaccttggttaatcgatccactattacccatatagaatcatatccaccttgggtttttggaaggccggggatgaaatccatcccaatttcatcccatttccattccggcacttggagaggctggagaagtccagccggtcgctggtgctctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaacatccacgaccaactatgtttaggttcagggcttccatctgttgattaagctcgggtggaatgcctcggacgttgagagtattgcaatggctcttccgacttagagcgtcggcaaccacgttagccttaccaggatgatagtgtattcccacatcataatccttgatgagttctaaccatctcctttgccgaagattcagatccgactgggtgaagatgtatttcaagctcttgtgatcagtatagatttcacagcgattcccaatgagatagtgccgccagatttttagagcatgaaccactgcggctaattccaagtcatgcgtagggtagttgccttcatgaggacgtagctggcgtgaggcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggctccacacaaatttctcttctttcttcaacaactgtgtcatgggtcgggcgatcttggagaagttctcgatgaatctccgatagtatcctgccaaacctaagaaactgcggacttgagtaactgtcttgggttgcttccaatcggtgacggcggtcactgtttcgggatccacagcaactccttttgaagatatcacgtgccctaagaatttgacttcggacaaccagaactcacacttgctaagcttggcatacaattgatgttcccgcaactttcccaacacctgacggagatggtgctgatggtcttcctctgattgggagtatatcagaatgtcatcaatgaaaaccacaacgaacttatccaagtattccatgaacactttgttcatcaagttcatgaagaaggcaggagcattggttaagccgaacgacatcaccgtgaattcatacagcccgtatcgcgtggtgaatgcggtcttcggaatatcttcttcacgaatacgtaattggtgatatccggaacggagatcaatcttggagaatacagtggcacctttgagttgatcgaacagatcatcgatccggggaagagggtacttgtttttgatggtgacttcattgagagctctgtagtcaacgcacatcctcttcgttttgtctttcttctccacaaaaatcacaggagcaccccatggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactacggggatttctgacagttctatctgatgaagttctgaacttctgacagaggttgggggtgcaaagaaaacaaccggttgttctggtcctcggtacagagtgacagtgcgcctcgcgcaatccactaccccttggaattgggccaaccaattcatcccaaggatcacatccaagttcttggtatctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtcgggagttgtcagcacgtcctcggccgtcacgtgattcacacgaccacggatgacgccctggccaccgttgttggggcggggaggcgcttggccttgctgacgccttggcttcgggcatttgtccgcaaagtgcccgggctcgaagcagttgaagcacagacgctgcggacctgaagcgtccctgcggccttgaacgggctgcccagctggcgtaggaggacggggcgcacgagtcccttgttgattctgttgctgctgcggctgtgggacgcgcaccacgaattgaggtcggggcgctgggcggggttgctgctgctgttgctgcgaggaggatccccctgggtagggattggtgtagcgaaccctctggttagcaccctgttgattgcggaaattcgccaagcggcgcttgtgcgattccagctccttgtgcttggcttccaagcggatgctcttgtccaccagtcgttgaaaatcaggatagtccccagagactagacggacggacagctcagggtccattcctgccaagaacttctcttgcttctcctcatcttcccgcacatcctcaggggcgtaccgggccagattgttgaactcgtgcaaatactccatcacggagcggttgccttgcttcaactctcggaattccctcttcttgagagccacgactccggcgggcacatgggttctccggaaagcggcggtgaagcgagcccaagtaatcggttgtccctctggctgcgtagcctggaagtggtcccaccagagagatgcgggtccctgcagctgatgggcggcgaagacgactttctcctcatcgctgcactgcaccgtgtctagctttttccccacggcatgcaaccaatccaacgcatccacggggttgttggagctagaaaaggtaggtgggcggatgcggaggaactcggcgagtttagagtgttggggagggggtggtggagcattctgttgaggtggattctggaggtggtggaggaaagcattcatcatgttggcttgttgggcgaggatttgggtgagaatggcgttggtgtctggtggtggtggtggaggtgggttgccttgggggttggggttgctgccctcgggttggttgccttcaccggtgttaacatttctcctggtcgtcaccatctgaaaaccccacacagaaccagcaaacagagaaggagctaacaattaaaactaaccacccacgactaccattattcttaaatttatcactgctattaagttggttcattaatgttcaagttgcttaggcaaacaaataaagacaggctccgacatagttacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgccgcagctccaggatcttcatgttgttctccaccatgccacgacgcaccatctgatggaagtcaatacgagctgcgtcgtatgcctccaccatgcgtgccagatgcacgacggtggcgtcatcctccgagctagcatctcggaaggtggcgaagtcgcgggctcctccgcgacgagggtggtagcggtagggcgagtgctgcaactcgtccgggtagcgctggtgaagggtgccgatggcgaggagagcggcgttttggcaagcggcggggaaggagtctccgcccgcggtgactgccagcgaagtccgctcgggagagccggagaggatcactacagtgacctcccaaccagcgtgaggctctgcatcctcaccctcctgctccgggagcggcctggcctggtaatccactccatgtggataccccaagaccacgcacatgccccgcagctccaagacgaagccaatcatgtccaaaccacgacgggtgacgctgccggccatctacaaacaaaaacaaaagaaaagcaacattttaaaggccagattttgatgataagtgaagcagcaagacaaagagagaatagcgggttttcacaaataataaaggatttttatttttgaaaatattgctaaggcttgggatctacggctcgtcctagggtcaagggaggctttgataccaacttgtcacgaccggaaatcacccaacaggcgctcccgacgtgcgtgtattattccttgtcccaggaggcaaggtacaccaaaagttgatacaatacagagtttaacaagcggaagcgtatataaaattattacacgggcaacaacggcccagcacactcaaagacaacgaaaaacagcggaagactagggcgacgaccacaggcgcttgacggcaggcacgagctagacaccaaagccttcatcttccaggaactcctcatctgggcttgggaaaattaagaaagactgagtacaaccaccgtactcaacaagacacacccacaaatgcagaataaatgcacgggagtacaagggaattataatataaaggggtagggttgcagtaaacagcatttaaagacatttagttgctcaaagctattttgtaaacacgatcctagaactaaacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattactcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgaaaatatcccaaagtctagagttgtaaaaccgcctaatgttacctaatttaattgcgaagcatttacctaaaatttaactatggtgcc

SEQ ID NO: 37796 - DNA, 3181 bp, Oryza sativa
agcgaagcagaagcctggtgatcgacaaatggaccgattacatccatcaacggccaaatctgcaagggttgaagtcactttggcccttcaaaggaatcagagatacgagatgtcccggttctcgcttacattgatggcggcagccttctcggccgctgacttatcgcaaagcgaggccggcacctcttcggccgtggaaagcgcgctgatcaggacctccctgactcgctgcgccaccgtgtcgtcaggaagatctgaaataaaaaagatgcaaggaagtacggttagatctcgtctatgttttcaacatcaggagcaagaataacgtgcaacgcaaggatgaataccccgtgaagaaatccgagttacgtcctcggttcccgcgtagtcgaatgcggggtgagtgcgggcttgcagcggttgatctgacgactaacgaagtcgtcaacgacttcatagccagtccatcctcgctcgcgaagaccgctcacaatatcgacaaaggcttggagagagggcgtcatcggaggtttggaggtctagtcctcggagcgatctggttgaacctcgggtacgataagaaccgggtcgagttcttttatttcgaggtagaaccatctcgtcctccactagctccgggatgagtggcattgaagtgggatgtatctctccttcatgccatcacgaaggcggaatccacaacatcctgaaacccgattgggttccatccaccagagttcatagaaaaagtggaaaagatcaaggaaaggcactaccccaatgtaggcctcgcaaagatgaacaaatatgctcagaaaagcgatggagttggggtttaggtgtaaaagagaaatcccgtagaagtttaagatcagcaagaggaattcagaaggaggaggtagaaagccacatcggatgaaatcctctaccgctaccatgcgacctaaaatgggagaatgaacagtacctcctgcctccctcgccatggtttgctttggagggatggctccttcggtgtacagcttcttcagtgtggcggcatcggaggaagattgctcgaggtccgccattgggggaggatcgccggaagaagatcactggtgaagggcgcaggagattagggagacgtagagtccggggaagcgggggaacaatgagagttttttggtaaacggactcaaaatggatcccaaaatcccattaaataagcgcactacttgacggttcgcatttcgaggaaaggggagagattgccaccgaaaatttctgaggcccattgaggaccattgttcagacttcaatttaaattcaaaacccgcatagataggctccctaagagcgttatcgataactctatatctctacggttatataaccgagattgatctaacgagtacgacaacgctctattaggagaagtcgcatgcgaggacatgaattcatttaagttgaagtcgggggctactgtcagggttacggataaggcataccttctatccaacaatttatgaaatataccaataaggtataccttcaagtatacggttggttcccatatacactgttagtaatttacctcaaattatggaaaatatctccacgaagttaagggattagagaagtcctacttggaaagggtaaaatctctagtatatcgtgtcggtttacatatctccaagtcttacttgagggtcaaggtatcccacgatataaaagggacccctagggagaggcgaagggcatcgcacctcatcgccaacacacccaccaaagtttacgaagccggagtccacggagccaactcgccgagagatgccgtcgaattcctcgactacgatctcatcggcatcgcgtattcagttactctttttgtaatctgttctcatcatcatcaatcccatataaactggactagagctattacctgataaggagcatgaactagtataatccttgtcttttgtctgttttgatgtcgtactacgtagatccctgttccaacgtaccccaataccctattcttccgatccgcgagtatcactcgtcgacaaaagcttttctgccagattatgcacttgatgaggctccatgggagataaggctacataaatggtacatggaagccagcaagaaaggcctaactaatctaacaattcgatcactggcaaaaactttagcctgtgaaggattcatttggcttgatttcaatgatctgcacgccatccatcgtcgagaaaagatggatgtaaactacgttgttgcatggtgcttgtgagtatgagtgtttatttattgcatgaataagtatgtgatcaattattaacaaattgctattatagtatgcaaaacatggatgctgagaatttagggaaacctatcggatttctggatctaacaaggatctgtcaaactcagcataccgtgagactatcaccaaactccgagcagctcaaggacaagactcctacagagatagcggaatacaagaagagcttgcacaagtagaagatgattattgtcgtacagtatattggacgagctttcttgcacttccaaaataagagtcatcatggttgcgtacaacttcaagtaagtcaagtatatttcattgtacatacctgtgttatttcatatgtgactaactgcatcgccattatgtagcgatcattacatatgtttcattatctacccgaagaccggcatagtgacagtcttggacccccttgattattctcacaagacatataaataatttctacaaatcttacaatagtaagtgattctcatacttgcatgcctactattaatgtattataattaaataacggtccttaatgcgaaacggtaaaaaattccatacagtgcgtataactactacaagttcaggggtggagaacaaacaaaaacaagggagaagcttctagtatatatgtattggccggtacgtaatactaactcacttaatgcatttcaatagttttactcatttcaaaatttaactactttcttctatctcatgaagtgtcacaagcaacctaagggcactatcatctacgggtactacgcaagcaaattcctccgggttaatgggaggtacagggttaacgcagaggatgtaagtctctcaactcaacgtacaagtgtattggagaactacacttctagatcgtactaatgtact

SEQ ID NO: 37797 - DNA, 5160 bp, Oryza sativa
agcaacctaagggcactatcatctacgggtactacgcaagcaaattcctccgggttaatgggaggtacagggttaacgcagaggatgtaagtctctcaactcaacgtacaagtgtattggagaactacacttctagatcgtactaatgtactatcgttctttcagttgcctagaattgaatgtcgaacaaggattcgacgatatgagtattaaaaatgtgcaacgggacctttgccaattcatccaccatgagtgttgtcatgtcttaggcaatttatctaccgcgagtgttgtcatgtcttaggcaagtttttcgacccagacagcatcctggtttcaagcgatgaatataaggttcttcgggagtggaataacgcgatgccatgatgtgtttattagttatagatgatagtgtgtattcgaagtggacaatataaactaatgtacaaatttttgtatgatactttgaatgcaatacatatcagtattgaatgtttattagttactatcattaattatgaattaattaattacaacattattcaaaaaattattaatacaatattgcggctattttcaattcttattgctaatttcccaggcggtcaaatcctatcttcgtgggcgggttttttatatcttcccaagcggtcctcctagctcccttccgcttgggaagatgacgttcccaggcggaccggccacccgcctgggaagataaccgatcttcacacgcgattgcctacaggcggaacaccggcccgcctgggaagcccattttagcccgcctgcaaatattccagtagtgttagctcgattacaaagcacacatacacaaatcaacctgcttatatccatgttactgcatagactttcttgtatttctgcaaaacgcgatgtgttttattacaggtggttatattactatgagtgaatattatcttactgcaaaacatgattttcgtcgtcacttcatgctaaggccattataatagatttgtaaaagtattattgctcaacatatttttatttgataacgacgatggagtatgcattaaaccttcttaaaagaaaacacgcgaaacttattatcatcgttgtaacttcatcgttgtaccttagcataatgtcacgatgggattgtaataatgtgacaacttgattgttaccacatgtttttacatgtttttacagtaacactcttaagaaaagaaaatatgtaacatgctatgttcctgtaaaccttatagtccgtactgcactcctgtagtaatatcgcaatgggattgtagtaacgtataatagacagtactgtagagagtataaatttttttaaaaaagaaaatctttgaagaacaatatctctcacatgatgtactaattctttaaaggtttgcaccatgttgctagaaaaaaaatgtttatcaaaactatattcatcatgactatatttgaactatagtttagcgtcgttactgcaactcgaataatcaaagtttcaatttgaatttgaaattaacttcaactaaaaatcttaaactttgaatgaaaaattgaaaactttcaaccctaaatttcaaactttcaacttatatttaacaccttctcagaatgtttatttattattgtattataaaaaaaagtatgcttgatattcatcattagcgctaagcacgattagtgctaagcacgtcattagcgaacgtgcgcgacaggagagagcgcagaccagcgggaaaaagaaaaaaacgtggcagcttattgggctttgtgtgggtcgtgggccggcagaaatgtagcgcccggcctgcggagccttgccataaaattgtgagttttagggttttgcacttttgctcctcatctcgacgccgccacgggagctgctcccgcttctcctccgtcgctctccgccgccgccgccaccgtcaccctcctcggcctcccgctggtctcctccgtcgtcctcctctgccgccgccgccaccgtcaccctcccttcgcatggcgatgtcgagcgtgaggaaagccttcgtgcgcgccgcaggggtacctagatcttcctctcctccctccctccctccattcttccccctcaatccactggggagagacctaacttaatttctaatacctttttacaggggccgatctcctccttcgctgagaaacggggctcgttcttctccgggccggactgtggaggaaaatggctggaggtctgcataatatctttctctcttttgcataacaaaggtcgatttgcttggagattattcagtgagtaaattgcatcttagaccactttttcttgccattgttgcaacttggactagggaaaaacaaacattttcactttaaaccacctatctttaccggttgtgcaagttaggctagttcttctacctcctgctaaccagctccctcttctcctcagttctctccctccaagggcatttctctctctctctctctctctcttctcgtatcaccgaagccagcgagcggtaaccccatcatgaactgcgccactactcctataggggttgctgctgttggggtgaacacagtactacatcgcccccaattagtacatggtttgacccttatagggggatgatgcaggataagctaacccagccatggtgacagccatctcgtggtgttgcacaaattggacgttgtcgggcatcacaacgatgttttccttgtagatgactgttaagatcgtcatcctgctgtggccctgaagcaatccagtcgatggcagtggacaacggctggaagaataaaatccgtttggagtttgttatgcatgcacgagggatgtggcgagctgcaggttgtggcgactgcgtcaagcgtgcgttgtgggcgtgagttttgtgcggcatgcgcaacgttgagtccaggagttccggatcgtgggatggcacgatttaggcctaggattcttttttctgttttggagtataagtagatttccatttttgtagtttacagataagttcaatgagaaaaccccagaaaatcgccacacaaagctagtgcgtttcgttgtttctctgaaactctccatttcttgttactctctgttcttctcgtttgcttgccggatttaacacagtgctgttcaatactggttcttctccaacaatgacgtgctccagcaacatcacatatgaattcacggcgcggtagttgagctcgatcattacatccacatggcaatgaggaatttcttctgccctttttcttctttttttctgtcaagtgcaaccattgtgccgaagctggtgccggcgttgaagctggtaccggcggagttccagcgcaagcacagcactggtgggtggctgctcaacctgctcacttgtagtggtggttcttcctacccatgagtggagagagaggagaaagagggggagctagaggtagaagaaacagtccaaactgaaacaaccggtaaagataggtggtttaaagtgaaaaaaaattgtttacccctggtccaaattgcaacattggcaaaaaagagtgccccaagatgtaatttactcttattcagttcattttcaaacaaaaagaaaaccccccaatgtgaaggtgttgtttagtttgacaccttatcaaatttgcaagctcttgtagctgagaagaaaataaatgaaaaaaaaatcaaatacaacttgggatttgatgatagcacttgaatacaaatgttttgttaccaacatacctttgatgtttttatttgccctgttctctcccttgtggttcttatcaagccagtttctttgatgccttgtgcgtctcgtgcgaacgtcctttttctttaagcgtgcatcacttagcatttcaatctgctgagcatcctctaggttaggacttcaccagaattttctaggattacttatgtgggaaatccattttttcttcaatttcctttttaaggatgttcagtgcattatcaactagcaaacaacattctggaaaactggccgcttgatgcgccaaagtgagaaatttatgagatagggatttgtagtgaagcatagcttccaactttggattttcgattatgtcgttcctgggtgtcccttatagttacatggcgtgcatcccatgtccatcgcttcaatatgtaatgtgttggcaatatgatctcttctttcaggatgccagggaatggtgcgatcgctggcaatctgttggatgggcaattggctcattgtgtgcaggcgcaggagtggttggtgggattgccgcgaggtacataaggcatgatgtcgaggcatatgttgatgggaagatagcgcaggtcgtatcaaaaaatgatgagttccgtgtggctgcgacaaaaactcattacgactttcaacagaagatcagtgacctctttctggagtatcaaagggagttaaacatgttggctaagagtcacctgcagtttcagagagacatgatgaagctggagcattccatattccttcttcccaatgtaagcaatttttactgttacttctacatctccttttactaaatagtggcaacactttactcgagcacaccacttttagcaatacttgttttcctctccttaagtcacatcaccctttactaggaaatttaactatttgccacttttacgtttgccaattgttcaaataccccttttaggtttgcaattaactatatgccactagagagaagattttctaattttttttgccacttttcgcactgtagacagccacatggccttgccagcgtggaataggcacctgaaatgacaagtatacccttggtagcaattggctgcaatatagagccgaatctgaaacaatatttgggcaaaatgataaacttattactactagctaaatgtataattcatttgactgaaaccatacatatataggactgcaagaacaatgacatttttttgggcaatgtataacatatacaagttgatgacaacacatatatgcacaaggattaatatttgtcagcatacatatccatacatatatctcaacaaactgaacatgcacacaatagcagaagtgccttaattcatcacgtcccatccaaatatcttaattcatagccatacaattcctaggttcattgcaggccacacattatcccaaaagtagg

SEQ ID NO: 37798 - DNA, 6895 bp, Oryza sativa
gtattcgcttgaacatcaactgcagtagcttgggcatcaatggcaccctttgctctcttccttcctacatttgtttttgtcttcttgtttctcttcctgcaaaacattggttaggttaagcaatacattgtacaatagctaaaagaaagtaaatcatagctgaactaacctcttcctagttccagtcagttcacatcttacactacctttcctatatccaaactgttggcagtctggacattgaacttgccttgtggcctttcctttgcccttttcaagagcagatgggatcctattctttctctgcctacccattcctctcttcttgggcacaggtggcaggagcttgaaacctttgtcaacttttggccactgcttcttgtctgtgatgttagggataacacaggaaatttaactatttgccacttttacgtttgccaattgtcaaataccccttttaggtttgcacttaactatatgccactggagagagaagattaatgtgtattcagtggcagctcataatgtgtattcagtggcagctcataaaattttttgaatccgccactaatcttaggtcacatgcaatgctaatctgttatccttttcgtttcagtttgctccagaagaaaagggacctgtgggtgctgtgggaggtgacaggggacctgtggatgctgtgggaggtgacagggaaccagtgggtgctgtggggggtgacaagggatctgagggacagctgaacctgtaacattcaaaagctgattttggtggaggggacttcaactgatgcaaggatggacctgagtgtgcttcttcaactgaagcaagggatgacctgagtgtgttttttgggctgcttaaaaaattaggcagttatgtgacctagactctattccagctcacgtatgtgctctgtggttgctgatctttggacccaatttaaacaatgggaatgtgggatggtcaaaagttaacttctatttttaacaatcaagctgtatcgaaaaattcgcaggttacaatacaaagagaagtacaaaatctaatttgagaaacctctcagtttagatttaacgagcaggaaatattttgtgcactcgagccctcacgtgtacacaccgtgtacgtcaactaacaaacgcttccaaaatatctagaaaaaaaatatacatatactttcagtagcattaggtgtaaaatctcaacctaaaatttattatattttggaaaaaaaagaggcagttttaaggttataattctatcaaaattttatctttttttttactctctatatagaatgaacttgatgcgattttacacgtatatataatactattggaactacatatgtatttcttttttaagaatttctggtgatattttttagctacggcgtgcacacacgagagattgtgtcataggatacactctaacgagcgacactcatatgtgagaggagtactaatacacgtgcatgccttttttttattaggcatgcatgtcttttttttttctttctataaaattttctcttaaattacatatccaatctacaattcgattacactattaagtttgtaacaagatattacatgatcaaattatgatgaaaatatatttatatttgtaaataaattttattatatttttaagttacttttaccatatatataaattaatttaagatttgattaaattacttcttatacatttataatgctctaagttgattatgcttattattatttttagtcaattatataatttgtggactctaaatttaatttttagatataccatatttttctccctacaacgaatttacctctaatgtgtaacaacttacttccattttgtgctaagttgtttttatgatttatgtaaattacttttatactttattgaatttactttcataaatgcatttacttaaaaattttctctgcactttgcttgtgaatttactctacatagttcttatttcaactcagtcataatgtaattatttctaggaaaaaagtacgaattaccccttgatctatcgtggttgaccgaattatccctctacacttaaataccagatattttacacactcaactattgaaaccgaacaaataatcctcctaactcagtctggtgtggttttggtcctacgtggtaatccagtcagcatttttttattaaaaaatcggtagggcccacctgtcatactctccctcccctctctgtatatctctatccctagcttccttgatccctttgctgaagcgcatggctagatgcatcaagcccgtcgagctcgctagccgggtgtaacgtcccgattttcgttcaggattaaaaatcattacataatgcattttctagaaattaaataaaagttaaagcaatttgatcaagtgaaataatgggagaattaaaattttctttcccttctcgggccggccattctctccctctcgggcaggcctcccctcccttggcccgctcggctccctctccctcaagtctgcaatgcctcccccttggctccttcctctccccaagccaccgacagtcggggcccacatgtcggttcctcccccaacctctagctccccagccgaaactgccattgccgcccatgtcgcccccgattctggcctctcccgctcgcgcccttgcgcccaaaccacgtgggatcagttcccctccaccccctccaccaaatcccccacttttccccaatttttggcgccaaatcgagcccccactccgctcacgttgagctccacgtcgccggctgttgccgccccaaattcgccgctccccggctccccgttgctccctcgcgctataaaaagccaccccgtgctgtgcctcttctgtttccccctcctcccccgaggtcctcgcgccctctcctgtgcgagcccgcgctccgccgctcaccaccgtgcctcagccgccgctcggttgtcgcctcccgccaccgaaatcaccccttcaacgcgtacccgaggcacctccgccattgctgcctccggccgcgtcgcgtcgcctcttcgatcgacgccgacccatgccaccacctccttcggcttcacaggagcgagagctacctcggcaaccactccccgtcaccggaatcccaccggaacttggttcccctcgctcgccgatgagtttcaccatctcttcctcctctggtcggcgtttctcgctgcgccgcaactccctcccctaccctaaccttccctccttgttccccaggtccttccggccgccgtccgccggttcccgctcacggaataccgccggaccgccgttgccgtgccaccccgaggagccaccgccgccttcccgtcaccttctcgccgttgcgtgagcacggtgagcactcccctccctctccctctatctccccttcaccggccgtcctatgccgtgtcgccgccgccggtggccgtccggccaggccgctgccgctgttagccgctgctcggccgggccggtctcggccacacccgtgccttggctaccctgcccatggccgcccgtggaccactcccgtggtctcggtccatggtgccgccccgaccgcggtggaccgtgtccaccgtgtgccctccccttgtgccgctgacgcgtggggcccgtctgtcggcgccggtcctttgcttacgtcagcgcttaacttaccctttgagaaaataaataataattgcgcaataagtcgagtttaattctataaatacattaaaatggctcaaaacttctaaaattcgtatctaattcatacgaacttcaaattgggccattcaacttgcaaaattcatccaaaattgagctctacatgtttgtttacttcttatgtactatttacttggtgtttattagagtttttcctagttttgcatgccagcgagtagattccgccatttcggaagtccgcggtcgcgaggaaaagagttcagaagattgtttgaagaatcaaggaaagtcacacattccccttgagcattttgagcctaatttataaatgttgtatcatttggaaataaaattgcatgtcttgctaattacatgggatccgggtattacctatctgctcacttgtgccatgtttacttgatatccgtcctttgctaaacgtgggtgataattcaactagcttgtgttacttatgttgacctagctagactcatatatgcttagccatgcttaattaccactagctcacaaaatgggataattacatgattagacatctagtatcttgatgagctgcgtgctcgaggcatccggccatgtttcatggtcgtaattattcaactaaaatgcgactgaatggtgggctgtgggtgcatggttttgcttgtcgcacccatggcaataattaaggaccggttcacgggaaaccctggaagacatatagtgcttaccataagcgggagtgggtaactgcttgatctgaagtatagctcgaccctttcctaggcaccagtggcgagggtgggcgtaatggagttgggtcgcccgaggtgtccggttgtccagttgccggattcaccgcggcgcacgaggggactgcccacctccggggttgggggtgggggtgaaactttagcgtggtgtggatggttatgggagggttatgcgaagggtcttgtcacaatcactcgacattgtgacgtgtctgcgcaggcatggtgacttgccggtggattgtgtcttgtgggtacagttgtgcacctctggctagagtaaaactattcgaatagccgtgcccgcggttatgggcgatcgaccagattcaccgtgattagtcccatccttaataattggttaatgaactggtgtagttcaggtggtttggttgggcctgttcaacgtggtgtagcgttgatcggtggagatccaatgttactttgatcactcaacagttttactgttttactcaataaaatgctttacatccgcctctatgcaaatagtgacaaaccgttcttgtatctccttgcacgtctacatcattggtgtggcttgctgagtactgtggttgtactcagccatgctattgttccccctttttagaagtgtagtgcttctgagctgaagacgaagttagagtaccaaggcttagaccccggttgagttttgcctgtggagtagagctgaagccccgctaggatcgccttttttcgctgtcgtcgttctctttcggtgtgaggactaagtgcctcttctgtaagtattttacgctttatttatgtttggaactgtatattacttgtcgttttgtgcaccctggctggtcctggatagggatttaatacacaaaatagtctagaaatttgggttaaatttcttgacgtgacaccgggccacctcctcctcctcggcatagcagcacatcgtgtggaaagtattggtggaaacgatcgtgtggaaagtattggtggaaacgattgcactgatcctgtgtgtcgccttcgtgttgatatatatgacatgaaaaaccatgccgtggcaatgcaaagaattgcgcagctaggcaacaaacctagccgacttacaaggagatggattacaggcgataatggataaggcaacaaactctaacagatcagccattatcgcatgtgataggatcggttaaaccagatccaaactaaccttatcatctaacaccctctctcaatccaaaccgtgcaaggttcaggttgctcttgaaattctccaacagtcgcacagacaaaggcttggtgagcccatctgcaacttgatcattagttgatacaaaatcaatttctaaaagcttttgacttacccgttctctgacgaaatgatagtcaacttctatatattttgttctggcataaaacactggatttgctgacagatacttagcaccaaggttatcacatcatatcttagcagctctaggcctcttgactcctaactcagtaagtaaggttatcacacattatttctgctatagcatttgcaatggctttatattctgactttgtactatacctagacactgtggcttgttttctagcactctaagaaaccagatttgaccccaagaataattcggcctctgaatcaattgtaacgtgcccccagcttcctatctgggaccagtcaaaccggccacgcaatgccggtcagactgccctgtctgcacggtcggaccggccacgcaataccggtcagaccgccgcgaccaccggtcagaccggccgtgcaatgccggtcagaccatctctggtctgtggttttgccaattttgcccaaagatttaaagtcaagcaccggcttttctaatatcaaaaataccccattcttcacattatagccagatgcttgttatatcaaattattggaccaaacttccttctctctagacatatgaaaattttaatatccaactaatatgactagatgaatactaattcaagtggcttttgaaacaataataatcaaggcataaaaacatttagccacttgaagtataatcaataatgaaccaccaaagtcatatgtttcacatgcatagattccataaaactaaaaatgtcagtaatcggcttgagcatgtatgcaaaatattataacaatgccaatattcctaaagataacaactctagatagtattaaaacaaatcattatattggccattgacataagccgaattacaaagaagcaaaatttcatggtgcaataattatgaaatctatatcttgtatggtgatccataaaaacatacatgatttggcttttaataaatatcaaataccaataagccaaattatacttaaataaattatatgcccactttctaattccaccacttaaaactggcatttgcaacatgtttgtataatatctaattaataagc

SEQ ID NO: 37799 - DNA, 5529 bp, Oryza sativa
actctaggaaatcaccagtctcttaactttttattccttaggtctccacacttgcttatgtactgctcaaggttctaaatttttacatgtttggtccctcatgtcttcggccttcttttctttttgacctatggctcgaagacgttgtagcctcctcttttgagagcgagataagtcggaagtatccacttcggctgtggttgttttccaggagctaagctatgattcttgatatttttggtcgaagtggaagctcctgtgttgccctcaattttctcaatattctctaatgccacccggtcaggccggtctttgggcccgatcagaccagctacaagccatcggtcagaccggccgtaggccggcggtcagactggcctgttggcctggtcagatcgggcgtaggccagcggtcagaccggccataggccggtggttagatcggccagatgtcccagtcagactcccgctattggcagtcatggtgtcggcttcaaccttttctgcttgtatagtttccaccgcatctccagtaggaacatcttgagactcttccttgataaaaacgacctccggagttttggcttcttttctcacccacaccttcttcacctttttaacctttgatccaccagaccgattcttttgtgagaaacggtcttgtcttgagttagatgaatgacttggtactgtcctaggtgatcccttccatccttgatgaaacagcgtagagaattgaggcatccacggcatgtaatacagaaaaggataaccgaatggtggcattggatatggataccatggcgtcacaaccggaggtttgtatggagttaatattgttgatgactttgattgctttggggttgaccaaatctctttctaggaagtgatcttggtcctcttaaatcactttaggccgatcatcaaatcattgatcggccaatcccttattgtatttagccataagcatctcaaaagtgagcttcggctttttagtcttttgggaactagatgactcatcttttgcaacgttacgatctttggccttagaattattgatcataattgtctcaggccgaagatatctaataataacatttttccctttcatggattcggcttgactaggccgaatcaacactttcttcttgtcaaagtcaataggagcaataggaagggaattactaacaattccggtcttaggcataggtgtaaccgaaataatttcacaagtgaccgatgaatcatcaaccggcctttgctccatcaagcttgcatctttaaaatatcatgaaactcatgctccatttgtgaccaagtagaaatcgaactaggagcaagtaaactaaaccatatagatgcaaagtttaacaaagaaagaggaaacaattttaacttaagcaaatcatcactaccggccgtaccacattgatcaataaagtggctgatatgctccattgtagtcatagtattctcacctgtaaatttcgtgaagttgggcacctcaaatccttgcgggtatgggaccgaatctacgtgttcaggatacggcctttgatatgtacgcatagctacttatttagactctatttcactactatcccgcaagacattgtcacaatcttttccaacatcgacatgaccgatttgcgactcggtcttagatgacagtactatttcgctttcgcttctgacacaatccgaaccgtcagttagttcggctatattttcaatggcactactgtctaagctaacaacataatccgaaccatcacttggttcggctattccattattgcctaaactagtaaacaatccgaaccaacacttaattcggctatacttgttattgcactattttccaaactaataacacaatccgaaccaacacttggttcggctatacatgctatttcattatcatcttaactagcatttaagctattgtcatccactcggctttcctgagccagagcttcatgcaacacatgatcaacatcaagaaatatctggccattcaatctctctttaatataatcaagcaattcattatatgcaatgtcggtcaaatccttttcagctgtattcaaactaaaacatcggcttttagcatctctaaacctctcaatataatcagtgacagattcatcgtgtttgtgcctaaccgatgttagaccagacaccctaaactcagtttcaccagtgtaaaaataatcatagaatttttgttctaattgagcccaagtatgaatagaatttactggcaaagaagtaaaccaagtaaaagcagtaccagacaaagagaaagaaaacaaacacaatttgagaacatcattagtactagcttcaccacattgtgcaaggaactggcctatgtgtttccaagtagtcctcccatcttcaccactaaacttagtgaattcaggtactccaaaaaccacgagggtatggtatattatcaaaataatcaggatacgacttttggtaaaccttagcacaatttcttggctcaattccaaatgcttttctaatgatgttactaatttgctcttccatattctcaggccttggttgtggatttggtggcctaagaattggtggttgtggcggcacaatatgattatactggccataatgcgtgttttgtgccaatccatccacttgatgattttggactagctcatagcaactgttggcacaaatagcatgggtatgtggaatcagggtttatgattccgacgaaatccgaccagatttcacgaaatttcgacgtttcgatgaggctcgaaagtagaaaccgattgagatttcgagatgtttcattcaaattcaaatttgaattgataaaaaagagaaaaaaataaataaaatattataaatactatgatattcatagaacctattgggatataaattttcaaaaaaatgatgtattgtgtgtatttactgaaacttacatcaggaaagaaaagaataaataaagaattaaaaaaggaaaacacttacatgggccaaaaccgaccgcaattaaaaaaaggaaacacttactgatcgaaatctcgccaaaaccgatcggttttcgagaacttgtcggcaaactcagggaatttctattcaaattttggtttatgaaatttgttcggaatttaccggttttccaccggattttgtgaaattccgaattgcgctagtgttcgaaacagaagggattgtcggaatcgtaaaccctgtgtggaatagcatgactaacaacattaacatgaggcaaataacaactagaatcagtactattagtcatgggagaaaatcctggaagaggttccggggcatcggtctgaccggctatagatagcccggtctgaccggccaagcacccaatctgaacgggggtcagtgatgcagccagactggccacaggaggcatgatctggccaagataaggcacggtctgaccggcatatggtacggtctgaccgggcgtcatgcacggtccgaccgttggctaggttctttgtataaccgattcctgtggaatcggctgtgtgaacgcccgttgatctatccattgtattataggtacattgtatatatgcaaaagtagaagtagcattatattgttgataactggctattttagagccagttttcttaatagattcatcaaatgtggttttaaaaacatcttctaacatatcatgatttttatcaatataagcattaatagatgcatctatacaacgttcaacatgttttcgaataacaagagatggatcgagcggattggaggttaccttatcagggacaagtttgagaggaggaccaggtttgagaaccacaccttgatgcatgggtcctgatgagcgatctcgccgggatctcctccattatcgcctttattcgcttctccatgacttgacgctgctcctcatcaagatcctccaatgtgatctcatcgatctcgttcctgctcgtcatggttgatgaataaattccttgattaatttcggccatatatcttatagccgaaacatttgacccaatagattaatatacagtcttaatttccttggtatgttactatgtgtatgtagcaaaaatatccacaaatcaagaaatcagtagccttggtcggccgatctcttgtgtattgtgggatgtgtacacctagcaaagatatttgatctcttggtaaacaactgagtaaacctagcaaaaatttggaaactaatctaaagccttacaggacagccgatataattgaatcggctttgattgattttttttattggaaaccgatcttgatttcttttctcgggatatgtgctaatacatgcgacacaggatcggtattgctcgctgtctattgcttgctggccttgatgtatgtgtgtacacagaaagcacaaaactgaagcaccgcatccttgatttgccactgaacctacattgttatagatatatgaggatccggacccatatattatagacagtaagtagcaaataattaattgacacatcttaaaatgacccaaagttaaatgttccccaggcaaaaactcgtcactgctgctcgtctttgaatcggcttcggactggtaacagccaaacgccgaaactttgtggcgaaggcaaggacggcactcggcgtagattgaagcagaaacgatagcagtggccgaagtatagattaattccagccgtatggccgaaaatcgaaacatttgattcgacgaaactatatctgaatatttaaataaaattcggtcgtaatatggccgaataaatcgtttcccagcggagtcatcaaaaatcatgttagcaacttctttggtaagaaaacaatcacgatcgggacatctaaacgccttgcggtaatatggagttgtcaatcaccccaatctagccaaatggtcaaatcaagatggattttgtagaaaaacagctaaaccagctagcggagccgatttagatatcaaaaccagcctctaggccgatttagattgatatgaggataactacccgtcgcgtgggtgaacggaaggtttacgggacaaacctacaaagaaataatcgcactctcgcggtgacggcgaacgatttacgatgaaaatagataaagatggactaaaactaaaataaagtagaaagcatggctaaaaagtaaaagaaatatgaaaaagcgattcaagtaggttgtgtgttgttggatagattacaattgaaccggccttgtcccttatataggggttgatcttaccctctacatgcccttctccacgtccaactcagactagaaaccaatagaaacccgaaacctgccttcccgagcaaggaaacccgagacctgacgaaaacggagtttgactcggactctgccagtcagaccgaccacatgccgcctgtttgaccggccctctggcagagatctgaccggcccacatatggcggtcagaccggccctctctggaggaaaccggcagagccccaaactttaccaatttttcctatttgttaattctagatgctaaa

SEQ ID NO: 37800 - DNA, 5666 bp, Oryza sativa
aaatgagaatggggtgaactttaggtgctattaaagtgaaccgatatcttcgatgctataaatacaaaaacgtgaactttcaatgctatataaccaatttttcataaaaacaacgataactttgcagtgaacctagcttatgccttcaatgacacaatcaactcctagtctctttttgaattgcctttttccggacagactctatacctagtcaaacaaaagggcgattcccgtgctcgccctgcttgatcgagctttcatcaactactggaataatcttgtagctttcatcaactactggaaaaatcttgtccaaaaccccaatgtgaaatcactcaggcctcatttgacagaccgggatcccggcccatatcccgagaaaaagcccgctagaaaattttcctacgaccatatttcctgaccagggtgtgtttagtttacgttaaaaatagaagtttagttgaaattggaatgatgtgatgaaaaacttgaaagtttatgtgtgtagaaatgttttggtgtaatgaaaagttgaaagtttgaaaaaaaagtttggaactaaactcggccttagggtgtgaccgtgtttagtttccccctattcccaactttccatcacatcatatcacataaaatctttcctacacacataaactttcaactttttttccaaactcccaactttcttcaaacttcaaaacttttttcaggaactgtgtttagttcacaccaaaattggaagtttggttaaaattggaacgatgtgacgaaaaagttagaagtttgtgtgtgtaggaaagttttgatgtgatgaaaaagtctgaagtttgaagaaatattttggtactgaacacggcccaagaataagttcatcgaaggttcctcaacttaacaacgagatttttcgaggtcccttaaccacaaaatcaaaaatatatacccctaaacaaactcactgaaaccgttcaaaaagaggtatttttatttggttttgctgacgtggcatcctagtcagaaaaaattacgtgggacccacatattagctgcacaattttttccttctcttttcttctccttatcttcccttttctctcctctcttctccggcagcgggcggagagccaggggagtggatggcgaaggtggagccgggtgtgctactggcgctaccgccgcggcagacggaacaactaaccgaccatcgctgctccgcctgcctgctacgcccgtcgaccgctcgccgccgcgctcgcccgctcccgcccccaccgatgggagcgaggcggccggcctcggcggcgtgagaggggcataggagggccgagagaggggcggaggcgacggcggcggtgctgccgagttcctttccctgtcactggtcgctgaccggtcgagggacaacatcgacgccgtgttcaacccccaatggcgccgtacaattctactgcttgctatataacttaacgattataaagcttgaaggataaattgaagcttcgcttttcttgagctatggtgtttctttgcgttttcttctttgcagcgaggtgaccaggcgctgtacaacgggttcggggccgccggaatgcatggtgacgccgtcatgcagccgccgacattcgggcaggtacgcggccaagaactcctgtgggttcaacttatcccccgattcattctgcttctttaccagcgttggaaacaactgcctgccgccgcgctcgcctacccccaccgctcctgcctgcttcgcctgccgccgccgcgctttcccgctgtcgccccgcccgtctcggtccgtcgaagaagacgacagaagagaagaaaatcttaattttaatcttaactatttaaaagatttggatttttcctttcgtcacatcttcaccccgcgcggtttttagtcggtaaccccttttttcgtccgtaaccctgttttttttttccgcgttttccgtttttcccaccgcagcgtccacaacagcgatttctgctatccgatttgtgatcggatctaatctaatatgacgctacttttcccaccccatcaaaaaaaaacaccgattcctactccagcgcaaatcacgcaaaaaaaaaaatcccataccgattcctactccagtctaacagattaagcccacaagcccaagtttaaaaagaaacaacaccgattctaatccagtttgcgtgcacaggttcagtatcccccacaccgattcctactccaatttaatattacattacattacaggcaatatataagtataaataatagaagcagacaagaaaacatatatcacaaggctcttcctctaaaacatcaagccagctttcaatcaggcaatagaaataatagaagcacacaagaaaatattaatcgcaaggctcttcctctaggacgtcaagcaatctccaatcaatgtcgattccaggttatcaaccaactcaatcctgaatgcaattttaatttcataagataagtcagcttatgaattcgaactaacagtaccatcataaaataaaagaggtcaaccagacatacatgaagtttttatacagaaattaaagaggtcaaccagacatacatgagccttgttttcagaagagaatgtttagctgagcctttcatatgcacaaccaatgctatgtatggttttttttcccgtcgatgcagaacagttagcaagttagcaacagtcaattttttcaagttagcaacagccaattttttcagttgtccagcggcacatagcaacacggaagttccagacgggtccttcaattcagacattcacatgaatgcagaacataaatcatgcacacaacaaaatcatcacaagagcttgcaatcaattaggctactcaaaatgattgttcagattagacatataatgttttggtgttttcatactactattacttgactaactaaaatatacaggatacaagcttaagcttgcagtaagtggaagtgcacaatataagaaccatgacagtaatctgattcctacagagataacatatcaaagacagtaatatatttgatatagtaccagtcataaaccaatcaatctataaccagcaatattgcgcagcgattagaggtggtgtgggaattgaacttaccatatatcttacctattgaccatatattttcttcctgggctcctggtgtactgccatacccaccatcacccccattgctgcccaagtaaccactagcaccaggcatcccattgctacaaaagcctttgggtttagtgaacctagatttgtgacctgcaaaaaaaattttggtgtcagttggaagatacagaattagacagtgtcaaatactgcatgtgtcctgaaactgatgaaaattacagatgtgaatctcatctatgattagttaagatgtatttgtctctatgtgctgaaatgccattgtttcctatttcaacaaaaaatatcacatgaaagcatcggcattcaaccaatatagagtaacaggacaagtttttaatcaatattgttacactactccacctaccttggttgatccactcaaaccaaacaaatcaaataaactagggtctgatctaattattctgacaaaaaatagtgaaaactcaaatcaacttaagaaaactcaccagttcaagcacctctactgcgggggggtcaattgtcactggatccggcggccacagcagcatcctcgttggaaaatccatagaggtccaccttcgtccgacaacttgaaccctcctatccggacgaccgaacagctctgcttgtacaactcgacctccagattcgtccactgcaccatatcctgagacatccaacaaaacaaataccaatcagaccaaatagtgatcatgggggacatcacgagacaagaaaaacccaccggatccggcatccactactcaatcggcctcctcgtctccgaccgctccctccgcctaaagaacgagaccgccccaatccgctcggcaccgaactggaccatcgtggcagctcgatcctacgatgacgactgccacccaacggcgaaggccgatccatcgccagtgagctcgggggaattggatccgtgccggcggactcggtggggggacgaggaaggggagctgaggagagggagaggcgccgtcggtgggtggtcgaggagggggatcggcggagaaggagggcgtcgctgagtggcggaggagaggagagaaaaccgagaggaaagaacgaaaggaaggaagtagcagaaggaggaaggcgatggatccatcgagagcatctgagcacgacgaggagaaacatggagaaagtgacactgccgcctacgggaacccgccgcccatcgagggcgcggccgccgccgccgccgccgctaccgcctccgccgggcaggcgccagcggcgagagcccgttgcctcccctcctgccacatctagcggaggggagggcgcggccgccgccacctcctccgctgggcagccgccggctacgggagcccactgcctcgcctcccaacgccggatccaccgcccaccagcctcgtcgccgccctcgagcctccccaccgttggatccgccgctcaccagcctcaccgccgccagccaacgatggagatgaacatggtggcggctggatcgacgcgaggaagcagcaaccacgacttgggccagtggtggatctggccggcccgtcgccgtcgacggcagaaccgcaggatccaggcgagcaccactgccggccgccttggtgagtagcgagagattaagagagagtgagagatagaacgggagagagaatgatagagttagagagtgagaactgcttggagagtaacgagagagagagagggacacgacactgtgacagacaaaatgggagagagaacgagagagtgagggagttataggataaggatgtcgacagaccacacaaatttatctcctcgctaatctttcttctgtttttaattatgtaattatctaaaatcagaataatataggtctcgttcctttctccaacaagtcttggatgaagattaaaatttccatgacacgctttttaaactgctaaacggtacatttcgtgcgaaaactttttatataaaagttgctctaaaatatcatattaatctattttttaagtttgttataattaaaactcaatcaatcatacgttaatatcacctcattttgcgtaaaaaaacttaatattcaacttcatcttaccgagaaaagaagatgataaaaaaagtatgaaaaaccggaaaataaaaaaacgaaggaaggcaagaaaaaacaattgtttgatataaaaatatagattgtgaaaaaaattgtacaaaatcatcatatgttacgtggccggtctccacgcgagtccacatatgattttagaaactaagacgcatgctggcaacgcgagagtcgacaaagcgagaaagcacacgtgtccactacgaggctataaataaatacccaaaagtattttttatccatcctgattatcatcggtattacgataaaaatgataaaaatacctatttaaaatatatttttttaatcacaacaccgggtacatctataagttcaacttcatcaaccgcgacattaccggtgcatcgcagcattttcctagtaaggccttgttcagttacgcttggattcaatc

SEQ ID NO: 37801 - DNA, 21241 bp, Oryza sativa
ctcttggctagtggattaattggtttccggacccggaataaatcccggtctctcattgtatctatcataaatttcttactatacctgtcattcctagcccggattgaatccaagcgtaaccgaacaaggcctaaaggagaaaagagaagaaagggaaagaaaaaagaaatgtggggcccacatctctttctctcactgacatgtggacccccacatatttattttattatttttgctgattaggatgccacgtcatcaaaaccagccatatatactgccttgggacctaaattagacggttttgtatagtttaggggtgaagatttctggttttgcggttaacggatcataaaaaatctcgttgttaaattgagggacctccggtgaacttattccttcctgagcatttggaagcccacgagacggatttccctgacctaatccacgtgatatacccggggaaacctcccacgcctcacgaggtcgggaaaaaaatcctcgctgcggagccgcgtcacctctgcggctcggcgcctcttcctctcgcgagactcacgaccgcgaaacaacacctactcgcgagacgccggcggcggtctcctctgacgagacgccactgcaggcctctctccttcagacctgggccacggcgacatacatatgtatatacttcgtatatctatatctatatatacctacttaaaaaatacataaggttttcggtggtaattttcatccgtcgttttctttcgcacgcggtatttttttttctcacacgtggttttttttcttggtttttttcgtccgattcttctttttttaggtcgtccgattggtttttttcacgtgcggtttttctggcccagttttttcgtccgattttttttgcctagttttttttccgattgctttattttgtgggcccggttttttccaaaacactgtttttgaccgtgggtctcaaatttttttggtgggcccggttttttcctacctgttatttttttttgaaggatatcccaaatagaatcgtataaaattacatggctcaagaattacaacccaggaattacattcagaatccaagaataaaaattacatggaaggtatgatacaaacatcttctcaacctatataaagaaattgaaaacacaaacaagactcatatatatacacccgatatttggtgtggatattgagcaatctcttgattgacgctactcatatgcgctcaattttttttttaaaaaaagaccaatttgttgttggacgtgattctttaacccttaacaattagatttttttttgcataactttagaagcaattataatcaggatatgaatagcttgtaatttttgtaaattctgtcatattaaatgcatgtaccaggagaagaaatacaacttatttatcatgcataattaaatcattatattaacaagatgatattggcagtaattacctgaatattttttaaaaaaaatccatgacataatagtgtgatagagacataaatatatccaatctaacagtcttaatcaaccactgacaatatttaaaaactgaaagcatgcataaacttcacacaatatccttcagtagagacataaatatattcaatctaatggtcttattcaaccactggcaatacttaatacccttaatgccttgagttacagtagcttgttctgcatatgctactgtaggtggttattcatcacattcatatgccaacatggtttaaaaaaatcaaaacaataatattgactaaatatgctactttaaaggaaaccggtttcagagtttattatttctatttcccctatctttctctgaactcggtgcgcaaaagtattacttaatgcagcaatagaacacaagtgaaataaacacctatggtccatgcagaatcaacagacaataatatagagctcttaaaaattccaaagcattaaagggggcatagcaaatacagtaggttccaatttagccatgcaaccaaacttattttgaacaaaaaaaaattcacctgaatatttttttggcaaccatctcgattccataactccaacccatcaaagtcaacaaatctcatcttctgtctccttgaaaacctggcaacacacctaaacaaatataaaatatggcaagaaatacaacttatttatcatgatgacttaccttgctgcatccagatcaagataaagttgtgctgggattttaaccatgattgtgtggtgacactcaaaatcacagctaactgagtttagttcagagcatgcaagaacaacaaacaggaataggggacagcaggatgaacattacattttttttgtttttttttgtgggaacattacatatttgttggacttgatatcggagtagatcactatgaaatcaccctcctacggctcatttaaatgaacaaaatcacctgaaaaacataagacatcaatcaacaatataattgagagtgacaattttagtatggcagttactggcttatgactaaatttgaatgattcaattagttggccaagcaatcataatatctcattttccaataatgggaaaccaagaacacgagaacaccaggaaagcgagataggaggtctcaccggcagataggaactgggacgccgttgtggcctgcgggaaagcgagtgcgccgtccaacaccggcagccccaccttgccgcctccggctccgcctgcaagaaaaccatcatccagcgatgagtcagccactcgaccaagatcgtcgtaatgattaactaataagtttacacctaggtcagaaaccccaacaagcaaagaacacacatccatattgccgggcccctacatacacatacacacacacaaatttatgtctaaacgtgtaaccaaataactcggaaaatgttaatgaaccaagaacgcacctgaaatcttcagtaccaccgctcgggcgctcggtaccaccactcgactgcgctctcctcggtgcaccttcgtccgcaagcttgaaccctcctctctggctggccgaatagctagcaaaactgacatgttatctaacctgccagtaagcaacaagattactcctatgcaagatgatccaaagatttcacatgaacaatatgatatattgtcaaagaaaataaagtacctgggcgaaaagattgcgatggcgcccaaaccacatgtgtcgccatcgtcgaggtcgtcgccccatctgccagtctgccaccccacctccgtccctcccatcatcacccgcggcggatcagcacgaacggagggtggagagacgacggaggtcgccggatcgacccacccatcgccgcggacggcagatccgcacaagaggggagcggagagacgacgggatccatgcaggaggggaagaggtcgccggatccacccctcccgtcgccgccgacagcggatccgcgcgagaggcgctagcggcggaggtgtacaagctgaggaaccaagaatccaccttaacgttagggtgcagatcgcacgagttgaggcatgccgactacagcgagctcatgaggttagccatctactcgccggcgtgacggtgccccggaacaagacgaccacctcgcaaaacccgagccgccgcgtcatctcgtcgggggacatggcgaagtacccgatccaccgccccccggcaactcgacgatggctccatggttgatctggtgggcaaaactagagaaggggatggagagagacggggaaagactgagagatagaacgagagtgagagactgggagagagagaacgagagtgacaggataaggatctcgcagggttcaccataccgccgataaccgcgcgggttcaccataccgccgataaccgcgcggttaccgcggttaccagacttaccgcgggggtacggtaatataaataccgcggtaacctccttaaattcaaataaatttaaaaaataatttgaatttttgataaattttgcacggttttgtacggtttttcacggttaccgcggttaccgcgcggtaaccgtgcttaccgccggggtgcggtaaccttgactccggcggtttaggaaaccctgaatctcccaggcagggttcaccataccaccggtaaccgcgcggttgctgggcttaccgcgggggtatggtgatataaataccgcggtaacctccttaaattcaaataaatttaaaaaataatttaaatttttgataaattttgcacggttttgtacggtttttcacggttaccgcggttaccgcgtggtaaccttgcttaccgccggggtgcggtaaccccgaccccggcggtttgggaaaccctgctcccaggcgatcactcatttttctcgcgtcaatttttctttattatttttagaaaaatctacgaccttagattggactgggttgtaactacatttgctgtgtgctatctctgcacacggaaaacggaatggtccattaacacgtgattaattaagtattagctatttttttaaaaaaaattaatcaatatgattttttaaacaacttttgtatagaaactttttgcaaaaaaaaaacatgccgtttatcagtttaaaaggcgtgcgcgcgaaatatgagggtgattgattgagaaagttggggaaagaactcagaatcaactcccgttgtgttgctaatccatggattgaattctgctaaaaaatgatttattttattaagtttttttatttaagataaaaagatgtttattgtaaaaaataaaatttctcacgaaacatgacatattatgataaaattacctattttaaatacattttttcaatcacacaaatttttgtccatcgactattgcatgaaagtgaccaagctattcaccgttattcctcgtttattcctcgcatggtacaatcatcgcactaaagtattatatacatatcacactaacgcatcgtgtacatcattcatatcatgtacgtaaacaggaataattgtccaaacaaaatacactttggcgttgtttagatcccctgccaaaatttacaccctgtcgcatcgaatgtttgatacatgcattaaatatagatgaaaaaaaataactaattacacatattgcgtgttgtcgacgggtgatacccgtagaccggatatagagggtattgaggtacgttggtacaaggatctacgtaatacgacatcaagcaaatagaagacgaagattatactggttcaggccccttgataggtaatagtcctaatccagttaatgtgggattatatgatggaaatcacaggttacaaagggaacgatggaactcgatgaaaccggcgagatcgtaaccgagttggttcgactagatctcctggcgacttggctcctgcaagctccgacttcgtaggctgtggtggttgtgttggctatgagattcgatgccctcggtcctcccagggggttccttttatatcgcaggtcaggcggtttccaagtagaactcggagacatcggaccctacacgatacattgacgacccagtcctgtccgagtaggactcttattctctgcaaacttcgtaaaggatttccttagtgtatgtagagaatgtccatatatgcgcgggcatgccatatcgatatgtaacatatatcgaagggtaaagggtatacctaacccgtaaccctgacagtagcccccgacttcggcttaaatgaactcgtgtaaccaatcgcgacttctgatgtcgaggctgatgtcgttttcggtgtgggaaccatagagacaggacatagtcgagaacaccatgtgaagcccaatggttatgtgtgagtttaaactgaagtctgaaagactaccgcgcgtaacggacccagaaatttccggcggccatctctctcctttccttgaaattcgcaccgtcggaagtgtgcctatttaagagagttttggggatttattttgaagtccgcctgttgtggaaaaaactttccagcctccaagcgcatctcatcttctccgctcccgcaaaaaaaccctagcttgttaatctccgtcctttctccagcgatctttagtcggtaatggatctcggcaagtctacctcgaccaacgcgtcgctaaagaagctccaggaagatggcacccttcctggccatggagccatggagagagaagttgaaggtactaaacgccggcctgtcctgggtcgcatggttgtgatcgaggactacattctgtgtggttttctccctccactttctgaatttcttctcttgattttgaacttctatggcctttctttgctccatttgaaccccaattccattgccttcttaagtatctttgcacacctttgtgaagcctatattggggtatagccctttctcaatcttttccgcttctactatgaattgcgttggatggaatccaacagagtgtctggatgcgttggattccgacttcgggatggtctgaagtcgcgttatatccccttccagtgcccttcttctcgtagcaaatggcgggcaaggtggttctatcttcagatagagaattcggatcctgtctttgttgttcctaaggaacaaccagacaagatttcgtcttggaccgcaaagcctaccttgacccccgcccttcggttcttcgtcgaggccatcgatgacctccgagtacgaggtttgtcggggtatgaagtcgctgccaacttcgttggtaggcgaatccagccgctccagactcgagctcatccagcctttgactattctgggccggaggacacgacccgggtttctcctcggggtatttttcttgtgtttgatttgacctccttataggcatgctcctcctggcttaccgaattccggttcttgacttgcaggcttgaacagcgaaacggtggagcgctgcgtcggccaactgatgatcaacggcccgacaacggcaagcgacatccccgtccccctttgtgagaaggaggcggccgatcgtgaaaccgcaatcaatgtgagtgtattcggcgacccccctctattcttgctcctggatcggataacgacttcatgcggtgcaggttctccctctgactgacgtcatcggaccgctcgtggatcaccaggcggcggcctcgctgaaagagtgtgtcgcgcatggggcatccaacgcggccgctgctgctgccacagcgactagcgggagctgccccccaaggaggggaaggaagttcacctccgtacttggcagtcgccggaagggtcctccccccggtaagtttcttgagccattaaccttgtaatcggaaaagtcgttcctcaaatcatccttggtttactaaggcctccgacgcgtctccgccacctccacgacggcaaaagttggtgacgctaggcgagaagtaagtaggtggagattgagttctttcctttggttggagatctggcgactagtcttgatattcggatgccatgatcttttgtaagtgggcgccagcgaaagccgcgcaagataagtttggtgagacctccagcgtgtctcctgcaacggtctccactgacgtcgtggtcgccccacgaagtcaggaggcgacaccccacggcctgtccggtgatctcgggcctgttcgcggcccgcctgcggacgtcctcagctggggggagctccaagtcgagatggggtgcctcctcgaagctagcgctcgcggcataagttgcgagattgctgaggcgaggacagcggcggcgtcgtcggctaacgagcgcgccgacaagctggagcgcaaactggcggaagttcgcgaggacctccagaagatgagggagctggtggccggcaacgagcgacagcggcggggtcttgaggaccgcatggcggaactcgagagtaacctatcggagctccgtggctcgctgcgagtcactttcaccggcctacaccagctcgccgggcaatgtggtgtcacgaccacgatcccggcgaaccccgacgagttctcgctgacgtcttcactcgcagaactggctacggcgatggaggcgataccctccaagcacgcggcctggatcaggaaggagacatccaatgggatctataccggggcatgtcatgtcctcgcgtgcgtcaagttggcacatccgaaactcgatctccagcggatcttggagcagggggcgacgaacgacgcgcgtagaggcgtgatggaagaagtcagcgatctgggagagtctgttctctcgctctttgaagagtaggaccttagttcccctgtgtcttttctccagttacgctttgtaaaaacatttctcaacctttttgcgtgtgcagtcatcgcttcagttttccccaacattttttatcccgagcacttgttgtcctttgtagagatgtcgatgtcgaggatgtccagcagtgtgggcagcctgagtcatcagtgatccttccggatcttgcatctgagggacccacgtcgctgaacgatgtggatgaaattttacccgcgagaatggggacggcaacgactttcttaggttggtggtctcttcatcccgtttcgctcctccgacttgatcagccgtgttctcgagagagaaaagcagcttgacttagtcgtttccatattgaacagatctcgagaatgcacttgctgaccaagatcgtcgtatccaatattggaagacaaaatttaaagtggcggaactcgagagagctatgttggaagtgaagaaggagcaggccgtggaaacactccgaggtcgtgaggtgtggttcaactcgtatttgaagagttgctgcacgtccatggcccgagtttgtagagagctccgagtactccgcggagatcccgaggagtcagcggccggatacatctcatggctgaatggggcctgtactcagctcgaaggcatcggcaagcgcatcgatgaagccctgaagcaggaatgccgtcgatcgagccgatatgctggagggcatgtgttgtcttgcatacgagatcatcgtccgcaactgcacctcgagtttctccatgaagggttcgctcgttctcggaggactccggcggagatagaccacctggcgaagtcgatggcgccgctggcggagaaggtcttccagtctatggactggcgttggccttcctggtagtctttgtatcctgtgatagatatcttaggaaaaaggtgtaatatagttccggacttgtgtggaattgtaagaagtatcttgtgaaatagaaaagaaatctatcttaatgagtccttcttactctggatgtagtgtgtaagagtgcctcctcagttcccgactttagctagtcatttgagtcgtacactctccctagcccccagccttgtcgtcgaggaattcttctcggaggacaaggctcttggacctttgacctgcctcggttgagaaagcactgattctagccctcaactgtgaagttggaaagttaatttctgattacacggcttggttaatacgcacggcgagaactcttacacgaccaggtcttacatggtctttcgtctctacaggatccgacaaggccttatcggctctgggcatccccagccgaagatcccttaggttcctcggaggccttgtcaggacggcataaagggacatgaggataggtttcaacgcaaggtgtcatctgggtaaggggtcatcaggcaggaacactgtgattgtaatatgcgcctgaaaataggctttattgatactgtaaggtgtcttacaggtatggattgtattgactcatacatagaatttacgtagttggtcaatgttccaagaatttgccaactcgcggccatcgccgtctacaactttgaatgcgcctggccgcaagacttgtgtgatcgtgtaaggtccttcccatttgggtgagagcttgtttcgccctgcttggctttgaactcgtcggaggatgtagtcgccgatcgaaagtatgcgtgctcggatgcgcttctcgtggtaacggcggagggcctgttggtaactggctgctcgaacggcaactcgttcgcgatgttcctcgagtagattcacatggtcgtttcgctgcttctcctgatccttgtcggaatacctctgtattcatgtactttgatatcgtagctcgctggggagcatggcctcagagccgtacacgaggaagaagggtgtttccttgttagatgttgtcggtgtggtgcatacggcccatagtactgatgggagttcttcgacccatttcttgtcgtgtgacatgagcctgtcgtagacacgggtcttgatcccttgtagtactatgccatttgccctctcgacttgtccgttgctttgaggatgagaaaccaaagcgaaacatatcttgattcccagcctgatgcagtaatcctggaaatcggcgctgatgaactgggagccgttgttggtgatgatgcgatgtggtagtccgtatctgcaaaatatccctttgatgaatttgatggcgttgtcggccttgatttcccccgtgggtatcgcttcgatccatttagtgaatttgtcgattgccacgaataggaacctgtagccgccctgtcctcgtgggaatggcccgagtatatctagcccccagcacgagaacggccaagtaagagggatagtctggagcgcttgtgcgggtagctttgtgtgtttattgtggaattgacaggctttacaccgctggactatgtcgcacgcatctttgagggcggttggccagaaaaacccttgtcgaaaagctttcccgaccaacgtccgaccggcggcgtgtgacccatagatgccttcatgtatatcaaggaggaggtgtctaccgtcgtcggacgagacgcatttgagaagtaccccgtttggcgctttcttgtatagatcgttgccgatcgtgcaatagatttttgctttacgggttattttctcagcctctgcgtcgtcctcgggcaactcttcgctgttgatgaatttgatcagtggggtgcgccagtcgtctatggtctcgatatcggcaacggcgtgttctgcctctgtggcctccaagctgatgtcgggggtgtctgggttaatttcgccgctgacctctttcactgatggctttgtcaggatgtccagaaaagtgctaggctcgagtggttctcgtctggatgcgcgccgtgctagatcatctggctcaatattgttcttgcggtatacgtgtcggacctcgatcccatcgaaccttttctccagcttcctgacttctgcgagatacttggataattcggggttagagcatttataatctttgtgcacctggttcgctactagttcagagtcccctttcacgatcagtcgtttgaccccaagtgcggctgcagctcttatcccggcgagtagtccttcgtactcggctggttattggttgccctgaagttgaggtggattgcgtgcttgaattgatctccggaaggagatgtcaagatgaatcctgcccctactccttggctgttgagtgcaccatcgaacgccattgtccacgtttcgtcgtcgatttggttgtctgatttgttatcaggcatagtccaatcggctacgaagtcggcgagtacctgggacttgatggctgttcgtggcacaaagtggacgtcaaactggcttagctcaactacccacttcgcaatgcggccgacaacgtctttgtttctcacgacttcaccgagagggaaggaggagacaactgtgactctgtgggcttgaaagtagtgacgcagcttccttgatgtcatgattaccgcgtaaagcagcttttgtatctgtggatatcttgtctttgcgtcatggagagcttcgctgacgtagtagattggtcgttgtactttctctctcgacagcaatgacggtgctaacagaataaggcgtggcggcaatatagaggaataattcttcattaggttggggagcaacgagtacagggggggtttgataggtagcgcttgagtgcaatgaatgcctcttcagcttcctgtgtccatacaaatttgttttgcttctttagcagagcgaagaagggttgtgctcgttctcccatcctagcgacgaacctgcttagcgctgccatgcatccggttagcttttgtactttcttgagtcttttgggcgacttcatgttctcgattgctttgatcttctcgggatttgcttctattcctctgccagatacgaggaaaccgagaagcttgcccgactgtactccgaacgtgcacttctctggattgagcatgaggcgatatcatcggaggttgtcgaacgtttcccgtagatcgtcaatcaatgagtcgcttgtcttagtcttgacaacgatgtcgtcgacgtatgcctcgacgttgttgctgagctggtcgctaagtgcgccctggaccgtgcgctggaaagtattccctacggttatcagtccgaatggcatcttaacatagtagaataccccgaacggtgtgatgaatgctgtcctctcttcgtcctctttcgccatgctgatttggtggtagccagagtaagcgtcgaggaagctcaacagctcacagccggctgttgaatccaccaactgatcaattcgaggaagagggaagtgatccttgggacacgccttgttgaggtcggtgaaatcgacgcacattctccattttccgttggccttccgcaccatgactggattggctagccactctggatgaagtacctctctgataaagccagctttgagaagtttgtcgagctcttctcgtatggcttgtttttagtctggtgcaaatcgccacagtctttgttttactggcttggcatcgggtcgcaccaagagtttgtgctcgatcacctccctagggacccccggcatgtcagacggctgccaagcgaacacgtctgaaaaggttggtgatgaaggtgatgagcgcgaattcctatttctcacttagtgatgccccgatcttgacggtcttgtcaaggttggcactagagagttgaacgatcttgatcgcgccgtctggtttcagcgtcttgtttgtcttgctcactttcttgggaggctcagttgtagcgggtgggctgggcgtgtgctcgaccatgtcgaggctccgcttgtcgcattgtaccgctagcttggcgttcccttgaatagtgattgttcctttcggtcccggcatcttgagcacttgatacgcgtagtgagatgcggccatgaacttcgcaagtgcagttttcccgatgatggcgttatacgctgtatcgaattcagcgacatcaaaggtgatctgctccattcggaagttgtttgcttggccgaaagtcacaggcaacgtaattttgcccaatggtttggacgaggaatggggagtaattccatggaagggttgatcggtgggtgtcaactcgcttcgtgggattcccatcacgtccaaggtgctggcgaagagaaggttgattgagctaccaccgtcgatgagaacccgcgcgaccttgatgttccgaatagtgggttcgaccacaatcggatagcgtcctgggatgacggcagtcttgtgatggtcttcttccgagaattcaatcttctgttcagactacttcatcttgggtgcagccccctgccatgtcgaacagacttcacgttccactttcttgtattctcgctttgaggagtacactgtggaacctccgaaaatgtgcgagacgtggaggtcagagtctggatatgctgagtccgattcctgagcagccgcctccgcatccttctcgaccactcgtactcgcttgcctttttccaacgccatgtgcttctcgagcgactttttgaaaacaaggcaatcttccaaagaatgtctgtccgtcttgtgtatggggcaccatgctttctttgcgtcgctaccttgtgggtctgggcgcttgggtgggttcgcgtattctgctacgagaacttccgcttgagctttccttttcccactcttgcgatttttcttcttgcttgactcaggtgcgtccgtggctggtttcttttctcccccggttttcggcttgtcgttcttgcatctcagcgcatcgtctacgtgggtgcatcgctcaacgatctcgaataatctccgagtagttgtgatgcgtcttgtcgccaactcctgggtagtatagcgatctcggacaccggacttgaaggcgcgaattacagaagcgtcggtgatttcggggattgtatttctgcactcgttaaagcgccaaacatattccctcaaggattcacccgagttctgtgtcaacgcatgtaggtcgtcttcgatcgcgtggcgcttgtatgttccttggaagttggcgacgaactgctgccacaggtttgcccacgaagaaatcgagtagggcgggaaatgcatcagccatgaacgtgcagagccttttaatgcagttggcagataatttgccaacgcgttgtcgtctgctccggcagcgtagagtactgtggagtagacttgaaggaattcttctgggtcagtactcccatcgtacttctctattgctccgggtcggaatctccaggccatcggacatcacgaagggaacgaccgaaagctctacacctagcgctgggagcagtgggttgtcggcgatcgtgtgtccttcgtggatgtctgtctgacgatgaggatgaagaagaagatgacaatgatgatggatcgcttggttttggtgtgggattacgaggtcgtcggctggattctcgagaatcctgtcgtcgccctccgttgttttcccggcgccgatctctgttgtcctcatcgttatggcggtgtcctcgaccagtatcgccctgcatccgcctctcacgatcatcatgatcgtggcgattgtgagatgaattttttaagcctaattgtgccatgatttgacaatgtggtgctacagagtacatgtgctaatgacagattaattaggtttaataaattcatctcgtagtttagaggtggattctgtaatttgttttattattagactacgtttaatactttaaatatgtgtccgtacatccgatgtgacacgccaaaactttacacctctggatctaaacacagcctttgattattattgacatagtagactgcttaagaaatagtacagttaaacttcaatcaccgcgatattacccggtgcaacgcacgggcattttgccagtatacatataaactttgtatttcagaaatacaaagtttatacgtatgtatataaaatatatacatatttgtgtgtgtgtatatatatatataatttttgtgtatactataaaattgacgtataaaaaatgtacatatatgtgtatgtaaagtttgtatacgcatatataaattttgcatatgtgtatagaaagtttgcatacacgtatataaactttgtatatgtacatattaaaaaccgagagaaaaaaacacgaatacaaactttgtatatgtacaaatacaaaacttggtatacatactagtacaaacatcgcatacatataacctaaaaaaactggaaaaaagaaagagaaaccgaaaaaaccaggaaaaacccgaaaaaaccagaacagaaagagaacagcaaaacggaacaaaaacagaaagagaaaaaaaaccggaaaaaaccaacaggaagagaaaaccgaaaaaaaccggaggaaaccaacagaaagagaaaaggaaaaaaaaatgaaaaccccgcggggcgccgtccgccgccccctttccgcacgcgacacgtgtccaatcgcacgccctccccgcgcgactgatcgctagataggattttggcccccccccttcccactatgtatccgttccccttcctctcctctattctacgccagcatcccgattcaccgccgtacccttccgcggaggagcacaccctctccagcgctggagaaagagaacaccagagctattgaagtagcacttaatttgtagccaactaattaattagtagcactaatagtactactggatgactatatcaccatactacctcatgcacgtgcagcatgcagctgtgacatgcttgatctgaagtttctgaacttctatctgaaccggccagattttattttagaaaatagattaaaacggggcctctacatataaaacagatgtacacagccaatctaaacattattcagagttgcagattaaaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctcctcctcccctgcgtcatctacgtcctcttcgttgccgttccggtaggacgcgacagcgcccgagagggcgagaggtcgacccaggagcggcgtctgggtttgagagtgaaaaagacaaaaataccccaacacatataatttttcttggactaaaatatccctccacaattctactaccatcaagtgtggtggtagtagaaatacatctgaaccgttcgatcaaatgcgatcaacggttcagattattctctactacagatagaaagcactgaagtgggactccggaagttcacacacgtgacaccttttgagctagcgaaagtgttgattgagcattattagtaggattgtttcccttacaacgaaaatagtggttgcatgggggaacgagatgggaaagcaaccactttgaaaggagagtgccggagagacgacgagatcaccggagttttccgacgatcggggatgcgatagagcatgcgagtcgctgggctcccgcgggctggcggtcggcatgggcgaagacttcgcaatccacagagatttcgtcagatttcaggagggagacagggggggtgcagttcactagaggaacctcaacttaacaataaattttttttaatatcctttaaccacaaaatcagaaatatatacccctaaactcactcaaaccgtttcagggaggtcccatggcagtatcgactcaatttttacctttttgttaacataacatcctagtcaaaataaaataaaataaataaatatgtaggacccatatgtaagcaagaaaaaaaaagtgaggtcaacaatcctagtcagcaatctccgtagagagggagcggcactggcgcgcggctggaggcaggcggaacggcggtatcgacgagcgagcaagacggcggggcgtcggcggcggcaagcggcgggcaagcgttggtggagcggtggcggcgggcgagcgacggctccgggctcgggaggagcagacgggcttgggatgtggggggcgcggtaggtgagtgcggctgcagagggggagaggcggccggagcaggtgaagcggtggcgtcagagggcgagcgcagctgtgatggcggtgagctcgcggcgcgcggcgagatgcatgtgcggcggtgcagcacggctcggcaggcagcgctgcgaggtgcggcgacgcggcagagacccggcgcaggcgcaacggccatgcgggcagcacggcgagggggcggcggccgtgctggtggcgcggctggcaggcacagacgtcgcgctagtgcggggcacaattggcggtggttggttcttcggagcgacgcaggttaaggcgtgtgaaactctgcgtgggatggcgtcgctgtcgtgcagggtagcatggtggccggtcgatgcggtcgccgactcgccatgcgtaggtgacgcggtggctcaggataggggcgacgtcgtgcgcgaggctatgcggcggccgttcagcggcatcagccaggcgtcatagtggccgtgcataggtggctcgaggcatgacactgtgtagggtgcgtccgagtggcggccatgtgtggcagcgtgacggtggtggtggccatgtggggtgtaggcagcgcgcgggcacggctcgagcgatggtgtgcggcagccatgcgaggcgccgcgcggcgggacggtgcacacgggagagaagagaaggagaagaaaagggaagaaaaaagatgtgcagctgacatgtatctatattgttatagactttagtgcacgatttgcatgtgtttaggagtacacgtttctggttttgtataagggactaaaaagttgagggacctccggtgaacttattcttttccaggtcgaaaaatccccccagttgcgtctctcgtgagcgccggcgttccgctctgtcctcgcgactctgcggcggccggcggctccccttctcatgagccgccgccatcgctgcgtgacgtccccctcccacgagccgtcgctaccaccggcggcgcctcccctcctctcacgacgcatccatgccagtgccgcccccttgtcactagccgccgccggcgggcattaccctcccccgagccgtcgccaccgcagggcctctccctcccacaagtcgccgccatcgcagggcctctcgtcccgtgagacagaggtgtgtcttctccttctcttcctctccttagggcttgttcggcacgtggtgagcattttccccaggggaaacgccacctggggggtattggatgaatcccctcccatcacccaatcccctccatcccagggatttggttcccttggtcattcggaatgcaaatggcggggaaggttaacgttcacttcagacattaactcaggccaagcaacgttcaacactgatatttaaatttcatatcactaaaaatacaaagaaaactaaacatatagtcctgaaatttaaaaatagcattaccgaaaatttgaaatattgtaaataaaaaactaaaatttctggagaaaataagaaattctgaagactgtctaaaaagattatgaaaattctgaataccacatagaatgtactaaaaattgcttgcatcatatccattcagtcaccacaatcagtcacgcattcacaatacctgatttactcatttaaacatcatatccatcaccacaatcagctaggataagccactgaagactaattacattcatttcatacaaacagaaactaagagtcccaaaaatccaaattctccgtaagtgcaagagcagaagggcattactgcaaggctattagtagctccattacctgctgcgagtgaaaaatgagttatcatcagtgatctgcattaggcattaatccatgctatgaatagaactagccctatattttaattcaagaggcagaactgttttggaatatagtataaaaagtagcagaattacaaggaggaaatatacatcagtagaagagcatttccttgaacaatcgatgtcagaagggaactatttgtatagaaatatatataaatataagtagatcacattagcagtatagcatcattagcaaaataggatcagtgctcaagcttatactgagttcatggcaaagcacaaagaggccgaggggggctcctgagtatttactccgtacaggaaatgacatcgatctatctatgactagacctacagagattgatcgaaatttttacacattccatgtagtagtgcatccaattcatcccaatcctttgaattagcacatctaattaatgtcagattgctaatagtatggaaaaaagaaagaactaatcaagaattatgaactattttctccatatgtttgtaacattatgaactcttttcagccaatgaattaatcaagaacacactaaagtatccaatattcagtctaatgtaatatgcaggttgcagagtttttgagacaactttttacagaacattatctgaaatcaagaacaattaattttcttttgctagtcaaatcaaggccaaatatgataggaataggctcatgaatcatgataaagtactaataaaaagtgtctaaccacagcacaatgtataaagctgtgccctcctttgtagcaaccattattacaattatattgcaacagtgaattaggaaatttttcataaaatcgagatatccaatatatttgatcataagtcaattgttaatctaataaataagagggcaatgaaattctgttacatcactttgtaaaatgaaaattcatggttccacgtgtaaatgttaaatgagctaaaaagaacaaggatatactaaatactgctagtctgctcatccctaacacaagctctatggagaataatgaccagctattagcccagtgatttctttttttgctttaatacattgcaaacagctattgtgtttccgaagaccatatttgacaataaaatctcttaaaaatctgttaggaaacgataggcaaacaaacgataaaaaacaatagatcaatcacagaagacacgagatttaacatggaaaaccctcccaaaacaggagagaaaaaaccacgggcgccagccagcaaaatatcttcactatatctgggtgaggttacaacgccgcacggcgacttacaagaggtatatatatggtggaaccctaaaagggatgacgatccgtttcgtgggggctccgccctcgcacccctgggcgtccccaggtgcacgacccaatgggccagcttcagcctccgctccactacggcagaagctggcctttattaagtgcaaatgaatttggatcacaactcaacaaactccaccttgagacaaattacttcttatagcatgaatcaatccttcaccctgaacacaacaaagataaaaaacactttcggcgccaaatagcctcttgggctaaaccactatacaaactaagcttgagcaaagctcaaacttagcaacaggaacagactttgtcatcatatcagtaggattatcatgagtgcttatcttgcatacctttagcttaccttgcacgactacatcgcgaacataatggtacttgatatcaatgtgctttgtcctctcatgaaacatctgatccttagtgaggtatatagcactttgactgtcacaaaacaagttaatgcaagaatcaactccacaaagctcagcaaacaatcctatcagccaaactgattctttacatacttcagcaatagccatgtattctgcttcagtggtagactgggcaacaacaggctgcaatgttgccttccaactcacagcacaactaccaatggtaaacacataacttgtgagtgaccttctcttatccaaatctgcagcaaaatctgaatccacatatccaacaagccccttatcagtc

SEQ ID NO: 37802 - DNA, 1448 bp, Oryza sativa
ttggcagcaatcagcatatcatcaacatataacagcaagtatataggtgatccattaacaaatttaatatacacacatctatcaaattcagaccttttaaagccatgtgacaacataaatgaatcaaaccttttataccattgacggggggactgtttcaaaccatataaggatctttttaacttgcaaacataatcctccttaccagctactatgaacccttctggctggtccatgtatatctcctcctcaagctctccatgtaaaaatgttgtcttcacatctaattgctcaagctcaagatcatgcatagcaacaatactgaagaatgtacgaattgaactatgctttacaactggagagaacacatcattataatcaacaccagcaatctgattgaaaccttttgctactaaccttgccttaaaccttggaggctcgctgggagataaaccctcctttctcttgaaaatccatttacaacggacaggcttcttctgttttggcaagtgcacaagctcccatgtgccattcttctcgagagactgcatctcctcctacatagctgagatccacttctcacgatttccagaaacaacagcttcagtgtatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacagtatcatgaacatcattatcaacaatttcagtttcctgatcatcacgtgctccacctgcacgttgacatattgctgctcctcatcagaaccacctggtatgacatctgtgggcaagctgtcattaaacataatagattcattaaaaacaacactcctgctcatgaaggtcttattagtttcaggattccataacttatatccttttactcctgaaccataaccaagaaacagacacttaatagctctaggctctaattttccattatcagcgtgagcataagcagtgcatccaaaaactctcaactgtgaatagccagcaggcataccagaccatacctcaatgggagttttcttattaagtgggatagaaggcgacctgttaatcaagtagcaggcggtgttagcaacctctgcccaaaaacgcttgttcatgcgagcgttggacagcatacaacgagccttggagatgatggttctgttcatgcgctcagccacaccattctgctgtggagtgtacgggatggtgtgatgccgaacgatgccttccttcctgcagtaatcatcaaaagcatccgaacaaaattcaccgccattgtcagtgcgaagtacttttacctccttttcagtttgcctttctatcataacattccactctttaaaaacagcaaaa

SEQ ID NO: 37803 - DNA, 2940 bp, Oryza sativa
  unsure (1)..(2940): unsure at all n locations
aagttcactcatatgtccaagacgcatatgccacaggttagtcttactaggttcatctttagaaacggcagcagcggtaacagaaccatgtaatgtacttcctctaaggacatataagtttgcagaattcatatcaccaatcatataaacgagagaaccttttgatacctttacaactccacctgaaccggagtatttgtatccttctgtatcaagtgtgctgagtgagatgagatttctcgccattcctggtatgtgtctcacatctttcagcgtgcatgtcgtgccatcatgtgtcttgatctgaacagagccaatgcccacgatctcatgtgggttatcatctcccatacacacaacatctccattctgcacagacttgtaagaactaaaccaatctctgttaatgcagatatgaaacgaacatgcagtatcaagtatccattcatcatgactagcaacacaaccagcaaaaacgacaagacaatctcctgaatcagagttttcggcactggtaacaatagaggccttaccatcagattttcttttctccttattctgcagcttccaacattcttcaatgagtgaattttctttttgcaatacttacagaactttttacttcgggacttagaacggcctctactctggctcttgtcacgatcattgctgtcgttgtaggttctttgctcagatctgcctctgacctgcaatgcttcgcccttagaggacgaggcattagactgaaccataactttcatcttctccttgttttggagtgcctcataaacttccgcaagggttagttcatcacgacttaaaagtatggtgtcacgaaaatttgcatatgaactaagcagtgagcataacactagaagacctaaatcttcatcatcaaaatgtacctccatcgacactaggtcggcaacgatctccttgaagaccgatatgtggttcaacacagaaccactctcctgtaacttgtgcgagaacaacttcatcttgatatgcatcttactggttagatctttagacatgcagatcgattctagtttgagccaaagttctgcaacagtcttttcctgcaacacttcttgcaaaatatcattagatagatgaagttggatcagcgacagagccttacgatcttttcgcttctcctcagcggtccattcagtcgttttcttcttcccgaagctttccagcgcctcatcaagatccgaagtttgcgccagaaccgcccgcatcttaacttgccacagcgggaatctcgtcttgtagtctagcagcggtagatcatacttcatcgacgccatcgtgaaaccctaatatggaaacaatgctctgataccacttgttaggaaacgataggcaaacaaacgataaagaacaatagatcaatcacagaagacacgagatttaacgtggaaaaccctcccaaaacaggagagaaaaaaccacaggcgccagccagcaaaatatcttcactatttcggcggcgtcaactttcgccttcttcgttgcccttgtgcgggcaggcggtggagcttggtgggaccttgacttggaaggtgctggacgaggagcttgaggaggagtcgacgcaggagcctgaggtggagacggtgctggagcctgaggaggagatggcggagccggaggagatggtgcatgagacgccgcttgtcgcctagggaggatgatgtaccgcttgcgccatagtataatggcgtggcttgtgtctcgtagatgcgtctcaccgtctcctccagggtagtccaactcgaggtccttgtacgcggttgccaccaactcaacttcgaccttcgagtatcctgctggaatcggcctgcagtggtaagtccccgaagggtccgttggaatagccattcccgacgccaccttcacgtggtgagaggttatctattagtaatcaacataagcagcaacttgcggaatggacaagtcaaaaatcataaaattacgagcataccttgattgataagttcttgaagggaatatgcagctcacatggtgtccgctgagtgatctcatcaacggggcaggtggtttcgtcctgagtttgcatggcttccatgctctgtgatcctacctgccccgttaaggcgcagctgctatgattgcctgatgggctgaccattgcaggaggaatgtacggctggggatcctgggaccgatatgcggacatgcgttcatccaccttccttgccacctcctcttgcatgctgagctcatagctcgataccctgtacttaagatctgcaattttcgcctcggtatctctcttgctcctcatccgactcctgtacgtgtggatgtcctccttgaatccaatcttccaaggaatcacccctttccctcgtgttcgtcctggatgctcgggagtctgtagggcaagtgacagctcgtccttctctctgtcgggtcggaacgtgccctgagaagaggcttccactgcgtccgttagtcgactggtagcctcgcgtatctgatcgctgaagaccagggagccatcaactgggttaagcgttccaccatgagcatagtaccagaacttcgatcgatccaaccatttagcggtggctggttcgatacccctctcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37804 - DNA, 192 bp, Oryza sativa
atgtaagcgagaaccgggacatctcgtatctctgattcctttgaagggccaaagtgacttcaacccttgcagatttggccgttgatggatgtaatcggtccatttgtcgatcaccaagcttctgcttcgctgaaggagaagggcgacgaccaagtcaccaaggtcttcttcattcccgtcatcgcccggggc

SEQ ID NO: 37805 - DNA, 732 bp, Oryza sativa
tatcagaggaagtatgacaagcagcaggagaagcattatgaagaacacgatgatggttttgatcctcattggggttgtgagttctttagattctgctggaatgaagggatgaggttactgtccatcgaaaactgccctgggtgcagtgttatcattgagagctcaagccagtcatataatatgaataatcggctgaggcaggaaagagtgtctgctcatcaaagattgggcccagtgaatcaaggtcgtggtcaggaggatgaggtagttaggacaaatcaatggtgtccttctggtattttcacgaagaaccagaagagaagggttcagaggttgaggaacagggagcattttcaagaagttgaacaggaaattaaccatcggctaaagaaagcaaagccaagacaggaatggcgtgttaagaaccaggttcctgtagccgatgatgttgcagccgaagaggcaaaaaggatggcaaaagggaagagtgttgtaacagcaccaattaacatggtctttacattgccagccgaattcgggattgatcaagtcgatgtagatgaggtagaagaggaatcggctaagttggttttgtcaccggagcgggcaatgttcgagaagcctgaggggacagagaatcagcatcttaaaccattgtatataaacggttatgtcaatgggaagccgatgtctaagatgatggtcgatggtggggctgcagtaaacttgatg

SEQ ID NO: 37806 - DNA, 1106 bp, Oryza sativa
gtaaattaatcttacaatacctgccagatcgtgcataaaatttaactttaaaaatgtttgaccaacaaatcttttaatatgaaacaagttttattttctgaaaataagattattgtatttacatttgtaattattttttatatgattataattttatacgagaaattataagtcaaagattaaatcttgaaggccatgcctttataatggaatagagagagagtagtgattaattaaattggcaatgttttctaaaaattactagccttcgtacaagtgcatcaattaatgcatacgccgaagtgtaaaaacattttcatatattgttaaaaaattaaaagtacaatacagttaattacctctcggttttcatgaaactattattgatagacctatgaaacaaacaaaaaaaaagtagtagtaaacacacttaagtaggaggaaaacataggcagtgtgactaaaaatcgacacatatgcctccagtcctacatatcacatgtcactatgtcagacactcagacgtcttgcagcatcgatcatgatcatgacgcatccatgaaccatgtagatgacttgtaatcacgagcctaggttaaccatggtgaggccggccagcagcagcacgaagagcgcgaagctcgccgccggtgaggctgtggcggccatgggcgcggcgagcgagcccgcggccagggacgcggtagcgaaccccacgccacgaaggcagctgcgacgaacgtgctcgccggcgctcgccgcggccggaggagggtcgacgccggcgccgctcgccgcattactgtccacgcgcacgccgacggcctcgtggtcgtcgtacgacggagtggtcccgcatgccgatcgagttggttgacgcacgaacgctgcactcgccaccgccggagtagccttcgccgccgccgttaggacagatcgtcggaggaggtgcgctcgccgccgtgccgcctacagctgtctgtcaagcaagcttccctgggagacgacgtcgaccgcgtgcccggtttaaatagaggggtttgagttgcgtgcatcaacagttcaaccaaaaatagttacatgcacaatcagattaattcagaatt

SEQ ID NO: 37807 - DNA, 2104 bp, Oryza sativa
  unsure (1)..(2104): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttactttatttacttaccttttactttgattttctaactttattcaaattaatccaaaaacttgtgctattaattggataaatgtcttaactccctcctttcacttgtctttagatgtcgcgttacaagcctgagtacttgtttggtgttgagggatttgtctaggagatgcgtacgatgtcctttgccataggatttgggactgcccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatcgctaccatcctcgccaaccacagggaagtgaccgtggcagctaccttgagactgagggaattgagaatgatgctaccacgaggcatttggttgagatgctgtgggctatggatgaaacccgtgcggagactgtgttagcagctcaagatcgtgaagaccggaatcgtggcaagatttgcaagttagaggacaaagtggatcgtttggagaaggaactagccgcattgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgtcaacataagtgatgatgaagtagaagaatccaagcgcacctattccaagattgagtggggagccactcaagatgatgaagacgagccggacgagccttcaatcaactccgttcattattgaattaagaaactagtcttcatgatacaatacatgcatccaatagaattagagaacatgagagtggagaatttaaaaatgtaataatttaatagagaaggggccatagttaattgactacatgcatgcatgccttatattatgaaacatctaaaaaaatggttgtgccttatattatggaatggagggagtatttgatattaggtccttccctaatatttttttttttttataatgagccgagagagtttgaacctggcaacaaagggcctgtttagttcgcgaaaaaaaaattttggatgtcacatcggatgtttgaccggatattggaaagaatttttggacacgaataaaaaaactaatttcataactcgtctggaaaccgcgagacgaatcttttgagcctaattaatccgtcattagcacatgtgggttactgtagcacttatggctaatcatggactaattaggcttaaaagattcgtctcgtgatttcctgcctaattgtgcaattagtttttttatttatctatatttaatacttcatgcatatgttcaaagattcgatgtgatgtttttggaaaaaaaatttggggaactaaacggggccaaaattaggcaggagcatgttaaatcatcccatgtcaaccaagttcaccacattgactcgtaccatttccttcccccattattcaatatgaaaaatgccatggaaataaagaaagaaagaaagaaagaaagatacaaagaggaatttgaccaatccccttacgaacgacgaacaccggagacagcaagagagaggccgccgagcagaagcacaaagagaccaaatgtcagcggcggactgatggcgccggcggcgagcatagttaccgcaaatgaggcagcggcgatcccgattacggccgaagcaaggttgccgccgcgagcatctgcgtccgcggctgcgtttgccgctccactgggaatatcaatcttaacctgcagggtcgatagcgtaattgaaacgtgtagaacttctcgcaaaaaaa

SEQ ID NO: 37808 - DNA, 3536 bp, Oryza sativa
ctaaaaaagctactgtaatgccgaactcgaccgagggcttacgtgtgcgccaagggggagggggggtgagcccgaactcgaccgaggctgatgccgacgctgaccgccaagacgtcgacggtgggagggggtggggcccgatccgaccccgaccgaggctgatgccgacgccgaccgcgaagaggacgacggtgaagccagccgcctttacccagctgccctgaggcctcatccaatcaagtgcttggcccagtcagtgccctgttcagaatgacgaaaaattcaaacaaaattcgcagaatttctatcgaaatcggtgcaacctgtgtgttggatggagcagtcaggcgaggtgaaataaggagtactgtcccaaaataagtgcagccatagatattcgtgtacagcgctttgaccatctatcttatttaaaaaatttataatttttttaaaaaaattagtcacacataaagtactattcatgttttatcatctaataacaataaaaatactaatcataatcttttttaaataagatgaacggttaaatgttgaacatgaacaatgctaaaactgtgcttattttggtaagtgtgtaccaccccttcatggtgatggtgaattccggattcgttgcaggaaaagaaataaggaaagaaatctgagcgactagacgagactgcaatgaatagtattttagtactcactccatacagatttgatcatactctgtttgattcttaaaaaaaaaaagttgtttggatggaactaaaattaaattttttagtccctatcatatcggatgtttgacactaattagaagtattaaacgtagattagtgataaaactcattccataatccttgactaattcacgagactaatctattgagcctaattaattcatgattagcctatgtgatactacagtaaacattctctaattatgaattaattaggcttagaaaatttgtctcatgaattagctcttatttatgtaattagttttataagtagtatatttttaatactctaaattagtgtcaaacatccgatgatccaaacaacacctaagcaaataacaccaagacatccatcattctgaaattaagggaaaagaactctgctttgggaaaacgcccacagatctctggttagctccacaaggtggtgggctaatattcgcttctttttttaaactctgctttggaaacggaagggtgaagcatggaaacactagttgaaagatccatccattatcttattttcatctccaaagacacatcggccaagtcacctatactgaaagtgttttcggaacgatcaggtctaaaacatgaggattcagtttagaaaatccaaaactcacatcacatgagccagttcagttctgaaactcttaataaaagttaaaattccaagaatctgtgtgatggccccatccacaatcttgaaagtgcataaaatcaacttaagagtacatggctgataaatccatttgtgaaactgtgtcctggtttgctgtgccaaaacttttcttcaccatattgctaattaacttatcttggagaacaattaggaaacatattcatcaaatagatctgcgtgtcaggatccacaaatagaatagtacatctgaggagtttgtcgacagtgacaacacctaattaagcaagacctgactgtagttgtattacgtatgacaatggcaaggccatgattaatataatactgcagaattaggctcactaagcttgcgctaagcacattgtcaaacataatctaatcggtgaaacaaacccggcatggaattaccaccagcttagcaagttcttcaggtttcaaacttgaaggttccgttctaaaatctgaaactcacattattagttattatgctatacgggcctgattagattccctggcaagttttttcaccttgtcacatcgaatatttggacacacgcatgatgtattaaatatataaaaaaaattaattacatagattgctgaattgcgaggctaatcttttaagcctaattgctccatgatttgacaatgtgatgctacagtaaatatctgctaatgatgaattaattagacttaataaattcgtctcgcagtttacaggcggaatctgtaatttattttattatagactacatttaatacttgaaattgaaatgtgtgtccgtatattcgatgtgacacggcagaaaattttacccctttatcctaaccacatcctacattatcgatatctctgtttcgtggcagcggtactttgttgcgtctgcctgagaaggatgaacgagacgttcaatcacacaattggctcaataccctttcgtgaagtcagcagtgacagtgagctctatctagcctctagctaagcaagctgaccttatcgtgacgacaccaggtttaccacaatagtactacggattggactaaagtcgaaattaggcttattaagcttccgctaagcatcacaaaaacatcgtgtaatcggtgaaattagtatctattaataggacaagatgaacaccaaggttacgccgtgtttaataccaaagttattctttaaacctccaacttttatatcacatcaaaacttttgaacacatgcaaacttttaactattccgtcacattttttcaatttcaactaaacttttaatttttatgtgaactaaatacagccttaattaagtttgtttctggtaatcatctcagaactcaaaaaaaaaaaaccgcctttaagctctcgacatctcaatctgaacaggacgaatgggatagccacttgcccatttctatcacagaacagctggaatgtgcttctgtctctttattggatttttcctctgtaggcagaccaaaccgcaaatgttgaaaaatatggcgtgtgtgttctatatttattcctgttatatgctttcgtacgaagaaatccttttcgaggagattttatcagaacgcaatacaattctagtaggatcatgaaagagagaaattctggagcgtacatatatcatgaaagagagaaatcctgagaatttgaactttcagcaaaattcgccatgagcatgttaaaaatcatcccacacgaaacctttaaaacatccatcgatcaccattcaccatgttgaaacctaccatttcctcccagattatttaatcgattagccacagacaagagggagttgaccccacacactcacacatgctccatagcctattgacgatatatccctttgacttcacacacggggaacgccggaggccgccagcgagagtccggcgatcatgaggacgaagagcccgaatgccaccggcgggctgacatcgccggcggcgaccatggtgacggcagatgaggcggtgacaatccccaccacggctgaagcaaggttgctgccacggccgccgactgctcttttcgcctctatcgcttcagcaacgaaatccacatcaattgtaacctgcggggattgagaataattgaaacgtgttgaccacaagaacattagttaaaaa

SEQ ID NO: 37809 - DNA, 7448 bp, Oryza sativa
ttgccggtgaagtcgttccccccgccaaggccgccgccggcgtggctcatgcgcagaaaccaatcagcggatggcgcggcgagctcccgcgtgtagccggtggcgcggccgtcggccaggacggcatccgccatctttgattgcgccattaatttggctcttgatcgggcttggtggcgtctccgagaccggggggactggaacgagaccggacgaacacctgcaagctgcagctagatagcgctcgagctcgcgatgctttgcgaggttagccatggcatcgcatcgctttataatataaacggggacagcgatccctaccacttttgacacattgcaactttcggaatgagacagtttattatcaatcatcttcgtatgattccgaatttctgacaagaacagcctttgaatttttagccaagggtcacttgcagaatcccatcaacactagtactatcataatctttatatccaaaatagggtgctttgtttcagctttgttcggctgcagcttacaataatgctacttctgatgttattattcaattgtagaactatacaggagtgtctctcttttctcgagttatcaacaacaggaatttcaaatgaacagaaagtgggggagagatgtatagacaatttctctcgtgctcagtcaaaataggagaaagcattatttgttccatacaagtactcctcggtgtaacaatatataattgtagtgccatgttctctcagacaaaaattagtagcagcaatatacagtatatagttcgatgggcaatcacttctggattttctcaaatcgcatatcttcgtagagctatcacgatcaaaagcgaaagataacggatttgaccgcctgctccaaattacgagtatatcaacaatccctttcgaaattgcaggtggtagaaagggtggattataagccactccagctagctagcactaattaatcgtcgatcattgataattcagcacttgtatgaatcttatcgtcgatcaagtatactaattaatcgctccctgatttttaatgcccttggagccagcataccttgaagggtactagagactagacttggcattttgccaattcgccatgcgttcatcttcatggatctatgcagcttgtatatatgcatttgggtttatgataccgttgaattccttaactgtgcatctggactatatataaaaagttcaatcacgtccttgcagcccctctatctcctttcattttcttttaattttaatttcccgagaattaagaaaatgtcacgtcaaatcttgttgaactagaccgcaatgcttaggcccggtttagtttctaactttttcttcaaactttcaacttttccatcacatcaaaactttcttacacacacaaacttttaactttttcatcacatcgttctaatttcaaccaaacttctaattttggcatgaactaaacacacccctactcacacaaacttccaacttttccatgacatcgttccaatttcaaccaaacttccaattttggcgtaaactaaacacacccttactctcttaaataacttggggtcctcttgacgttcaaaagaaaatgaaaataaaatctgtgctcttcttgtaaaactaaatcatcatttgatccaatcctctcttttcttgttaaaagaaaacaaagttggacaaatgttgtttatttgcctccctgtatgatatctccagataatactgcggcgcgatactgcacacaaatgctttcccttctttctttaaaaaaaaaagaaaaagaaaaggaaagtgttgggatgaccgaaatagaaagtttatttggaccaatcgacgtggacagtcacatgtctgtcttcatggcatattacgttggataaactaatcatttaatcatctctttgtctagtaagtacttatcttttctctaactgctggcagtccagatcaaaatgacattttcccttccttttacctttgttcttttcctatatagcttgtgaattttgtggtagactaatcttatacttcaatataagccagtaaaagctggatctctcaaaacgaaattgtattatctaaataacatatacatcatcgtcaactagttatatagatgtcgacccccctgcaattggtggtttgatcttaagttctgaactgttaaggctgtgtttagttcacgccaaaattaaaaatttggttgaaattgaaacgatgtgatggaaaagttgaaagtttgtatgtgtaggaaagttttgaagtgatgaaaaagttaaaaatttaaagaataactttggaactaaacacggcgtaagtctctctatacatttttaattaatgaggccacaaaacgatattaatttgtttagagcagcaatagagattttctttactgataaaattaaatttcatcagatttcacgaaccctacgcgttgtttcgggcgatcggacggcaccagccggtccctttgacgacacgcttcagctgaattcaattgtaatctgaacaattgcagcaaaaacagcagtatgttctcccaaccgctgagtcggttccaaggagctaattcgtactctctctccgtttctaaatatttaacgccgttgacttttttaaatatatttgaccattcgtcttattaaaaaaatttaagtaataattaattcttttcctatcatttgattcatggttaaatatacttatatgtatacgtatagttttacatatttcacaaaagtttttgaataagacgagcggtcaaacatgtgctaaaaaatcaacagtgtcaaatatttagaaacggagagagtatttttttttaatcccaaatgtacatcacggagcatgcgaatataatactagcaccacaacgtcgttttaatcagcctgtgtcatggtcatggtctatcttttcatccgcacaatctgaacctcgcctacttgttggcactataacctgaagaaaacaccatccatcatctcccttgtttttcccatgaaaagaacactagtctttttcgtggaaattgtagctgatgcgtccgtctgccgctcgacaaattttcaatcagcaacaaaaatgatttgatactactgaaattaaggaactaaactttcatttggttggactattgcagattgcattgcgtgtagaatgtatgctgaattgtactggattaaaggttaaattaggattatcaagattcggctaagcctcatctaatcggcaaaattaatctctgttaacactgcaagatggatgccaagctaagtttatttcgggtattcatttgagaattcgagaaattttggcgcaagacccatttcacaacgaaacgaaagctttttttgttacacgtgaacacaacgaaagcttttgacgactcaactaattaactagctatgagactgaggacaaaacgtccttttctattcttcttaaaattgacttgaagagctcaaatcggataagggcacacgcattagcctcttgccaacttgcagtactagaaaatgtctgaaatgttcttctgcctcttttcttttggacttccacggcagagcagacaaaacctcaagaattgaaacgtgttgtgttcatcctattgatactatcagcctatcaagatggagtactatgctttggtacacacaaatttattttcgacaagatcgtataagatacaattcagttcctcataaattaacagcaaaattcagcatggacttgtaaattcacctcaacactacattctgaaacataagatgaaaaacatttcggaaacatcagatgaaaaacatttcgtgtagcaccaattgatcgatcacaccaacatccattattgctaaaccgcagatgaaggaactgataatctgagatagcatctgatattattgcttcattaacatatataggacaagatcttgtacaagtggcgttggatctgacccatagtttgacatgtcgcatcactgtaattgttaatgaagcaccatgtcatgctatgaattcggtccaaattcatctgtaaaggatccgaatcctacaaaattattccccaattttcgtcagatatcatcaaccagctgattctcaagaacacgggagacagaaactaagaggccaccaagcagcaggagaaaggcaccaaacgccaccggcgggctgacggggccggcggcgaccatggtgacggcggttgaagcagcgaaaatccccaccacagttgacaggttgccgccatggccgccgccggaatctgcaccggccgctaccggcacctccttggcaccgacaagaacatcaatggcaacctgcaaaatttgaacaattgatggattgattctttgtagaagagaagcagctcgagagtaagaaatggtggccatcgaatttggctcgctagtctacctgctccgagtgcggggcggaaggcgccgggcggagagccttgtcggtgcgcgcgccgtgctcgtcggccgcgacaagcccggcgaagggcggcgcggctgtcttgcgcgcgaaggagtagtcgtcggagaagaatttctcgtccaggagaggtgtgtcgatctcgcgcagcccagcggggtgattgtttcccaggagggcgtcgccgaatgacatgccgcgttcacgcgcgaacacgtcgcggtgcttgtcgaggaggaggaggaggaggaggagaggctcgccggtctcacgcgggaggaggtcggactcggacacgccgcgctcgagcgcgaagacgtcgttggcgttggtgccacccacggtcagcccgccggcacgggccatgtccactagcggcgcaccggtctcgcgcttgaagaagaggtcggacacggccagaccggccggaccgttcttgctgaggagggcctcgcgggaggacacgccgcgctcgcgcgcgaagacgtcggcgccgtcggtgtcggccacggttaggcgtggccgcgcgtcgcggtcggcgaacggcgcgcggtgatcgcgctctaggacgcgcgccccggcggcggcgcggtccttgtccgggataaaggcattggtgacaggctctcggtctgaagcgctattattgggatatgccccgacagggacacggacaaactctccggagatttcgcccatattttggggcacgatcgagcacagcagcaggaaagcagtttgttttgcgtggtggttagccgtggtgagctggggacttaggatttgggggctaagaaatagtaggggggacagccggacaggtggccccgttgaattgcagctcgacaagtgtcccggcggctgccaagtgacacgtggtggtgccgcctgtcccaaaattaggatgcaagtggaacgagcaagcacgttttcttacttgcttatcgcacttaaaagattttttttttaagaaagaaagtgtactctcacatagacagtgaattagtaaacgagcttttatataggtatataacgagattgtccacttgtatatctctagtgtagcttcctcttcatttagaattgctatatatcttctttccgataagatggatggtagaaaatcgattttcaaatgtatcagaattatgtttttaactttctatgaacacaaagcaataaattcatgaaggaaggattggaatcctgcagcaaaaaacaaaaggataaagacagtattttgctttcactgttagagaagtcggctgtatgcggtgatctctcttaaaaaactgatgatcaggtgataggtgacatgatgttaacctaattaaaaagaaatgaagtaccaaggtggaaggagaataagattaggtagctattttaatctctctgaccaaagtagttcttaatccctcggtccacatatatagggattttgtgttcaatcttatacgtaaatataagagattttaagtattacttgttcgatctaatcacccttcacttaattttcgttcagtcgtattcccagtttccaaactatcctctcacccttcaactattatcttattttttgaggatcatcatagttttttttataagtaaatttcactttaggccacttatattgacctaagttgcacattgggctaggggtgggtcacttttttcactttacaccacctatttttaccatcctttgcaagttggaccaggtttactgattgggccactaggctgggcttcagcccacgcaagtaggtgcgtttaccagcggtcggcagtcctcgtctccgggctccagcgagggctccctcgacggcggttctgcctccctctctagtacgagtacttccctcccaacacaaaaaagtctctgttcacacacggctgttgtgcagcggcgtgaactcaacaatcgacacacaaacaccaccgtctaggtccaccgtccaccggcgccaaggtggagcaagtctcgtcatccggccgtgtcgccagcgtcaggccaaagggcctctgcctggtggacgcccatgccacctcgatcgggaagctgcttcccgaggatggaatcactggggtcgtcagctgcctcgttgctaggatgcttgttgggtttatgaggtagacaggtatatgcatccgcgatttgatcatggagtaatccatggaggaaagttttgaccctgggacttgggagagtgaaacaaagcaacgcattcagtaattcctatgagatttgggttttgtggggataatcaatattcctcttctgctcttcgaaaaaactagagtaattaatctgtgttcctcggttggtaaccagaaacatgtcgaattttcacaagaaaattaaagagaagatcggatcttgattactgctaaatggaatagttggtcttttttttatttcacatgcatgatctgaatgggatagttctagtatggtctcagatcttgtcaacgtaatcagatgtgccgtagtattgttttgagcgcgacagggccgagcgtgatcaccacagggtccgcgtccactggacgacaacatgctcgccctcgccgatgaccacaccaacgcgtcgcgcgcgctcctggtatcgcgcaccactgccaccatgagcgaacaccagctgctcgcgtggattaggtcgaaacgcagcccatgccgtaaacctggtccaacctggaaaagattgtaaaattaggtggtgttaagtgaaaagagaaacttagccctagcccattatgccacattggtcaatataggtggttcaagatgaaatttactctagttttttcacactaatcttaatatttctaaaagagcctacgatcatttgcatttatggttggggagggagcaattaggagtagtttaggggctgtttggttttcagggacttattccaagtccctgtcacatcggatgtttggccactaatttagagtattaaacatatactaattacaaaacccattccataagctcggg

SEQ ID NO: 37810 - DNA, 682 bp, Oryza sativa
agttcacacggagataaaatgagcagatcgatcacgccgtcacggcagccggagagaggcaacggcgaggtggccgttgagtggtgacgctaattaacaacagaacggagcagaggatgaccgatccccttcgacacactctctgtgtgtgtgtgcgcgcccgagtacccacccaatataatttttcctcgttcttgcaatctcgcctcatccgtccaggcgtccggctcttatcagtgctgaacgcgtcggatcatgaaaccggttgcatcgatatacgtgcttcccttcggaaaatagggtgcactaaagatacggtgagcccataattatctttagttttttataataggtagagatacggattatgtatcaaaatcatgataaaaatatcttcaattttataatattagagatttttactaaatgttttataatacacgaatgatcatatatatttttaaaaggagggagcaggagaagtcaataggtattctctaattagtgctattctgtgaaactaaaccatttggccctatctttttttatcattttccctttttttcttttattaaaaaaataaatctcctttccatgatttggcaccaaagaaacaacgggaggacaaagaggggaagggtgtggctaatgggcgggtgatcactgtgggcgatcacccgcc

SEQ ID NO: 37811 - DNA, 6446 bp, Oryza sativa
  unsure (1)..(6446): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacatatggaatctttagatatgtccatgaggcaagatgtttaaaatattccataaaattattatcaagaatattttaattttactattgtttcttagctacctgaaattgtcactgattttctatccaaaaaaataaatgcactcactgtcactgggcttgaaatatgcacattattgaacaaggtaatatgatgtgtcggatacttttacacttcatactcttcgtcttgtgttttcccaattataagaaattggcgttacctagaactcgagccatccaatgctaaaaaaggtttaaactgaagtttaccgttttgtgttaaactcttcaccgtaaatgtaaactatttccattatctgaaaaagaagtgaaactcttcatccccttttacataactgaagtatgacatctgttcttgtctgtatatttccacaatatttttgcatctcttgaattttggcataatcatttttgccttgcatagacaacaaacttcatctatattaaattataataatcattttctagctaaacaactcagagcctttaattgtacagaaataaaacgagtcctgaagcctggtggtctctacatattcattgagcatgttgctgcgcctggtaccacctgctattctctttcacattttacacacaaatggcttaagaccatttctgtttagagattttctgttgttgtgcattattgactctccttctccttttgccccgtgcaatagatggatccttcctccgattcgtgcaaggtgcccttaatcctctgcagcagtttgtctctgacgggtgccacctcaccagagaaacaggcgaaatcatcagggatgctgggttctcgagcttggacctgaacacgactcgcttgtctactgcatttatcctcagcccccatgtttatggagtagcatgtaaatgatatttcctctcctttcgttgttccatctaattgtgtaaattgttatttgtcagcaatatgagctacagtatcacgctaggtttccaaggctgaatattccatgccacacgttagatgggctggtcttcagaaatggctggatgcctcgaagatattaaatgggccttttctgttaacatttcgttgctgttgggctgggcccgtgtcctgtctgctgatttcttgcagcttggaactcttcaaattgtcgattgtgaaccataagagcaggtacaacaatgggctaatagcctgcttacatataggatttttgtatacgtggccaagaaagaaaacttggagagagaaaagtgagcaactatttagtcgccggctttttgcgcgagcctctacatttcacttaccatgggcccatttgctctcacaacaaccaatggaaaaataaatggggacgtaaaatactgggcaagttccttcggagtaggcactagctcgattaaaaaaaataaagaagtgttgttgttgtatgcattgtagattagttgtctattagaggacgtggcactcggttgccgccaacagtcgccgaaactattaaccttgggcatggtttagttcctaacattttcttcaaacttcaaacttttccatcacatcaagatttttctacacacataaacttttaacttttccgtcatatcatctaatttcaatcaaacttctaattttggcgtgaaccgaacacaccaaaccattgctctagaacttggggtgcaaaagtagtagtagtcctgcgtgcatgtgcgacgtgttcaccaccagcccacagcattcattccagttcagttaggttagttactccaccgtggggcacgtggcaagtgtaggtgaccaccgtggggcacgcggcgaggggaccccgtgtcacgcacggcacaggacacttgcacgttcccctgcttcgcccgcgcgacacatggcgcggccgccgggccgcgtccctttgcagcagcgcgctggcgctgcgcctcgcatgtgcccgccccgaggatacgcgccaagtgtgagcaacgatggtttggctcgtagtacgccgtgcattcactacgcctgtgccggtgctgggggccagtcacgggtccccctcccgtttctgccaaagggcccgtcatcccgtttctgcggcaccctttactgcttccccttgcgaaaatttgtaaaatctgtagtactattcccgttccaaacaaggcatgggcatgaagaggtagagattgatgtgaagtagaccttcaaattattcgtcgtttgtttagttgtttttttatcatttcgtggcacgggcgacgcatttccgttggcaaaacaactgggtagtgatccccgtaatctgggtttggtgggcatgttgaattcttctggactcctggtccagtgttttcgccgtcggaacctgtgtgcgttggacaaatgatcttttgcgcagatgctggcatgcacgttgtcgcggtcagcatgtgctccttccgtcctttgttgctgttgcagcttgcagcgtcagggcctgacacgttatcagaagacgcgggccagtgacatggcaattttggctgtttttagttacttccaaagttaataagttttggttaaaattggtacaatgtaactgaaaagttgtgtgtgtataataggttgatgtgatggaaaaagttagaagtttgaatctaaacacagcctttgttacttctgctaccaatatcagtgacagtgatgcaatttaaaaccagtcctaacgaacgtagccttaaacccctatagatatttttgcatttcaaccccttctgttttctactatatatacatatagtggtataaaattttacactcaacaccctaaaatctataaataatataaaatcacgccctatcctcacctgatcttttcacttcttgccattgcatccagctagcggcgatgatggcaccatttctcccctcctccatccaccggtgtcgacgccacattatccctccctcctactgtcggtgccttcctccctccactagcttccaactccagttgtcgccgttccttgtcgcctatgcaagctatccaatacgaggaagcctccttattcttcagcggtgtagatcgagggggcgacggtggatatggagcttgcggcgataaacatgttgcccaacggtgatggaacatggagctcggcggtgatggcatcgtcgtctgcgacacttcactacgtcattcctctctctctctctatctctcttacgtgtgtttgtgttttttttctacttactctcatgctttctctgacaatgctactcattcctcatagcggtaatcattatttctaggaccacgctagttgcctacgtggaggggaatctcctaggtgactagtcgggggttgaatgccacatagacgcactgtgaatggtcttatagtcttttcgaaaggaaggaaatgccgtaggaatcgggatcctacggatgatagcgtagttgccgcttattagaacaactatagtatgcaaccaaagatggtacctgtggtgagcttgacaacgataatttcaattcctcgtattctagccacggcaaagggacactttgtaaagggcatggatgacaggaagtgagaatgtacattgggtgaaaatcttgtcctagttttgattggtgtcgacgatagatgttggtgcatatgaacgtcgtcttctccctttttattcgggtgaaaacctagtcctggtgttcggagcaagagttgacaaatgtcctctctagaagtttcatttaggacgtgtttagttccaaaataattcttcaaatttccaacttttccatcacatcaaaactttcctacacacataaacttctaactttcacgctaaaattggatgtttggttgaaattagaacgatatgacggaaaagttagaagtttatgtgtgtagaaaaatattgatgtgatggaaaaattaaaagtttgaagaaaaagtttagaactaaattcggccttagaaggtactccctccgccccaaaaaaagacaaaccctgggtttccgtgtccaactttaattgtccgtcttatatgatttttttttataattcgtatttttattgttgttagatgataaaacatgattaatattttatacgtgacttgtctttttaatttttttcataatttttttaaataagacggagggtcaaacgttggacacggaaaccagggtttgtttttttttttagacgaaggggagtagcgctttgggtggttgctgattttttttttcggttgttgaccgtggagggtgtggatcaacgtaggaaagtcggtgttgcttggtctttgactttaaaacatggcaacaatgactcgtgatgtgtctcaattttcttgggtcatcagttgcggtggcttgccgcctcgaagtgtgttctcgccgtggaggttttcggcgattactcaccaattaacttcacagttgcatgactgcagggcaagtttttccttaataaaattggtcagtttttttcttccgtgacgatagaggatgtaactctatgccaattttttagaggttttctttaaaaaataaatcaatgctcgtaccattgattcataggaacgaggaaaaggaaaaatgtggaaatttttctactctatagttctagagaaaaaaaaaccaaagcttattgctttggcagctcgtgtatgattgagacataactactcatgcccctttgaatcgcagaatgaaacaaaaggaataataagaaaatcacataattctgacctgaacaaggaatgaaaaaatatatgaaaacagaaaatgtgagtttaagtggaacatatgaaaaacactggaatcgaacgagattggacatgaaaaataaataatgttatgtgaatagcatgctagcgagagggcacgaaagaccacacagagggttgcacctaatgtattgttaggaatgaagggaatgagtgagcacccagtggtgttgcatcgtctgtaaggtggtctggtggagataggctccgtgtggtggtcagggtttaccgaactatttagggtgggattatcaccaccctgtggtttagtaaaaccgaaaatgttatcatacgttataaccgcacgatttggtaaactctggtggtgtaggtggttggtggttgtttttgtttttgtaaaaatggcttatagataaatgactacatataaactacgaaggacatttattatcacattgttgcaaatctgattgattttttttgggtgaaaatatgtagacaagctctcctgttttataattaagagtaaattgcgcccgtagtacaacaacttggcaagtttgtgcgatatagtgcaagaacttaagaattaaacgtccaaatataacaacttgataagtgtgtgcgttctagtacaagaacttgataatttagtatttttatgcatcaactttgctaagtatatgctaggtgaattttttccacgttgtcaatatgccattacatagtaatcctacggatattaccttataatattgaacttaatctttaagaattatactgcacatacaatttacatccaattaccttttaagactttttttcttgaccttctcaaatatcaaccggaatataataatttctatatcctgtttaattgactttcagttattagttattaggataaaaatataaatatgcttatacaaatacacgttagtatactgtcaaaataagtacttaaaaattgaatctatataaaaaaatactattaagttgccgcataacctcttaatttattgtatcaaaatcatatataccttgtaagttgttgcatttatatgatcttataagttcttatattaaattgcacataccagccaagttgttgcactcgaccgctcatttctcaattcttacaccaaattgcacccacctaacaagttaatctaccgtgggtgcaatttactctataattaatatattacatttacatagtatgtagacatatactccctctggttctatattaattgacgttttggacaaggttaagattaaacttttataactttaaccatcaataactttaaaaatatttaatttaaagaaactagaaaaacatatatagatttgtctttcaaaacactataataaa

SEQ ID NO: 37812 - DNA, 24026 bp, Oryza sativa
ttcctgcagcccagttacaattttttttttcaaactttcaattttttcatcagcattaaaactgttcttacacacataaactttcaactttttcatcacatcgttctaatttcaaccaaacttttaattttaacgtgaactaaacacacctagtattagattggttttttatgggacggatagagtatttacatattatgctactctactcacagttatcactactatgccgctatggctgtacgcctttatatttggggtgtgtttagttcatgttacaattgtaagtttgattgaaattgaaatgatgtgacggaaaagttggaagtttgtgtgtagaaaaatttttgatatgatataaaagttggaagtttgaaaaaaaaagatgggaactaaaccaggccttgggtttgttcaaacccaagggttcccaacctctcaccgtcatattccacgcgcacgctttttaaactgctaaaatgtacgttttttaaaaaagtttatatataaaagttattttaaaaaaatcatattgatctatttttaaaaaaaatagttaatatttaattaatcacgtgttaatgatctgctccgtttttcgtgttgggtgagcagcaagcacacccatttggcccattagccaattggcccatgaatgaattggacttcatgtcttcgtgaaccggtagaggtggaagtagagtggagtacattaatgattaaatatggatactttctaccggaagcattaaataagcctgccacacagttactgcgaatattattaggtgttgttttgattcagatacttaattttagtctatacatttagatactaatttaaagtattaaatataaactagttataaaactaattatataaataaaaactaatttgcgagacaaaatttttaagcctaattaatccataattagagaatatttaccgtaacatcatataggctaattatagattaattaggctcaatagattcgtctcgtgaattagtataagattatggatgtgttttattaattgtctatgtttaatatttataattagtgtccaaatatcttatgtgatagagacttgaaaattttagtctcatctaaatagggtcttacgctgtaaaaagaatgaactgattttaatttttactcatggtcacattatatttttacgtaatacttcctccatccacaaaagttacttagttttatcacaaagattaagaagaaattaaatcgtcttggatgatacaaaatccaaccaataagtatttagatgactccttggttctaatcaaatgtttaatttatctcttcatttaatttaagtcttcaatgcataaagactaaaataggaacaacttatttagaaaaacttaaatataaaatatgtgtaacttttgtggatggagggagtatttgaaaataaaggtgaatgagtactctctccgtctaaaaaataaactcaacctcgtaagggtgtgtttagttcacgcgaaaattagaagtttggttaaaattggaacgatgtgacggaaaagttgaaattttatgtgtgtagaaaagttttgatgtgatgaaaaagttaaaagtttcaaattttttttgaaagttgagtatttttttttaacggagggaataatgttgtgcagtaaaacccgtcagactgctgtgtggactgttgtcccgtggttcagtcaaagatgccatttataaacccttgccttaaaatatggagggatgtgtagctcagctcctggagctgacaactccgttagaatagtgcaggtatgtgaagaagacttgtatggccaaacgtaagggttagggtatgtactcctgagggttagagtaaagatggaagctttgccgtgacaacatttgcggaatgtatcaccgcgttaggttttgaagctgggaggggcggagggcagcgattttggttggtagtagtacgggacggcggcgaaaaaaaagaaagcaaaagcagtgctcccgctcgccgcgctcggtttcgacttccaaaggcaccgccgcggcggcagcttccccgtctttattaccccaccacgccatcccttttttttcacactcccgccacgcctcccaacgcccccgaaatctcgtgtccctacgtgccggagcagctgcgagcttttgcacccacgctgtgagccccacccgcgtacgccgcggcctacgccgcactccactccaccccaccctactgcgccgcgccgtttcaaacccgttcctttcgtttcaccgttcccaccacgcacccctctatttatccccgcccccaacaacctcgctgcactccacactccacgcctccgcccgctctcgtcgcagcgcaccccgtcgcgtgcgacgactccatccccgtcacaacaatgtcgtcccgccgagacgtcctcgctgttgtcctcgtggccgcgctgctcccgccggcgttgtcccgtgggctttggctggggcaccacgggctggggcacgggcacgggcgatggcgcgcgccgcatgtcggcggacacggccagggacaggggccgcagcagcacgcgccgctcggcggcggcgggtggtcgtcggcgcacgccacgttctacggcgggggtgacgcgtcgggcaccatgggtacgtttttttctcgctgtgcactgtgctgaaatgttgtacatctgcgtgttgtgctcactgttttgcgtgtgcgtttttggtcgcgtgcaggaggggcgtgcgggtacgggaacctctacagccaggggtacgggacgaacacggcggcgctgagcacggcgctgttcaacaacggcctcagctgcggcgcgtgcttcgaggtgcgctgcgacgccggcggcggcgggagccactcgtgcctgcccggctcggtcgtcgtcacggccaccaacttctgcccgccgaacaacgcgctcccgtccgacgacggcggctggtgcaaccctccgcgcgcgcacttcgacatgtcccagcccgtcttccagcgcatcgctctcttcaaggccggcattgtccccgtctcctaccgccggtgagtagccaacgccggcaatttcttgccttcgcgtttcgctttcttggatctaccggaacttactgaccatggcgtgcgtgctctcgagtgcagggtggcttgccagaagaagggcgggatccggttcaccatcaacgggcactcctacttcaacctggtgctggtgaccaacgtgggcggcgccggcgacgtgcacgcggtggccgtgaagtcggagcgctcggcggcgtggcaggccctgtcgcgcaactggggccagaactggcagagcgccgcgctcctcgacggtcaggcgctctccttccgcgtcaccaccggcgacggccgctccgtcgtctccaacaacgccgtcccccgtggctggtccttcggccagaccttcagcggggcccagttcaactgattccgctcaattttactcgagcatcgtcgtggtagttgcagtagtactcccaactggaccgtgctgggaagtgccattgttttatgattggtactcagtctcgccttggttcttgggaaagtatttagtgggtagtttggcctagtatcaacatgggctttgtgctggtgtcactgctagtggtagtttgttacaagtaccattagttgagcttttgtggtatcttttggctagggattggaagtggtggtaaggctgtggcttgattgacagaggccgccttgtatcacccgccaaaatagcaaaattgggcctaatgggaatggccttctgctagtaatggttttgcctggttgttgtctgtaccggaccccagtaccggacctcattttgggggtgccaaacagtttaggcatctggggtatgccctgtgtgctgcttatgaacaatttctttttactcgtgcttctcttatgcgggagtattaatgcatttgaattcaatccaccgtatcacaatctgaaacaatctgaaacaaatccaagaaaccgccgtacatgatttgcttgctgcgtcaacaaccgtgcaaatgagtgtgtcgagcctagtgtacatctgctcgtgcgaggcccattgcaccgtactgctcgttttcgctgtgcgcatcaatctcttgtgccgatcgtagtgcgcggtacggcgctgcgtggtcgttgcacacagactagacagcggcgtggcgcgcgtgaagggaaaacgaatgaccggattacgttcctgtgttcgctcggttagaccgccgagcaagagttctacgagagacgcgtcggtgtccaaagctgctcgacgcgcacaggcgccgcaggccggggacatgaacaacccggcgttggcggaagttttcaaccgagcgagagaaagaagtgcggtgacccaacgcaccgtcggcagcgagcaacgtcaaggctatgtacagtgttcaccggctcacggcgagtcggcgacaataggcagcatcgccggtcagtctgcgtgtcatgggctcaccgaatgtaggagttgttcgtgtggagcgacggcagcaacggggagacgactcacgacttcacgagtccgatcaccaacacattgccgttaaagccatgtgcagtcgccggcgtgtatgtgaaatgtcaataccaatctgtaaacaattggattttgggattggcaaaaacaattgtatccgcgcgtatgtatccacggtttggttgtatccgactccaaaccgtgtactactccagtccagtctccaggaaatcaggatatgaactgtagggcaagtacaaaagtagagaacggtaaagtctctacgttaattagaggctatcacgttacaatatttaagttacagtctctaatcattaatgtaccaaaatattttcttactagtcatctttcctttattagactcaatgcaataaaaaaatttcctaataaatgctaagagtcgactctacaccgttgtcatgcgtagcaaccatctttctctttccttcttcctctctcttccacgtcaccaaatatgcttgcatgatactccctccatctacttttgataatcatatttccaaatctgaaaattttatttttgataggcatatttcaatccaacaacctatcatcttaatgattttctcgaatttaatacgtgactctccattcttccacacatgattggctacatgggctttgagaaatgtaaatattaatgaatcgcttgtttacgaggaatgaatagtagcatgcttaaatgaatgataagtagaattacttatccttggtctgtgtgttaagatgaaatgtaactattaaaaaatagatggagggagtaataaagagagaccgctaataaaaaccactgtacatgccctaaagtagcatagtactactacgtattatatggagagcacctactgtttgatacacaattgtatccgcgcgtatgtaggctgctccattttagtcattggttgtatccggctcaaaccgtgtactaatccagtccagtctccaggaaatcaggatatgaactgtataaagtagcgtagtactactatgtatacggagagcacctactgtttgatacacatactagaactactcctacatacagaaggcatacagatccctatgggtgtgttcggtggtgggtgttgagaacctatcacccacgcacggaatacggaacggtctattagcgcgtgattaattaaatattagctaatttttttttcaaaaatagatcaatttgatttttttaagcaactttcgtatagaaaatttttacaaaaaacacaccgtttagtagtttgaaaagcgtgcgtccgaaaaaacgagggagaagggttgggaactggggttgcaaacacagccatagagattcctgcacggaccgtcaagcaatcaaacactccagccagtcatcaacttaccggtaaaactcgtgcctgcaaggttgcagagctcaagtagttgggctccagaaagtggaacactcggagcaatggtcaggaaacaaggaatctggttccgctcgatgcggatttctagaaccgtcattccaatctctgacccaatttttgaccagagaccgtcattgccagcgagctacccattggattctttgatgttgtcgagcagtagcactcaagtgtaagattaacgaggctgttagcgacaaagataagagactctgttttgagtagtacaggagtactactagtagagcatttgaatttaacgtgccatgcacaaaccaggccgatcaaaacttttgctaatcctgcaaggtcatcgatcagccaacctcaggcaacagcgaacaaactaggggtgtttgggagagagggctaaactaaaaacataaatctctagggtaggtaaggagggactagagtttagtccctctcacaaaaattttagtctcttctatagggacttatgtttttgtgagagagattaaagcttagtcactactttccaaacactatcttatgcttttgtgagagagactaaaagttacctagttccaaaacaccccctcagcatgttggacacataccgggcacaacagataacactgtcctgcagacaggtaaatcttttggcatctgcaggaggtttcgctgaggagataaccgacaacatatacaaggcatgggaaaaagatgctgcgattgttttgcttttgcatgcggcgtcttgaatcgattcacaaaagaggcaggaagacgccggtcaggcgcgccattgatgggctcttttttttcccttccccttgcttggtcgtactactagtagtagcggagaggagacatggcggtcacaaaggccacacgtcccggttactcggctcacacgaaagggatggtggtggtggcaagcaacgtgcgagtgtcggtggctcgtctcactgaacccagtatgcgagcctgcagccgcatggaggagatacggatggcgtggtgcacatgatgctacagctactgtgcattgaaatctttgcgatgtctctgcctcccacttgctgggtgtactgcgtcgccgtggactgtgagatggtggttagttggggtatgcctttgtgcctttactaatactacttgtacctttttacctttgtttttccgtgggtggtggtgttgatctgaattcttttggagggtaaaatgtacgcgcgacgttaacctgatactgtcagtgagcaattatacaggtgtgatctatagacactcttgattctgcccaattggatcaatattttttcttaagaatgtgtagttaagaagagagcagtactatactcaacagagggagtacagtgcgatgggctacggcattctccctccatcttaaaaaaaacttaatttctagagtttaaattttatcccataaaaaaccaacttctatcattctacctaatctcaaacgaaaagttttatccctttaatatcttttatctatctatcacccttactattttttttaataattaagggtattttagttattctcacactatactaattttatattgggatgttaggaatgggttttatttaagaggaagggagtacggagcatcagtaaagggcgacgaagagtacgccaaaagaccagaggaaattccgaagcgcacgttttccatggatcgagccagcgcgtcctcgtccggcacgggagccgagagggaggagtcgtcgtcgtctcgtcggactcgatctcgagcgctgcggcgacgtttcgtggccgtatcaactgatccgacggtcgcgtgttgccgttgccttgtggcttgtcggttccgtcggaagtccgaacacgatactcgcatcgcaccgtgctctgtgcctcgggttcaccgaggatagcggaaggttgggtccctattgggccataaggagacgggcctgtttgcatccaggttttaatccgatagaaataagttcatttaaggtcccttaacttgtcaacgaatccgattttcgttcctcaaccagaaaatatgatgggtccctcaactgtcaaaaccagtgcagatgaggtccctcggcggttttgacggcggttttggctgacgtatcgcctacgtggctaatttgacttggtcttcatctgatatggcattgacgtggcgcttacgtggcaattcgaccaaaaaaaaaaaacttcgtgggacccacatgtcagttttacacataaattaataaaaaatggtggggccccaccagtcattctcagcccccctttcttcctcctctctccccatctccctctcctcaactctctctcccctctccagtcccccatggcttctgagcgcccgctgccgccgccgacgtcgttgctgctcccgccgacgcagccggagtccgcccatccgcgccgactgcctcgttttctccctcgaggccaaccccttccgccgggagcccgacccatcggccgcgtcgcagcgggaggtggaggagtccaccatggcgcagacgttggtgggcacaagactagcgtcggcgtcagcctgcatcacctcgagcagcttcgccgggtcaaggccgtagtctgtctccgctccagtgggatcgactggatgttggctggatcgaatataacatgttcgtgtggctcaaacctcaaaggtcaagcacatgaaaaggcagcaagcatatctaatagtgatgtagtgatgctaaatgctacttctactcatagagcattttacgaagctgctcgaggtgatgcaggctgaagccgacgccggtctcgtgccgaacggatgtcgtccagccgtcgccatcctcgccgcagcggacgccgtgaacgacgacgtacttgcgctggtggtcttcaagtcgggggtgtccgacccggggggcctattggcgccgtggtcggaggatgccgaccgcgcctgcgcctggcccagggtgtcatgcgacgcgcggacggggcgcgtcgacgtggtcgcgctcccggccgtgggtttcttcggccgcctcccgcggtccgctctgctccgccgcccgtcggtcgtcgcgcccgagagagaagagagaggagagaggagagaggagagagacggacagaggggagattgggagtgaggaggaagaagaggggagtgagattgacaggtgggggccacgttggccccgccttttttaattattgttttttgtgtaacttacatgtgggcccgatgtttttatcattttcaaaactaaattgccacgtaagcatcacgttaatgccatgtgagacgaagaacgagtcaaattagccacgtatgcgccacgtcagcgaaaaccaccatccaaaccgccttgggacttattttgcaccggttttgacaattaagggacctgttgtatctggttttccggttgaaggacgaaaatcgaattcgttgacaaattaagggacctaacttgaacttattccaatccgatatatatggcccatcaaatctccaatagcccaatgcaaagccatcagaacgcctgagttttggcccaagagccaactgctccaccgtctcggctcttcttgatggctacaccctacaagtacagtttggccgcggcggcggcggcggtggccatcaccggcgactcgatcgtctctgcggcgtgctcaactcgattcctctccccacgcgtcttgttcacccagcctgaggctcccggcggccctcgtgttgcaatccgcaacccacaaggtgagtttccgtttcgcccagttctcttcgtttttattcatcttggaacccttctctaactgattatcagcaacacatcaatcgaaaagaccaatttagatgttatttcaatgtcttttgaccctactttagtgagttcttgaagtgtgtttagttccaaagtttttttttccaaacttccaactttccatcacattaaacctttcatacacacaacttttcagtcacatcgccttcaatttcaaccaaattccaaactttgggccaatctaaacacagccttggtctgctgcaaatattttcagcgcatttttatgaacacaaacaaatcagaattgcgaagtactgtaggattccaagcacactgtattagtacattggcagtagatttcccccttcttgaaatcgggtttagagcgtatagtttcctccagttttgttatcgtaaatgtattccattgaagttcataggtgttaaatgtcgtgctacaatatctgtagctctgaaatgataattgtcactattaacatgctaagttacataagatgcgaagctactcttcactaaagatagcacttgcctattaaatacgttgacaatactagatgattttcttcttgctcaatgtgttcttatctcccatatgcttatcgcaatttgttgaagccctcaattgccgcagcgttgagctttcctgtcacatgcaaggcacaagagttccccattgactgctttaacatggatcctgcttctggagcagatcttgcaattgccctgccttgatctaactggagacactgacgcccatgaattcaaatccaattgcaaaatatatgatcgattgggacagaagaaagatgtaaaaaatatcatctctgtacaagtagtcatagcatgcagacgtaagaagaaatccaccaatgaatagctcaaggcagtggaacctaagaagcaccggcagatggagaaattagcgcataactcatggcacagatcaagttcaaagtgattcttatattcatataagaatttacctgtctttgaaacggcaattcttggtaactctgacaatggatttgagcttctggatgtttcccaacttttgcgtgacaatccattcgtttgcccttccagcctcaaaaaatccgatcagggtggctttcaaccggtgcaatgccataacattctcaaataagaaccacagtatgatcagatggattgacctgaagcacatggagttcatgagatgtaccatccttttgatcatagtagctggtgacacacacacaaaaaagggtaaacagcactgatctaaccttggagtcccaactgaatggagtagaatgatagctgtaggtatgaggatcagctcccacaaaggaatctgcacctctggaaagaaaactttcataggaagcagtacgctgaaaaagaaaaaggtgaagaacgtcgatatgatcctccgtgcgatgaagaagtcatatgtcatgtataactttttccagaacgagactttctgcgttggaaaacaatggaagaatataagggctttcaggtaattctagcactagaagaaagaatgctgcaataattctccgagtcaaatacagtttcgatgcatcagtttccagggtgctgtgcaacttgagaaaataatactaaccttggcagccagaatttcccagaacattttcttgaacaagagtgcaggtccacatgaccagcgatgttgttgggaccgataggctttcaaagtactcggcagctcactcttaacctggaattggaagcaaactctcaagttatccaattaatctgctaatgtttttgttcatggattgccatgtcatcatggtagaactgaactgctgaagtgaggtaaaaataccttaatgctaccaacatagacaaattcccagcccagcagtcctgctctcagtgccagatccatatcttctgccgtagttcggtcctcccaaccaccggattcatcaatcacttgccttctccacactccagcagttcctggatgcgttcatgagcatataaaattctcaaaacctctgaaaaacttgtagaggagaaggaaagcaaggagcaattgcagtggcagaggcgagcaaggatcataccattgtagccaaagaagttgcagagcgaggagccggcctcttgctcaaccttgaaatggtagtccattgacatctcttgcattctcgtcagcaagcagtcgttagcattcactgcaaggcagcttaaacagaatttctctcagcatatgacaagcactctcatacttcaaaaatttagaataattgatatgagcttcggccatgtttagttcattggttgattatcaaacattgcaacaccacctagctaaaacattggtaatgtgcggcaaaaataatgagaggatgacacatggggtccactgcaaaaaaaaagagaggaaaagttggcatgacaaagatgttgagatcgcctgggtggatgggccgtctgtctctaaaataccgactaggccgccatatgtggacactagcactgggcccatcttgtttagctcggctaagattcatacatctccatcctaaaatatagcaaattttaaatggatgggacatatcgtatattatgaatctagatagagagtttgtatagtattatggtcaaggtttttcgtgattatcacgtgcggtaaccttgtcagtttttgaaaccacggtatgtgataaccgcatgggtatcgcggtaatcgccaaatcatagggtggttgtaactggtaaccactaaaaaacgatttggggagccctgagtctctgactaggatacgttccatccacttagaaattacaatattcttaggcagagggagtacttctatcactacccagaaactgtactagagcagtagagcacgaggtttattagtagcacagtacagtaagtcttcaactgctcctcgaatcaactgtggatggaagacgacaaccggcagcagcattatcttcgtagtactacgacgagtggcgcaaacgaataacgacaccgtaccatggtcagtgctgtagcagcgtaggctactttctttcctgcccaattgccccgaaaacaaacaaacaaagcggaggtgactcaccgaactcccatcgcgtctgcacgagcgcgaggcgtgggttgtggacgaggaacggcaccgtcttgaggaggaagtccggcggcggctggaagtcggcgtcgagcatggccacgaactcgcacccctgcacgtagccacgccgcatcccttccctgaggttgccggccttgtacccggccctgtccttgcgcgtctcgtacttgacgttgatccccttcttcccccacctctcgcactccttcctcaccagctcctgacccaagaacacacagacagattactttgtcagttgattacttccaaaatttacttcgttttggttgggcaactttcaggattcgatggtcccaccttgacgatggcgtcggtggagtcgtccaggacctgtactattaaccgatctgccggccatgtgagcctgcatgccgccccaattgatagttggtatacctgcattgttcactgtttttgtcaggtggagctaaggttacccccgtgaacgaatcctacagccaagaattgcctgttctatgctaactaatcaatcatgcatttctgctcaaaattttaaatgtttaatgcatgtaaatctgaacacgatgctgaatgcggcgacaaaaacggggattatcactttgctcttctgaaaaaaacgacagagcactgcagtgttcccggaaatggcagagttcagaactgattgaaagccatgttacctccttctcgttgtacatggggatctggacaagaaccatggggaaggacgcccggccagcctcatcgtcgtcctccacgacgacgggatcgcacctgtacagcctcgccggccgccggcggagcaacttcaccaccgcgctgaccaccccgaggaacaccttctccgcgagcacgatcaccgacatgaccatgcacgccaccaccgcgcctctaagcagcggcaccagcagctccatcctcacctgccgccatgcctgcaccaagctctccaccacggcggccaccgtgtcggcgaccaagagcctatcaccgccggcgcgcaacgcaagatcacctgcatgcaatcggcgatcgtgcacgggtgaggtgcctcttggagtcggagacaagaagtcaagaacactagtgctggtaggatcagaaggaacaaaatgcaatattgatgtactactaccttgcattgctgctgctgcttcctggcccttgtgcagtttcagacacttgattgaggaggcagcagagcaagtggtggtgcagtggtggttaagacatgaatggccatgacggcaatgggcgcactgttactggttgaatcgggctttggatgtacatggacatgggcatattccagatctagggtaagacggcgctgtttacgattggcacgttctcttcgctgaatttagctgatatttatgcaaagctgctagctgctgcgtaacattgttttatcggagataattgcatatggttatagctgggtaagtattgcctttggtttatggctgccatgtgagcctttggatgctttgttgacctgtggtcaatttgtgtttttagccatatccgcatcccacgcggttggctgacttgtgttggtgccatgcgagccagtactagctaggtacccaggctaggatctactacatgcgtatgacagcctgtgtgatagtaggagcaatatatgcgagatgttaacgtgtttggtaggccgcttaattgtggtcaggctcaggcgaaaaaaaaaactacttactccttttcacaacctaagcattaccataaacatatatatatatttagttatatatctagatttattgatatctatatatgaatatagataatattaaaaagtcttatatcgtaaaacggatagagtactactgttggtactactgagctagcagccgcaatggccgtctgactgagatgtctccggctgtgtttcttccttgtacgtgcagtatcttgggatggcaattattggaacacagtcatttagtcattgacattaacacgagcgcgcgaatcccgggttgtttaatggtgttcctatcccctaacacagttccaaatagcagcatgacatggtagtgtcagtagaagccctgtgcttcactgcttatatgaaagaaaagacaagattcagaacatggttaacatccggcactgaacttgcttggaacctgcactgaagagccgcactggcttgaaaaactcagaaagctggcaacatatacaaatataactcccgcgacccggccatctcgtctccaccatttaccaggacaatgcctttaacacacacacacaagacacaacacattcggtaattcagcgtgaacgtgagtacgtgaccaataagagcagatctcatgtagtagcagtgtagcaccagtagtacagttcacttccaccgttgctcctaccgtccggtggcatgatggcatcgcgtgccgccgtctcagcagcagcgtgccagtcatcgtgtgggcgcgaacgcgcgcgatgcgtctgagcgtctccgacgcagagccgccctagagaaaaagcgcgcccatccacggcgggatccagaggcgtcgcgaaaaataccaccagctcaccactggtacttggccttgacgaggacgtcctcgtagagctcggcggcgtggtcccagctgaggtcctgcgccatgccgcgcgcctggagccccctccagctctccttgtagttccggtacgtgttgaggcagtgcccgagcgcgtcgatcatccggttcgcctcggcgcggtcgaacgtccacccgagccccgtgtcggcgaacgggtcgaacggcgccaccgtgtcgcggagcccgcccacggcgtgcaccacgggcacggtgccgtacgccatggcgtacagctggttcagcccgcacggctcgaaccgcgacggcatcaggaggacgtcggcgcccgccgtgatccggtgcgccagctgcaccgagaaccccacccacccgcgcaccttgtcgttgtgctccgactcgaaccgccgcagcatctcctccaggtccggccgccccgtgcccagcatcaccacctgcacgtcctgcccggcgatccacggcatcgcgtcgccgatgatgtccacgcccttctggtggtcgagccgcccgatgaacccgatcagcggcacgtcgtcgcggacctgcaggcccagctgccgctgcagcgcctccttgcactgtttcttgccggtgtccagcgtctcgaacgtgtagttggcgtagccgtcggactgcaggtgctcgtccacctcggggttccattcggccatgtcgatgccgttcacgatgccctgcagcttccagtcgttgtggtttattatctcgtggaggccccagccaccgtccattgtcttgatctcccacagatagccatggctgacggtgaccgcgcggtcagccatcttcaggccagcggcgaacacgttgctgtgctcaccgccgacggggtcgtacagtctgaaatgatcgatgtagtgctcgggcaagtccatcgtggcgaagtcatctacagggccacgaccctgaaagaagaaaatcatgaaacatctataagagattagcatcaaggtaaatgcccacggatgacaagcgggaaaacaagattgaattacattgcgaaacgcaatcataaaataaatagaagccaatttaactttcattagaactaaattggtgtcactatgacagtagtatagtcaattatctttcaagaggcaaaatcaataactaattcaacttcgtaagaacaaaactggtgtcataaataaacacaaatttcctatattttctacatatagggtaaaatagcaggtgcactctgctgtattccagtacacaactctgaactgaattttgtactttatctgaataccaggtttaaaattgtatggcccttattaaagaaaaggagaaacacttgcaaaatacaaatgccattgagcagatcacttgaaaacaagtacattagtggttcagataatattcgaagaatgaaattgcagaataagactaggtgaaaaacctgatgagcaatgttgtgtatcacaagaacagagcgagtatactgcatcaagccattatctcggtaatatgccttcaaatatacgggtaaaagtgcagtatgccaatcatttgcaatgaagactaaattgccatcaccgtagatggaaccaccacatggagcaaaccaaggaacctgcaaatgtttcatcagatgaatgaattgtacttattcgagaacataacatcaggctcattcacctcataaactaaaacaaacatgaaaatcttatcattaattgttcttgtgttttctacaaagtagtcaatggcacacaaacagcttgctgcaagacactcagatatatatcgactgactagatggtgtactaaattctaattgtcaaacatcaaaattttagtattaactgtttgctacgaagtagtgaaaggtgcataaacagcttgctgcaagaaacttggatatgcatcgactgaccagctggtgtacgaaattctaattgtggactgtagtaagaaattattgtgtttagtcccactggaaattgatggtggtgagacctgggtggcccactcgtggtggagtgagctgcgaatctaacagaactgtaaggagtacatttatagactagtagcaataaaatgggaagttacctcaacagcagctttgcagaacaaaatcatacgcttcaaaacatcctgccatcaaatgataaaattgtgcaaaaaatatttacagaagatttaaaaggaacttatttgtaagtcaattaagctatagaaaaattgggacttacaaatctttctcctccataaatatcattgtgccggtgtcgaaagggaggggcctctagaaacacaaaatcaacaccatcgataaaagcatgaaaataactcacttctgaatcctgaaaaccacacacacagaaaaaaaaagattctatcatgaacctttaaacttttcatttcacattgcacaataactgtttcaatgttttcttacctgtccagctaccctgtaacgtttgcggacacctagatccttggcttctgcatattctccgtatcttggtatcacaacctaaaattgaaatagccacttatatttggatcacttaaaactaagccactgaactcaatcggtgcatatcctactacatttcaatttaagatgctatcttaagaattgtcatccatctcaagcatgctaaatcatacagctcaaaaattgttatctaacaagaatacaagatagatttccacacttctctcctaaatatgtgaaacaacatttaatagctgacagagacaacagggtaacaatttgaggattgttttccatgatgcacgcaaatcaaaagaatgagacttaagagtttcagatataacaatcaaaataccacctcttagtctcttacgttgtggattgcacatatactagtactacagattgttaatctcttccgagacaatcaaacaaagacaaatgtgaaggagtacgtaccataacacgatgtcctcttcttgccagagccttaggcaaagcacccacaacatctccaagaccaccttcacatgatagcagttattagaaggaacattgcctaagcttaaaagtaaaagcctgattggtcatgctcaaaaaggggaaatgatggggtcaggcccaatttccagtttagatatgcatacctgttttacagaaaggagaacattcagaagccaccacaatgacattcatcacatttggccctgccaatggaccagattccttgttctcactatcatctgcagagcttactgcacctgcatctccaccagcatcagccttagcttccaacggttcagcaacaccgacgtcttccttcttgtccagtgcagccttcgattccacagcttgtgcattaccatcagcttcagccttggaagcaggaactgacgggtcaactttgggtttagacactggtgcatcagatttggtagctctgctcacaacctctccattttgcttcgcaacggcaggtttcacgtatttgggtgatgaaactgaatcctcaacatgatcagcctgaatgcatatacaccatcactcaaccagaatcagcaaagttataagcatttaagcattatcaacttgaaaaatgaaatgtcacacaggggtagtggaatatactaaacaagttggatagggaaattcatgtcaaaaagtgcagcgaggtaacatttccgaataacaaatggtaaataattagctcctagctcgctagatcaagcaactgtagttctagcaacatggctctacatgtaactgcgctatttgcactaactaattgcacgttctggcacgcatactataatcaaatcacgaaaagtagttaaaatatcaaaatgacacgatctgaaagtctgaaacacgtgggccaacagtctcaagcttggttctaaaaaaaatggaggaaaagtatcaaccttggccgtgctgccctgcacagcgaccgccttcgagctccccgctgacttcgtcttcgccttcgggacgccatcctcaccaccggcggccgacgccgagcacacgacggctccgtcccgaaccaaaccccgccgctcccatgcaaccgcagccccgtgccaccatacaagtgccaccaaaccccgctcaccctgctccgcctgcgccgcggcgaaaaggaggaggagccagcgaggaagagagtagccgccggcgaggaagcgattgcccccgacataggatccgccgccgccgccgctcctcctcctcctactactactactagattgcggccgagctagctagctaggcaacgagcggcgccgcgcgcgcacgaggtgaattaagcggcgggggaaagatctgccggaggtgtggctgatgttacgccggtgtggtccccgggggacggagggggtggaggccactggccaccgacggcggagagtggccgaggtgggtcgtgtcgtgtggagctcgggaatccgagaggtgggaagacgagacgacgacgagagaaaagagattggagggaaggcaaacggctcgccgctcttgtgcaccaaaattttcaggatattttcctgtatttttttctattttctgacaagtgggccccaccgtttggaatggccgtctccgattggttgtgggtactggggtgggccatggaaaggggcatgggagaacaagattgggttttggtttgactgacctgtggggcctcaatttggtgggtgatggtgtggggcccacgtgtcaggcagaggggagaaggtgccagaaggaccggcctgaaacacgtcgtgggctcgtggccctgtccagtctttggacttgatgatgtggtggcgatgtggctagtggaaaatgcagtgtgcggagtgcatatgcaatcggttcgctaatcaacttcagtccaataattcacgtctccaaacaataattttcatacttcaattcaatagtttacctcttcaaagaattttcctacggtaccgttgtgcaaagtacacaattagttgtgcattatatcgggcctaaattttcgttttaatttctatatggatatgaatcatttcagccggagttggattgtaaatccacccagccagtcaacttgtttacttaccaaaaaccaacaaaatcttttattatggctgtgttcggaagagctagcagtggctgcgctgcagccacaccaacaggatctaccaagtaaatttgtactaaaacaactgcagcactgcggctgtacagccactgtctagctgatccgaacaaaccctatatatcgtttgatgtcgctgaggcaaacatactgtgttcaaatcgagcggactcaaacggtatattttcaaatgaaaaataatttgtgaataaaacttttatatacgtgtttttagagatctaaaagcaaaggctgaaaaataaacttcgatgaaaaaaacccaaaatcaacttcaaatttaaggttgaaaatttaaattttgattgataagtataagtataagcgaaaagatgtggcccgagatttcttgaacataacactcaattatgaatgtttagaccaactccatggcacatacaattgcaatgcaaggggtgtattgaaaccaaccaacagtgataaacaataggtactttgtatgtatctcggagcaaatcataatgatgaagaaatataaaacatgaatgcctcaaatatttcatgtctggtttgtgcatatctctgtttcgacctaccaatgaaaatggcacatgcatctccaaaatgctccaaaaaatacaataaaacaataaatttcaatttgagaggaatgcatgttcatacaagaaatccaagaaaataactaatttgctagtatgaggcggccatgttctagaaaaatatcataataagttttgctaacttaagacaatcagagaggcccaagtcattcaacaattaacactagcacaatcaaaggaacatgctatgtggagtatacatttctatgggctctatccttactaggtggcacaaatcggcttacttactatattaggttataacgttcttattgtctcatgctttgcgaatgggcatgtagcctagtggttacagtgacataagtagtacaccaagtcctgagttcaaatctccatatgagcaaattttagattgagttgtttgaggggctaagttctcaatttaaaaggcttcatatattcggttgggtatagagaccagataaaaaataccattctctaaaaaaaaaattgtcccatgcttttaaagagactaacattcatggcctttcaccagctgaaaaacacccttatgttgagatcaatatttgtaatttctccatggcctcaaatttgccgagctcatctccaccacacatgcacaaaacacacacaaacacatgcatgaatccacatggggttggccacatatgcatgacatataatcttcacttcttccaagagatcgagtcaacatagggcacttaacacatgaaaaatttacgacctaacttttctatcatgtggcacatagcacttttcaccatttgctcttgccttctttcaattgccactcatttgcatattgtcaatcatcgaagaaagctctaaacattatagattatagaactaaggtatggccatgtggctaggttcaatcccatgctattacctattgcgcctcatataaacccttggatttgatccttgggttagtcatggcacatatgtatgcgcatcagtgagatagtggttttcatatttgttgaaggtcggatcggtatcatatattcctactatgtggaagcaaacatgagtatgcttgcgtagggtgtaggtatccacttacccttaagaagcgtatctccaaaaaccgaggagtagaaaaaccaaaacctttgatgatatagctcttgaagcttggggtctccagtagatgcctttgaaagaaagtaaaatctttaatgttctgagtgttcataccgcatacgcccatagcaatcacttaatagacgaaggttcgagagtttcaagagttactaagacccaagattaatgagcaacggataatatttgtttcaagcataatctataaaatcttttagtttgttaccctatcaaagtagcaaatgaatattttcgtgcatttctaaaaaaaagttggttttatagagcgacaaccaaccacattcattttgtaataaaaattgctaatgtcaatgcacccatatcacaatttggaccgctataccacgggattccgtccggacgatatgatatcaaataggtattagatctagatacccatgggtaccaattgatgctcgttttggtactagatctcataccctataggtaccatcagcatctcattagtatcaattggtaaccgtctgtaccagttgataccctatcggttccactggtcgatactcattgatactcgttggtgccattagatatcggcctgttggtactaggaggaaggagagaaagcaacacagacaaatgaatgtagtgttgtcctcttcctcttccctttttctcactcccacatgatgagacttccaactgaagactggcgaggtcttgctagctagggagaaaagaagaaggagctcgaggaggaagaagaagcttgacatatgatatcaaattcaaacaccggaggaatgacgagtttaagggaggacactatatgacaaaacgaagcccggtgcctccctaatatgcaatggctaaaaccaaacttcgggagctcaatccttcccttatccattcccctctatctcgctcaatcctttccttatccattcccgtctatctctttctcttcctccttctttctccctttcttcttccttctccggctcttgtatactgagacctcctccctactctgcaccacgtggccatcagctcgatcggcccaccccgcaccgtcaccaattgtagcgcccgttccgtcgtggcgcctagcgggaaaactatctcttaaaaactctatttgcgaaatttgtttctttgcttgttgtctagtgtccatgccatctcagatctcaaatccccgatctatcgccgagttcaatcccgaatccaaatccttcccaaatcaattcctccgcaaaagtctaatttgcctccccgggttcgatgggccgaatctctctcggcccatctccccctccctccccgggtctctctctctctctctctctctccctgttctccgctctgcccgcgcgccgcgcgcgcgtgcgcgtgagccgcgccgagtcgagccctcctccctcgcgtgcgcacgcccgtgtggccgctgccctgccgcgcctgagccgtccgcgccgcccggccccgctgccccgccgcgcctcccgttgcaaccgcgcgcgcgtgccgtggtggccgaccgcctggtcgccgccgtcgtcagcacctgcctgcgcctgtcgcccgtgtcgccgctccgctccaaaccgccccgccgtcatcgccgtcgtcatcgcccggcccccgccactccgcgcgcaagctgccaagggacggaggcagagctcctcctccctctgccgcgt

SEQ ID NO: 37813 - DNA, 9836 bp, Oryza sativa
cccctttttcctcccgccggcgtaatcctcctccctcctccctgtcgccgctttggccgcgaccgccgagcgctagcccttttctttgaccgccctaagtcggttcccaaaccgacattgccatcctataaacccaagcttccccctttcctttcctctcccatttgcctccacgccattgccgccgcctcccgtgctctgttcgctgttgccgttcgtcgttgcgcgtgtcggaggagccggcacgagcaaggacgcggaaggggactccgagcgcgccctctccttcctcttccccggcccgaggccggagagattactcccgcgctgtcggcctctcgtcactgcgcccgcccgcacggtagtgcatctccccgttctccctcctcgctccatttcctccccttagactcgggtagtagcacgagtagcctccccgtagctagccggcgccgccccgaccgttgccgccgctcgccatgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcgacccctcgtgacctcgtcgccgtttcccccttctcccgccgccggttgccgccgccgcaattcgccgccgtcgggcatcctccggcgaatccgagccattggctcgtctcccctcgtcctgagcaaccacccggtgcgctcgctttcgcctgtatcgccgtggttcgctccgccgctcgtcgctgtcgtccgccatccgttccggccggcgtcgtcgtctacctcccgccagcccgcgtggcaaccacgtaggcgccacgtcggcgccagctcggccgagatcgggtcgggccgaccccggtcagcccctcccgtgcgtgcgttccaccgcgagccgtgaggctgcgcatgggcccgccgcatccgcgtcctccgcgaaccgcgcgcgtgcaccgcgtctctcccccatcctagcgccgcgccgcgtgctccctccgcacggtgagccgagccgctgacaagcgggtcccactcgggaccacgcgaggtgggcccggtccaccggctctctctctcctcccctcccgcgcgcgcgtgccttgggccgccttgggccggccggcccatttagctcggccgagccgccccttttctctcgggccgcgccctagccgcccgagggaagtctaatttccctccctcttttcttttcttttcttttctttttcaaaaaggatttaattaaatccttttactttagacccaaaaatccaataatcttagaaattcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagactcgcagtgcgaggatttcgaggatcaagctccagatctcgagcaaggcaagccacctttgagcatcttgagcctatatttgaatttaattatgttacttgaaaaatattacgcattgataggatcgcacttaatctgtttgtcccgtctgcaaggcagattggcggacctacctaatttgttgcatttgatccttcctttgttaattgttatatcatgtccccttgtaaccatctagttgtgcctcgatattcgtgcaccctgtgcgagtatcgacggtcgccttcaaacttaaaatctgaaaaacttcttgggtaaaacttgggttttacaaaaggcttggaaaacccgacacctgagtcggtgcttgcgaactaaatgaatttccaaaaccgcgaatcggggaacgtaccgggtgtacggtttcccgctcttgcacctaaggaccgtttccttggaatttcatccgaacataagacaagtacgaccacatgggtggaatgggacacccctggctgagtaactagcttatcaagggagccttgatgccgagagacatgtggattcgccggggtggtgtcggggaggacccctgggcttcctggcatagtatggtctgggacctaacctgttgttggtctgggacccctctcgtcggcatatggtaaacctgtgtcggcttacgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattccttgcgtagtgttgtttgactactgccttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacatacttcaaccggacgagacgcactgtctcatccatgtcgtttgagaagcactcacttagttgctttcagaaaagagttcaaataaaatcaattacaaaaacaacagcctttccttgaagcctgcattaaacacttatttcccatggcttgctgagtactcccgtactcacccttgctctacataaataatcccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgcttcccttttgtaatgcggttgtgagctcgggatctgtccgcagcccgacttgattgtactcctactctataataaagagacctctgttgctgtgatattctgtcttcctgtgataccagcactgttttctgggactggtatcgattaacaggttaatttggagcgtcacgggctagttccggtcggtaatagttcggggcgtgacaccaatcccgtgttcgaagaaatcactcttcattgaagcactgcaacagcccccgtgaaatctggctgcctctgcatcgtttctttgccatacccgcatgagggaggaagaggatctcattctggaagctaagaatgatatgcgatatctagcattgccgtaaaatattggttaaaaaaatacccaacacaatcatttgccacccaattctttttattgccaaaactcatcgttaccaaatatgttttctgattacacgaaatacgcatacatgcacaccatgctcacatacacgcaattccgcaaatagacaccccagcacacgataaaaaaaaacagagaccaacgacaagtctgtgggcatcaagattttaatcatgatggatacaataatacaacgatcactgtggcacccgccacacttgatacagtagataatcaagcaagcacttcttcaagcttgtcagcacgcgtagcactgtgtactattacaactacacaagcgtcacggtacaaaaacgttgatcaacaaacagtacgacgtgacgtggcaaagtatcgtccatcacatacagtacacaacgatccaaaagattcaattccgacctggcaaagcgtcagccactcgcgcggatcaaacggcgaaggagaaagcggacaaaaacctcatccgtatccaatccgcgccgtccaatcgctcgatccaacggctcgtgtcccccgcaatctcccctcatcctatccactactcgccccccaaacctaacacttcactactcccaccctctgctcgcgtctcactctcgcgctcactcctccaccgccaggtcgagctcaaacgagagagatcttttccgaatccgaggaggagaagccacagaaacgatgacctcgctgtcgtcctccgccgccgcggcgcgcgccaccttcgtcatgccgtcgtcggttcgtgggggcatgagccgcggcaggaggatggcgaggctggtgacgcgcgcggcggcgtcgagcccgaagctcccgagcgggcggcggctgcgggtggcggtggtcggaggcggacccgcgggcggcgcggcggcggaggcgctggccaagggcggcgtggagacggtgctcatcgaacggaagctggacaactgcaagccctgcggcggggccatcccgctgtgcatggtgtcggagttcgacctgccgctggacctcgtcgacaggaaggtgaggaagatgaagatgatttcgccgtccaacgtcgccgtcgacatcggcggcacgctcgcgccgcacgagtacatcggcatggtccgccgcgaggtgctcgacgcctacctccgctcccgcgccgagggggccggcgccgaggtcgtcaatggtctcttcctgaggtatattgctaactcagtcacatgcattgtgaattttgtgagtaaaaacttctgccatcgtgttggatttctgattgctctgaacctttgtgcgcactgaacactaattttgcacgatgatgaacaaaattatatagtacctgcacgaaaatgtacatgtttgtttattactactgcctcaccaagagctgatctgtgtgcatgtgtgcaaaacccaaaatttctagtactgttcagaagatttgtgcatgtttgtagaaccaccctgaattctagcaaccgtaaaatagcatgaatatttgtggcaaatttatcttaggaacagtctatctgcgtggaaaccccaattttctaatacctgtaaaaaagcaatactaatttgtacgtgcatgttgaaataatgaaaaaaaatgataatggcttgatgtttggatatgttgcaagattctaactattgatttccgtaaagtccagcaaaaatttcattgaaacataattcagcaccacatgtataaagaaatacctccatgttctaaactaggcccattcggtgtgattgcaacatttttacttgatttatgctgccctgtgcattaacactattacaagtttattggggaaaataaacatgtttttggatcatgtcgtctctgttgtttgaaaggtatgaggcgcccaaggaacccaacgggtcgtacgtggtgcactacaaccactacgacagctccaacggcaaggccggcggcgagaagcggacgttcgaggtggacgcgatcgtgggcgcggacggcgccaactcccgcgtcgccaaggacatgggcgccggcgactacgagtacgccatcgcgttccaggagcgcgtcaagatccccgacgacaagatgaagtactacgaggagcgcgccgagatgtacgtcggcgacgacgtctcgccggacttctacggctgggtgttccccaagtgcgaccacgtcgccgtcggcaccggcaccgtcacccacaagcccgacatcaagaagttccaggccgccacccgccttcgcgccaaggaccggatcgagggcggcaagatcatccgcgtcgaggctcaccccatccccgagcacccgaggcctaagaggtaatcaacaatgccagaatccacaagcatttctgcatcaaatcaatggctggtcgatcggtcggggttgacacctgttcgacagggtggcggggagggtgacgctggtgggggacgcggcggggtacgtgacaaagtgctccggcgaggggatctacttcgcggcgaagagcgggcggatgtgcgcggaggcgatcgtggccgggtcggcgaacgggacgcggatggtggaggagagcgacctgcgcaggtacctggccgagttcgaccgcctctactggccgacgtacaaggtgctcgacgtgctccagaaggtgttctaccgctccaacgccgcccgcgaggcgttcgtcgagatgtgcgccgacgactacgtccagaggatgaccttcgacagctacctctacaagcgcgtcgtgccgggcaacccgctcgacgacatcaagctcgccgtcaacaccatcggcagcctcgtccgcgccaccgccctccgccgcgagatggagaaggtcaccttgtgagcctgagctgccatgaccacgaccgcgatcgaacactttgcttcattttcttgaggcattagaaactgcaatttgcggtggatcagtgtgcatgtatagtacagattcgcggctgatcaaacagatttgaacaagcgtaagtagagatggataagagagagaggctgtgtaccgatcgaccctgtccgattttcttgtacaacacaaggtgatgttcagacttgggggcagtttggttggattactgaagcacaccaatcttcggtgtgaactcaatgtactactatataagctccatgtttctgcatggttcatgtttcctgacgaatggtgaatgacatgaaatggtttactttagctgttcttcatgcaattctgaatttctccacagaacaaatgtgcagcaaaagacgccatctttattttcagaactaaaagcactagttgttcacacgccagatcgtgtctgaaaacagatatatacatgatacttcccatgaccaacataccaaactagtactgttactatcagtgaagacttggctagaaaagaggtatatacagcaaaaattcctacttttctgccttgggtcatacctaaaagcctgactagaaattactgcctacacatttgatcagccaaaataacctgattacctgcactatcctgatgttaccatctacaagcagagtcaccttgctacatatccctcttcatccttcaatcgccaggagcctcctcctcttgtagttctccttgaaacacgcttgccttaacatcttcgtccaatcatccagcttagcatcaggactttgctcgatgagcttctttgtttgctgcaacatctccactgcgttcctagtattatcttcgtcttggccagtctccatccctagctcctgcaggacatgaaattcagatttgctcagatataaacttagacactatactatttacatagatggaaaattacgggaaaactcttatggtaaggtaatggaattgttggtaaatgacttcgcccatcaaagatcaccaggatagaggactacaggggcgtgtgtgtatcagggttttcaatttcgaaattggattttatgccgggggtgaccaaaatttcggaaatttctggccggaattatttgaaaatttaactgaatttgaataaaatttgacaaattcacaaaaaattgcaaaaaaacgaaaatttcggacgagatttgagcataccggtgggggccgaaatttccgaaattaatttcgaaccgaaatttcaaaccctggtgtgtatacctcttccatctaatcgagagaaaaaaaatgagataggaaaaatactacctggacattcttgatgatcgtctccaagctcttgaccttgcggtgcggccatcgtgggatgccgagcaccctgcatctcctcttcagaagcgtgagcccgacgttgagctcctgcgccgcctgcttgatcggcaggcagaagtactgggacacgagctcgaacgtcagtgtcttttcccctgattgacggccgctcgggagtcgttgcagctgcagctccatggccttctcatgatccagcttctcttccttctcgccgccatctttgtcgctcctgtgataggcgtcttctttcatgtcgccccaaatgctcaggatatctccgtcgaagagggtgtaaagctcgtctgcattgatagatagaaaatacatgaactttcaaaactttctactgcatacttgcttgagtacatgatgcttcattcttcctcggtacagagacctgtattaccttgcacgaagttgctatgaacactagtgctgaagtggtgagtgaaaaagggctcatcctctcccagcagcaggtaatcaagactccaagatggcaaaaatggacagtgtcaatgaagagtacaacataaattacaggcatcagtgaagttctctttctaatgcagagtgcaaaaagaagttcatcttgaagaaaacaaggtaaaatgagcaaagttttgcaaaggatagcatcttcagagagtattagtaaaaacacaaaccttgcatgagattttgactgcttacctccaatcctgaaagaggttctcctcttcgtgaaagctgtaactctgaaactgatggcccccatagaacctccacttctccattggcaagggcttaagggcagtggcgtagctacgattttaggctaggatggtccaactgaacataaattttctttaacactataaatgtaatatgtcgacatagaagtatagaatttaccaacacaatgcgatcagttcatgcgatgccggtgcttcattcagcttttgtcttgtggcctgcgagcgtcgtgttggccgtcggcaagggcgcaagttctagtggcctaaccgcttactaatcaaattagtaatttagtacctaggattagagcttaatgaagacgggagggatcagagaagggagggccaaaggacaggaggaggagatgaaatatacttaccctgatcctgatcgctgcctcgccggccaccgattgccgccgtcggtcacgggagttgagttgcggcagcggtgctcgcgcaatcgttggcgcagtcgcgaactgggaagtgtggagggcggaacgacgactcgacgaggcagattgatcgccaaaaccaattagctccgcccctgattaagggtggagaagctgctcactcctcctgggaatggcacttagaattgtactactagtaaatagccacattcatgagtagctaatgcagtaaccgcagaatgagtgcgttatgcaaacgttaaatgagattagggaagtggccaatgatgtgtttgtgtactggagtagtagtactagcaaatctttgcagcctgcagtgtgttgagcagtgcttttgtctcctctctgcacataggatttctcattattaggaaaatcccagtttccaagacatgccatttttgaagcatgaacttttcatctaccctttgagctttgacgtcatcaacacactggctgatactattcccatatcgtggaggctctaatatccactgatgcactctactcacatgtaggaaaaccacaaacatatattcactcggtctcaaaatataaaaatttttggaatatatgagatacttttataagtccaaggaatctgaataaagagtatttccagattcgtagtactagtaaatatctcagaacggagggagtgctactcactcatacggagtataaacgtacatataaccatgaacacctcccatcaaaataattggctgtcatattttacattgataaagtcaatcactatagatgcctcgttagtgcggcacgaagccactgatgtagtaggctcctatggaagtttacgggctttgtgaaagaaaaataaagcctattgacggatttgtcggtgtcgttgaaaaaaataattagtcataaatatgaaatatgtgtatatgtgaacatatgtgctcgcataatttctatagaaacctttgttttataaaagagatttgtcatatttgtacaatttttaatgaaaaaatattagaaaaatgaaattcctacgtaagaagccatcgatagcagtattgcaccccagcggaaacatttttgggtgtagcggggtaagggcttgttcggttaattctcatgaggaagggattagaggggatttattcaatacctattatggtgtgaaattattac

SEQ ID NO: 37814 - DNA, 5639 bp, Oryza sativa
tagtacatctcgataggatggaaaagatcttcaaccgtcttgtagtactacgaaagacagaaaggaagattactaccccagtcactggtttatcagtactgcaacgtccattgtgtatactacccctacctctgtttgaaaaacttaccccgtaggatagtttttcctagaattttcagctacttaaattaaaatctcaactgctgcagctgtcttgtcaatattgtctatttacatttaagtcacactaatctgtaagaaaatttacttaaaagtgttgtctgattttctccattcttcattctctaaccgactttacatgatgcacgaacaaaattaattttagtgcaaagttatggactcaaaaccctcagaatcgctcctattaaagggataaagaagcagaaatatcaccggcatgttgcctcaatggacttgatattagtgcagcttgatccaatccccccccctttttttttagaacacaatccccctagtatatgctattccggcaaaccttcagcgagatgctacttactcacatgagattgggcatctgctaagttgcacacttgcattctagctctatccatgctgatacttgcagctaccaaagtttgcattgcaaagcacttcaataagtaggtgtgatgaagtttatcgtattttccattgtgaagttacttccatactatatcgcccaaaaacttcagagcagggacgccttttatttccatgtcgacaagaggggcttggattaagttcagccccattactctggatcattccttatcatatccaaagcacgtgtttgatcctggatgaaagaagatggtaaatggccctgcaacacagtttctacaagcagcagacaattactagagaatcatttcggcagattatgaactctacctttctttttatagcacagaatttacagtctgatgacgaaggtggtagaatttggttaacaatgagtctcttaacgggaacactttcatttcttagggaagaatgtagtcttgctgattcacttattgccatcacctgaaaaatgccaaaaggaaatataaagatggctattacactgataaatacatacagaaggtggtgggggaatggatacacagaatctttactgttggaatagtcacaattataaattcagttgattctgtgtcacgaaaaagttctcgcacttggaccatcctttctctcagctgctccaatttgtttgccttaagggggagaataacaaattcaaaggtttaaagacatggtgaagaaacaccaagttcagaggaattttaggcaaatacttactgcatcctgctgttgaacttcttgtccaaaaactgatttaatagctgatgttgcagaagcgatcttgctcctaagctggaaaaaaaaagatgataaatcagtatgacaaaccacaacttagatggaatgcctagctcttggtaacaggacttgaagaataactttgcattaattccttattaaattccagagacatgatatttcatcatatgaagcagaacaaggataagcggtttcttctaacaagtgtctaaaaaactctgatgaaaaagatgtaaacaatgtatttgagcagataaatattcaacaagataggcagccttccaatttcacaagttaacaaaaaaaaagcacaatctgaagctgcgcaaacgaacacaaatgaataatagcagaaatgcaataagcttcccgctaccatttagccacaaaaataacaagattgtagtggctactctctctggtcaccattatacaactttgactacctagttctttagcattttttttaaaagaaggttacataagtgtagtattatgaaatctcttgttatggcaaacttaaatatatcatttttcatagccccaaaacctatattttaagtgatatttatggtcaaagttaacttgtgttgactacacacattctaaaatgactttgttttgtgtgacgataggcaggataatagttacacaagataatacacattttcttcatcaattatgtatgtactgcaggccttacatcgtagcatgatagcaaaaggtgcagaagcaatcaagcaaataataccttcaagatcttcccaatagatgcatccaggaaatctggcaaggataataaacggagtgtatggccctgttgatgagggagacaaatcataggtaataatgtgaatgtgcgtatggagtcaattgtggattcacatatataggatagttaccgttggagcagtgtcaaaaacaatgcgtctaaacatgctatactcttgtgcttcaaggaattgcataacctggatgcaagtaggagtcacatgctagaagaagaacaacaagatgaaccaggtaaagcccatgacctgctttttctcacctttgaaatcgctattgcttcatccaatcctggtggtggtgtgtccaataactcccccagttttaactcccccagctatatggaataagatggtaataccaaagttaaacaaagcaattcaggcaaattcacgaacacaaggaccacaacattcagacataatgggaggtgatgaaatacagagagcgacagtaaacagatatgcagccttgcacctgctcagcaagcactcccagtcccatgccatccatgaagtcctttaccccagtccctccattcttctgacttgctgcacgaaactcttctcgggctttctcaggatttatctgcattaaaactcgaatatgccacactcaagcactatctatattgatctagagtaagtcaatcagaaggttgatctaaattaaatcattctgattccaaacaaatcctagaatttcacaggtagaggttttcagcttattactgtagaagctaaatgattatattgcatagctcaaagtttctcaaagcaaaatggatgttctctacgatgttcatatgctaacacttcattacaatctaaatgattatgttgcatagcccaaagcttctcaaagcaaatggatgccctaagattttcatatactaataccgctcacctcaagcgcaaacaatggcgcctcaggcccctcgaccggcacgagcgccccgccgctcaaatcctaaaatgagtaggcaggaagtgatgttagctacgcagtacgcacacaagaaacctcgaaccgagacagcaggtgctcgacgggggaggcgacctgcgcgaaggagtcgctgagggagtgcgcggggtcggtggagacgacgagggtggggtgcccgttgttggcgaagcgcacggccagcgacgccgcgcagctcgtcttcccgaccccgcccttcccgccgagcatgtagtagcgcctccgcgtcccggccgccatctcctcgaaccccatctcctccgccccttccttcgccgccgccgccgccgaggcgcgcaggcgcagcgaggcgtaacggccggggagactgagcgggagactcacgaactgcgcccgcactggcgccggcggcgagaggctgccccacgcggcggcgcggaaggcgcggggcggcggtcgcgagcatcgtggcggaacggtggatgaggcggagacgggtcggtttctccgcttctccgttctctcacggcgacaccgccatcaactgccacgcacgcctcttccgcgcaagacagcccatgggccatggcaactcgcccatgtaaagcccatgatcagcgtcagcccatatggaggttagatcaactaagcaatcctactgagccgatagcccaattcgccccaaacagccttttactgtatcaaatcctcatctttattcccattttcttcagaaaagactttcaattacggcctcatttttttatacttataattataagtcaaaagttaaattttaaaactaaatattgaacttattttttttatcgcagtttattttacaacatttatttttgagtcgttagtgagacttatatgaaagttttatttgtaaattattttctatttgttaataagctgtaaggataagcatatgtataagagaaataatagggctctttggagctcaagccaggccaatgaacatggtcaacattgcacaagaatctggactacgatacagtagaaatcgacctccacaacgcggaggagcaaaagaatcattcaaccatgattaatcatgataccatggacctacgactacagaacgatccttaggttcagggctgcaacacaggaagtcatgaaccctgcacactacagtgcagatgatccgggatgacccttcaccgagttggactaaaaacgcaaatgactccaaactcctcctcctgtagctgagtcacgtcgagctcacatccatcaggtcggcattgcgaatgataacaagcgtcgcgttgtctgtcagcggctagttgcacacactccagtcgttagccaccctggctggcaaacgagggccccggtttcgcttttcttaagtcgcatgggatttctctgtcaatcgctctgcatcgctagccgaatgtggccatgataaacaacgggttttgcaacattctacaacttggtccacttgtgagccatcctgacaagggaaaaaacagcgagattagcagataaattagacggtttcatcagctgttaccgacatgtttggtgccatatgaaagttgccttgtcgcctgttgcaaacaggggattctaaatgccgaagcttttctggactggagagagcgagagcctgcttagtcaactgactgattccttcaagataacttgctgtcgtgttcgcggccgagctagattagcttagctcctggctcttcttgattagacaatgtgataatctctacacgcaaggatgacaccacaccttcaataaactaaccaccatgcaaaaaattcttcagggtagcctaaagtgcgtactaactccagtttcttattgcaatcttttaccggtgcaataactaaagaaagattggaacatcatcagatatttgttccagtacttcagtactccctccgtcccaaaataagtatagttttgcactattcacgttcaacgtttgaccattcatcttatttgaaatttttttatgattagtatttttattgctattagatgataaaacatgaatagcactttatgtgtgactaaatatttttaaatttttcacaaattttttaaataatacggacggtcaaacgttgggcacggatattcacggctgtacttattttgggacggaggtagtacgtcaataacacatgaaaaaaatctcatgcaagtaaggaagtaaatcaaaggagaccagcagtcacaagtctcatttagaagcagtaagggcagtcccaacccataacactagacatagtttccataaactccacatcatcaagaaactagtcctagatactactcttccaatgcaaacaccactattccatactccaatttaatgctatttatctcacatgatgtcttggatgttgtgtagaaaaccatgtcccatgcaagatatggtttccttctctttcctcatttattcacttgccacatcattttttatcctaagtggtaacttatttaatgctatggacaccatcctagtcattgggttgggaatacc

SEQ ID NO: 37815 - DNA, 2186 bp, Oryza sativa
ataaatacattaaatgcataggtgagagatagagagaggaggagaaaaaaaaagagataaccttgtagctcacttactatatatgttaactttaatataaactataagcttatagttggctccgttattaaacttactctaaggaagtacattattgattcttgcagctgaagagtgtccattgacacacatgctttctctgaatgaaattgctgcaacaagcaaggggatcgaaaacgatgactgaaagtctgaacctgatgttcgatggagcaaaaattgtcaacagtttcaagcgtgtgccagctacaaaaggcagggccttactcctcaactactagtagccaagccgacctaagatgaagagagattactggccagcagagtgatcaagaactaatcagtgcagtacttggctggcccctcctacacggacgcccaaacggtgacatcaacggagccaaggcgacctaaacccggcgtcaaacgcaagggcccttcagttcgtccgtatcgtagactctcgtagtgttccagtagaccttatgttttcctgttgttttccgtgcaaaatcaacgatcacgctgacggataaccaaccttgataggggctagcataagtcgatacaaatgccttttcaaccatcagacgaccacgatcaaatgctggattgctggtcttctcatgtcggctttgctcaaatgaatgaatcatgtagtgatacatccatgcttctactatcattactggatagagcagttaaagttacagtgattttgaggttaaaggccctgtttggtagtactgcttttgatcatgtagaaccaccaaagcgcttgtttggtttattactgatgcaacctttatcaaaactaggaaggtggcccgcgcatacgcgcgggcacttatattattgaaaggtaagatttttattgtttgttaaaaaaaatatctcataattaagggcaaactaaagttcggatattgttattttataataatttaagggttcgattttttgttaagatatcttaaaaatccatttacaaactttgagtgggagatggattaagtacttacacttttgaaatatatttttttcttgagtaaatagattaaatcgtctcatgaaggtgcatgatatagtaagaaagggagggaagcatattcatggaggaaagaagaaatgaaaaaataaaaaaagggaggggagtaggtgcgtaccaaaggtggagaggtgggacctcgtagtatttagtttattctaatatcaatttaatctaatagtttataaactattggacccatcgattcaagtgaaaatcaagtaatagatactttgctttttttttttagaatttctaatattttctctaatttattagagcaccacgtgtcatcttgagggcattttaagaaattttaatggacttaccacatgtaattagaatattaacatgtaatatatatgtatgggatgtatgttaatattcgttctagcttcgtccatgtttatatatatgtagagaaaaattaaatatgtcgctagcaagccattagatgtttaattaatagcaattaattttgacacctatttacaattggtcatagtagttcttacagattcatcatacgattttgattatgcgttgatcaccaatttacttatcaccatgactcgcatgaaaaaaaatatgtactttagaggttaggataactgaaattgatgaattatcttatttatgtgatagctatttgagattataaacgaatgaattgacttctaaaaagttaaaaagttgtttaataaaagcaccatttagtaacttggaaagcatggagcgtgcaaatgaaaattcaaaagatggaatcagggaaaaaatagggccttaaactcccttataacactcttatcctagtaagagttctattgatattcgttaatattgtgttcacaattataacataatgatttctttcaactgtacgaacaaataatacaaaatccaaatacaacataacacaatatattataattattatttaataaactctcgatttcatcttaaacagagttaagtgttccacggtacttaattcttctctcgctgcatcacacctttaatatttttttcatgctattaacaaaagtggtagcgctgcagcggtcgtgatcacccaaga

SEQ ID NO: 37816 - DNA, 8002 bp, Oryza sativa
ccctgtaaagttgttgtaaatcccaggtccactaaatcattaactgatggcaaaaactcaatttgacatggtacatttgcaaaaattcatttgataaattaaagcagtttgcccgatggaagaaagcaatagcaaatttaataaacaaaaaagaacagctttcatgtttgcatttagcatttgagtagaattgactagaaaatcttttatatgagtcgtaagaaccaaaactgaggctaacttgtactatacatctgttcagaaatataaagaaaatgtgtggtcaaccttgtctaattttgactaccaatatataaaaaactatttgaattggtatgtgaaaaatgatactatcatattttcataaaatatattacagtaatacatatttttttacattttttatagaatatactcaacatgtcataacccaggagtaacaagaaacattaatcaaagtagtagatattctgatccattaggtagtactactacaaccaacttgccgctggctaggcatttggcagatacaagagaacaaaagatatgctatctagtctgtttagaacaaagtgcatctaggataaagttggataagatatgttttattgtatttgattaaaaagtaccatattttaggaaactcaatatgtagagaatatagtagagaagatctcttacaatgcttgcgagatttctttcgtcttttgaagggttccgactcaactttagtcctgacatgagaagttaatcctatgactgttgttccatggtagccaaaggaatgtaaatacacacagatagatattatttacatatgaaaaaaaatgacgaactcacatagacaaatttgccttaaccttagcatcgagagtttgtctttgatccattctctccttaacatcctttatactagccatatcatgatgttttgctgtagagcatagcatcaaacttcattccagagaagtatgagaacattatcgacgaaagaatctgtttgtcgtcatttaaagttggtgagtttcctaagggcctacataattgtcgtcacagtccattcccttttctagtactgttgcatacaaacattacaccgcttctccttcccctaacaaatcaaaagttcactcccaaacctatcttataatgcaaatgtgtcacatgcttaaatttgacatgatgacaacagaaaaacatatttttggatttttcatttctgccacgcttaacttcctacacacttcaggtgagaatgcttctcggcctattccacccaatcccacgaattattgaaaacgatgaggagaaaacattctagtgttacgacacaaacccactatcaccccgcttttcaattactacattgcaagcaaaacgatagttcttgccctaaaactacggatctctagcagggtgatttgcgcagcttaccatggaaggggagattggggtgggaagagaaggagaggtaggcgagggagacaagcgcgagggcgaaggccgggaggacgagtaggcggcagtgacgccgctgccgtcgggggtgacggcggggtccggccgccgccggagtggatattggtaggcggcgctccggcatgccaccggcgcgctctccggcgacgcgtagaggtggcggttttccccccttctggtggtgccctctcttctcttgctttgctctcttccggtaaaattcagatagccattggcctcgtcacgtgtagacgtgtagagtgtagtgcaaacctttacccaaaaaaaaaaagaagaaagaaacaaatattgtcatctggttaaggcctcctttgtgaaataaatttcgcgggaatttcgtagaattccaatttgtaagaaacttttctatttggcattttgaaacaaaggtttagagctttttaaatcatatagaattctctggtaatggctaaatacatgtaaattttagaggatagttagcaagtgctccaacttgtattttcctttttgagtttatatttcatcttattcatgcatttcttttgcattctatctgttgacattttttttttactccgacgtatcgaaatggtcattcctatgtgttttccatgtgttttaatcttttgtttttgttttgtatatgtattctatcaaaatcatgtgttttttttatttttaatgttttaccattcctgcctgcgtttcaaaagggcctcaaagtgttgtatagatcgttgcccttcgccaatggtcctgactcctaagggtgtgtttgagaagaaggggattgaggagattgagaagatacacaaaacgaggtgagccattagctcatgattaattgagtattaattattttaaattttaaaaatggattaatatgaatttttaaagcaacttttctatagaaaatttttacaaaaaacgcaccgtttagtagtttggaaagcgtgcgtgcggaaaacgaggtgctttctccctcaatgtcctccaaacgaacgctgcctaagtgttgcatgctgaacaattttggaaaagggatctacagggataaagcatgctgaagtatgtattcccttatgttcccaactcttctccctcatttttcgcgtgcacgtttttcaaactgctaaacggtacgtgttttgtaaaaaatttatatagtaaagttgctttaaaaaaatcatattaatttatttttcaagtttttttacagctaaatagctaatacctaattaatcatgtgataatctatcgctccgttttccatgtggaggggaggggttcccagcccttccaaaagaacacagccttagataccagtagtactaaaagttttggtattgactattgacaactgattactctttttttccctaatgtgtggatcaaattttgaacttgattgtgtcaacattgctacagttttcgcaactacttttcgtgatactacaagtggaattacaagtgtgtgagctgccttgcacgaaagatttcgtatataaaaacttgagttagggtgtgtttagttccacgccaaaattaaaagtttgactaaaattaaaagtttgaagaaaaaagttgaaagtttatgtgtaggaaagttttgatgtgatgtaaaagttggaaatatgaagaaaaaagttgaaaactaaacaagggcttagaagcagtactgtgaaaacaacgcggttcatctgggtagtttactaatctagcattctgattgtaagccagtgaataaactagtagtacaaaagaatactcaaggcaaaccagtgacacagataatactgcatctgtgcactacggcaaaggaacgatcgaatgcaccacaaaagttactggcttactgcatagctgcatacagtgtaaatatcatcttctcttgttaacattggcatgcatgtaagctcaatacatgcagccaatctccaggaaacagatccaagtggatcttagtgctttagtattctttgatatagtacactaatttactcactataccttggtacaaggagaacccctcccaaaaggtaacagaagaagaatatagagaacaagaaaaacatcactatacgaacaaggtgataatttcacaccaacagtgtagttagaagatcagggtaccacagagccgagagtagtggaccgagaatacactaatcagtcttggtctgctctgctatgttgagtttaactggccgtgactcaaaccctcctccttttctgtgctcgatagagtaaggcatgtaagttccaagtatcttgtcccaaatgacaaaaaatggttgtgaaaagttgtacttgtttccatagagctgatgatgaatgtcatgataagcgctgttgttgttgaacagcgcatggaggatgttaccaggaagccacagaccacaatgatcatccactgtcttgatggttgcgaacgagaaaaagaatatggatgtccgtggtgtcataccagagacgaggaatgagagagcaccaccaatggtgtccaaaataagaccctcaagaggatggttgtaaagagctccaaaggaataagggactacaagagtgtggtgcttggagtggatatgtttatataggaacttgttgatgtgcatgtatctgtgcatgaagtactgccatgtatccataacgaacattgcaatggcaaattgcagcaatatcacaagggcagaaggttgcttctgttcaatatcactttcatcaccaataacctgcagttcgatagaagttcaacagtttgagaaccatacaagtaaagctattaggtaaactccaaaagaaatgtcaagatacaatattggttcaagacacataagcattcgtacaactggacattcatgcatatcagtttattttccatggacaccattttgatatacttcaatcagcatagagcagctgccatctcataaatatatttttctacttagtcagaaagcaacaaagcacggattttcttgataagcaacgcagaagcaaaatcaacacaagtatcataactttgctccctactcattatattcaaatgacttcttcttttagttatgtgcagcttccttccatacgaagtgaatacaaaaaatgtattttaagtagcaccaaagctatcctaccaaacaacacacctacagaccaaaacttaatacatgatgcgattagctcctatcctccgcatgttagcacagatgctgaggtttaaagattgatttattgagtgctacacggtgatggtgggccaaaacaatctaatcgaaatgcgtgtgaagcaatttttacttcattgttctccaaaacaatctaatcaagacgcatgtacaacaatttgcctattttacttcaaaattcaccccaagtatttgcatctctgcttctgcacttctgaaggaaaataataataaaaaaaaagcgattctgcatgtttcgcatcagattaccacaaagctaaaaaatgaaacaattcatccaaccaataactcgggtgcccgcatgctggaagagataaccggcggcgaggaggattaccgcgaagagggtgagcgagacggcgacctggaaggcctgctggacgaggacgcccctgacgacggtgcccctggagacgacgttcttggcggcctcctcctccctggggtgcagccggtacacgtccagccgctccacgccgtccagcgcgaggtacagccccgagtagagccagtacacggcgatcggcacgaacgtgcccagcagctcgtccgacgccccaatccccatccccccgccaacccaccaatcctcgggcgcaaaacacgccccccacaacgaacgtcgagccgggaaggccgggagagagatgggcttaccacggcgcagcgcggatccccccggcggcggcggaggaggaggaggagatgttggaattggattcgtggaggtggctggtggccacggcggaggggaggtatggataatttaggcggccgtcgccgtcggtccgaacgaggagaggagacgagggaggagaaggtggggaggggagggggacgggcgttggttgcaaaggggagcgtgtggtccgggttcgtgcgacgaaccgggcacatgtgcctgtttctacttctcgtgcaaaaaatctaaggaaatttcgtacgagttgaaaagaacagctaaacataacttggctaatttttcttctctgatttggactgtgtgatctatggtttgattgcattttttaaaatagtttataataaatttactggtgccagtaagcgcatgaattactgtacattttttaaaatagtttataataaatttactggtgccagtaagcgcatgaattactgtacattttttaaaatagtttataataaatttactggtgccactaagggcatgaattactgatgctaattttgaagggacgtatacacagctccatccacaccatttcgtattttccaagacctggcttggaacaccagtaaacacatgtcgattatagagtttctctttgcctacgcaaaacatgaaaagctagccaacgcttcaggaggcaaaatcattcgaaccagaatgtttctaagcgaagtgagcgaatcctggattccttcgcataaccactttagcagaccaggttagagccaaacaactgaagaacgatctcaggatcatttagctaagacaagacgtaccacatataaaaaatgaaagggcaggacgataatgaattccctttcacgacacaaactaaatactaggcagacagctaaataccgcacattttattttgttcattaaatctgatgaaataaaacccatgatccagtataaaggaatctatgttacaattgggataaaaaggaatcgatactctgcagcaacaagtacgattaacttgtagcctgactttcaagagagcaggagtatagtaccaggatgccagtacctacaccatcaccaactgacaataaggttgtctggggccaatttcagtgcactgggccactggggtgatcatcgatatgctggtgcaccagcaaaggaatacagggaggagaccggcgcaccaggcacgttaggccttgtagaagaaacaggcatctgatggatgctttcactgtaggcaggtcctgggttctcataggcagctgtcacataggacggaccctgatggagatccattgcacgagtggcaagtctataagaacggtagagctcatccacatgatccgagcgtgcgacaatctcttctggcactctgtaatctcttgcgaggaaggcctccctgtcagtagcctcaactatagctctgggggcagaactgaaattcaaaaggttacaaattcattaaacttaaaacagatcaaaagacttacaaataagtaaataacttcaaagaaaactaactcaacgaacgctattagaagccaaaattagcagccaaaattagcacgacaaagttagctataacaggaaggcacaattttctagcacatcactaaaacaatcatcagcactctgacagataaagctatgctcccttatatgtcaatagtaagaccctactcattaggcaacaactttcctcagcctccttaagataatacaccacagtcaattcttccttccttttatagatattgtcttgtacagctaatgagctaattgctgaaaattctagaattaaacatggacaggttttgagacaatgaattccagcagtagaaaactgagatccataaacttgccatcctgtggtaccttggaattgaaacttgaaaaaaaaactacttagttgattgctaaacttgcaataatttgttttttcagttagctaaaagtattgatgtgccttcaaaacatgtggagagtgcaagtagaacaagggtagaaagttccgtgtgaattgcgaagtgaatctgagttgcagtattgaatctcctatctacacggttactattagttcaacgcctctatacttttttatcgagctggaaagtcccaaaattcaatgactgcatcaacaatctctctaaattatccaaattagttttacacctccattcactctcatgtcaacgaatttaggtaataaaaaagttgtttgactgacgcaattataatttgaatgtttggaaaaacctaaaatatttctcaattatgttgctaagcggaagctaaaaggagccaccacatttttcctgttggcatggaaattactatattaatcgaggaaaaagagaaatatctattttctcaaccatggttggtccaaattacaattgtgtagattaatcaatatagttgtatacaaaatacagtgtacattccaaataaattttaatctagtccatgtgtaattgtgcggaaattgagcttgtttttcaagttacaagacataactggcatcattatatagtttacagatctctagcatagaggccaacaaatcatgaagatggtgaggagcaaatttagatagtttgctaataaaccaactagaaaggtagagtactaa

SEQ ID NO: 37817 - DNA, 460 bp, Oryza sativa
atttcttgtttaattactaatcaatttcatacattcatatagtttattcgcatgagggataacctgaccacacacaaggaatttatcgcggcggttcaagaacaacacatgggattcatcaacgaagaaatccttgatcccaagggtgaattctactacgacggaaacacaattcaccggtccttaacttctgagctagtagcgagtactactacgtcgaaatcgtagctagctaggacatataatggattgtaattaatacatgactacatatgtttctatatgcatgtgtacacattttctataatgtaaatatattttggtcatatatatatctatatacatatgcatttggataacatatatatgtataaatacatatatattatgcatgtatatacatataatataatataatataatatatatatatacatatatatatgtatgcatatatatg

SEQ ID NO: 37818 - DNA, 3376 bp, Oryza sativa
cgtaaagcccatttcacttttctgcaacactcttcattggtagctccttacatcgaggagcacttggctctagtcgcgccaggaacatcggtaagtccgatgcatggattacacggcatcacattgatactttccccgcgtggctacgacaacatctcatgggtaacgagtcgatcaaccaacaacttgccttcctggcgagggaaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgtcgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactgtctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatattggaatttttattaattataagtcatatatttgcttattacaatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtaataccaaccgggactaaagatcatctttagtcccggttgttctcaacaaccgggagtaaatatcttttctttactcccggttgttctcaacaaccgggactaaagatttagtcccagttgttctcaacaaccgggagtaaagatcttttctttactcccggttgttctcaacaaccgggactaaagatatctttagtcccggttgttctcaacaaccgggaataaagatccgggggtatatatattcccggtgggccctcgtcttcttcaccaacacttagacgttttcagccgatcgatctttctcggcctctttccttcgccgccactgcctagggcaaatccccgcaccgacgccgccgtatctcgccgtcgtctcgagctcgtcgtcctcgtcgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgacgacgcgccacgccgccgccttcgccgccgccgcatgccaacgccacgccgccgccgccacgccacgccgccgccgccgtcgccacgccggcgccgccttcgccgccgcgcgcgcaatgccgccgccgccacgccacgccgccgccgccttcgccgccgcgcgcgcaatgccgccgccgccacgccaccgcgccaaccgccgccccgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaatgaacgtgaacgagctagggaacgtgaacgagcgaacgaacgaggacgaacgttaacgtgaaatgcaatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggtgcgacaagtagcaattgactattgtagtcttaattagacttagcatatacgcacgaaacacttagcatagatgactattttagtcttagcaagtaatattatttgagttttaatataagataactttatttgtaattagacttagtatgtaattattgactacggaattggtgcgacaagtagcaattgactattgtagacttaattaga

SEQ ID NO: 37819 - DNA, 1301 bp, Oryza sativa
  unsure (1)..(1301): unsure at all n locations
ttagcatatacgcacgaaacacttagcatagatgactattttagtcttagcaagtaatattatttgagttttaatataagattactttatttgtaattagacttagtatgtaattattgactacggaattggtgcgacaagtagcaattgactattgtagacttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatgacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37820 - DNA, 575 bp, Oryza sativa
catgtcttgcatgtgcgttatcattccgtcaatgattaactgatgatgtcgctaatgatcgatagagcttggttgacctgaacaataccgtggggcactggaaagagtattgtcatgatatcggcccctgtcgcgggcatgaacacttgttgagaaaaccgtacaaacagcactaaaacagtgtgttttcatgggatatggcaccttagttttctcttctcctcttctccacgtcaagaaaaagctatacggcgaagcttaaaatgacacatttactgcttttttttcatgctctaattaatgaactgcttgcttggagtaatcatttagagcctagctgcctagatttatcaacttcacttttatggcgtacttctcaaaattgtcggcagtcggtgcagattttttttttttatcgacacagagtgtacttcccggtaaattggtcggcaccccattttcttcaactatctacatggcatttgacagaatacatatataaggctgagttcttttttcaactttcacaactcacatatctcgttttccacgcgctcgtttttcaaactactaaa

SEQ ID NO: 37821 - DNA, 2279 bp, Oryza sativa
  unsure (1)..(2279): unsure at all n locations
ttcctgcagccccatccaagtgcaacgtcctctgctctgacattgcttagcattgctaaccgaagcatgcacactgcgtaatagagtggttaggataaccccttattgtatgtcacctttgcaaatccttaactgctcggatatttcaatttggtcaccagagatggcaatcctacaattgaaaatttgttcagttgccacggatccatcattaatctggcaatggcggcaacctctgacagggacaatggcaaattcggccaatagtaaatttcggtacggtttatcctagttggcattggcacacatggttcgtctcttctacgagtatagattatgaaaaatgtcaacttacaacaggtgacgaatttcgcaaaaaaaacgtattaacattcggcatggaaaacgtacgtagaatgaccaaaaatatccatccctatagtatcatttctttcaggggagcccccaatctacaaaagaaaaagaatttgttcgtcacccatatatcggcgtcatgacctcgacgtcgcgctttatccaggcatatagtttacaacaccttgtgaattgaaaacccacaattatttcagtctaacagcagacagaggcaacgttgctctcgttgtcgttcacggggggatgacgcgcggttttatgccctcgacgagaatacaaaatcaagtatgcgtttctgtttctcggccaatgctgatccgacaacgtgtttgaacggattaaacaaaatctgaatccccgtcgaaaaattagaccagaaacaatgatcttatgctgattaattagggctaatgagctatgcatgcaagcactgtacccagtggtgctccgacaagtaggcctgcctaatcaaaaggcagtgaggactgtaactactagtacctgccacctcccagttgctcaggcttctcaaccttagctagctcgatctccctataaatactcctgctcattaccacaacgagcaagcgatcgacggagcgagcgagctagccagccagtgttagagcttgagctgcttgttcttcttctacctcctgcactcgcgtgctgcacaagtagctcagctagatagagcgtcagaaatggccagcaacaactcgagaacaaactccagggcgaactactccaacgagatccacgatctctccacggtgcaaaacggcaccatgcctaccatgtactacggcgagaaggccatcgccgacttcttccctcctcacctcctcaagaaggtgaggagtctggagctgaatgattaattcttcagactttcagagctttatctgtctttctctggtggctggattgattcgagatcgattgagctgggggggagctaatgcgtgcacgctgcttggatcgccatggctgcaggtcgtgtcggaggtggcggccacgttcttgctggtgttcatgacgtgtggggcggcagggatcagcggcagcgaccttctcgcatatgcagtggnacagtcgatcgcggggggccttcatcgtgacggtgatgatatacgccgtcggccacatctctggcgcccacatgaaccccgccgtgacgctcgcgttcgccgtgttcaggcatttcccctggattcaggtatgcagatgcagcaacacagctacctcaaactgccaattcttcatatatattacttcttgcatcaaaatatatatgggatataatagttagctatgtgtacgacttaagccatgcactacttcggcatactagctagatgctttcttagtttctttcaatccggtctttgccaaaagatgttagcagagacacctaaccaattgagtgctgattgaatattagtagtcacataaaaattttttctgaaacgaccttagcttgttccgggtgtctttttacatatgatggtatctgaatcttgttaaatttacctccgatagctacaattttcagagtttcgtcagctttgatcctctccatttttttaatttttgacgcaaccctcttcattatctgaaaaactttttaaatctcaagagagcaaaatcattggctaatttagtcctcacttaagtacttagttattcacgcgttcttgtcaagatgttgccatggatttgattctgccaaattaaatctctattttaggcatatatgccaaattattcagtctagcttatgtcgccggccacaaagaaagtcaaaaggcgacgagaggtggtatatgctcatgtaacttgttatccgaaccaaccaatcacatatctttcaagggcattaa

SEQ ID NO: 37822 - DNA, 1417 bp, Oryza sativa
atgttcccggcttcaacagagacatctcgcaatgtgcagttagatactactgcgactgctctagatcgatcttcagctagaggtgcagggttaaagcgttgaaatgaaacatcttttcaactattttttttctcccttacacaggttcccgtctacttgggcggcgcagttcaccggaacaatatgcgcgtcgttcgtgctcaaggcggtgatccacccggtggatgtgatcggaaccaccacgcccgtggggccgcactggcactcgctcgtcgtcgaggtcatcgtgacgttcaacatgatgttcgtcacgctcgccgtcgccacggacacgagagcggtacgcgtcgtccacggctttcacctccttgtcgtcgatcgatgatgactgaattttgccgtaaaatacatggactcttgaccggtgtttttttccatatgcaggtgggtgagttggccgggttggcggttggttccgcggtttgcattacgtccatcttcgcagggtaaatacgctagaaatcgacggcccgttaatcaatcagctattcaattcgttcattcatgttcatgaccaaaaagattagtactagctattaggaagtaattaacttggagctagtagcaagaccaattagttaatttgtagccacttgactcctgacaagtgagaggggggggggggaaaagtcaaactaacctggctaatcaacattatctttgatcgatcagtaaccaaattaataaatgtagggaaacatacatattgatcaggcagaacgtagaaactaaactagttgagcagaatatacaatggagactgagacgcagcgaaaaacgagtggtggttgcagggcaatttcaggtggatcgatgaacccggcaaggacgctggggccggcgctggcgagcaacaagttcgacggcctgtggatctacttcctgggcccagtcatgggcacgctctcgggagcatggacctacaccttcatccgcttcgaggacacccccaaggaaggctcctcccagaagctctcctccttcaagctgcgccgcttgcggagccagcagtccatcgccgccgacgacgtcgacgagatggagaacatccaagtgtgataggacgacgagatgtcgtcgatcgtgtcctcttactcggaaaattaccagtcgatctcggtctcgtcatcactagctacgtctttgtgtgtgttttgtgtcgtgtcactgctgcttcgtacacgccggagagagttacataaaacgcgcgcgcgtgcacgggggagtggcgctagctttggttgcttggtggttcgtgtggggtacgtagattgctcgctctgttaattccggggctggagcctgctaattttgggcgtgtgcgtgtgccgcttgtgcatcagtctctgccgtcaaa

SEQ ID NO: 37823 - DNA, 8315 bp, Oryza sativa
  unsure (1)..(8315): unsure at all n locations
aatcatttagaagttgtgcaacatcccctccacagcctctccaaccaccgtaatattgcgtgcagatgttccctcgcctccaagtgccatctgggcagaccanaaggtgtnaccccccccccccccccgcgccacccctcatctccttagtcggctggcctcctcccttcccatgccccctctttcctaagctggcggcggtaagtgcctgtaacatcccggcctagggtttaataggattaatagaatattcatatcaacaagttgcaacttcttttccggaagccaatctccaaataactccagggttaagcgtgcttggcctggaaccgggaaattcttcccgggtgcacacgagtgaggacaaaatgtgcagaaaagacatgtgttggtatgtgaggacagtctatgacctatgaaagctgccaaatgtaagtgggcccggcctgggagaggcgggtcgttacagtgcccctaccccaaccatcttcctcgtctctagaagcaacctgctgctaattatatataaaaaaaaggtcaatgctggctcactgccctcctctattcccttggctccgatgttgtcatccgccggcctgggagaggcgggtcgttacagtgcccctaccccaaccgtcttccttgtctctggaagctccctgctgctaattatatataaaaaaaaaggtcaatgctggctcactgccctcctctattcccttgggtccgatgttgtcatccgcctgtgtccaccgtccaccatctcccatggcctcccctctaaacccgacaatcccccccctatttcctcctttcaccccaacactaacccataccctaaaccctgactcatgaggccattgctgatcaccaaagttgtggagttaggttcatcgttcactggagcatgaatcgtaaagcaaattataaggttagaaatttataaagattttaccctcccatattctcttcaacatcctatttgatgttgtggagtagtgaaatataatgcaaataattgtgaaaagcttaaagaaaatcataacagtgtatggtggtcccttaagtaactaatataacatagaagcagatagggattgtgcgcgtgttgataggtttgaattttaacatttgcatgaaactatattatctaacgaaatgtatgagacactgaatgaatcattttttatcacttcaaggtggtcctcagctgtagctttcgagtttttttagattgctcgatcaaaaccagcaaaaagagaataattggtgctgtccattgttcttatctaatctaaacggattaaagtgcgtgcttattcttatatactactacatccgtaatagatagcacaagcatatactatgtgctttgctcctctaccttttcatcattttctccttttgcttggatatgtgcaatttagttcccgtgcctaaatttagtatatctagctatctaatgattctgtactcgtatagtcattttcatccacatgccaattaattaaggcttagttttttttaattatttaacaggttgtacattgaaatagactatttacttcacattccaaaaaaaatacattttataaagcaacttctatggtattgtttaggagtgattttatagtacttgcgaagctatcgagagataccgtattttctaatataaattttaatatctctcggtactttcgatcctagaagatacaaaaatctgcactaaaaaattttagtgcctctggtactttttgatatctctcaaggatcgtaaaatttctaattatttaaactagttgttttaagttatttgttaactatcaagatatttaatatatatactcatattaaatagataatccataataataatctgcttgtatgactcggcggaaacggtggatcactaactttctctagaaaagatagaacgaaagaaaatccccggtctggattttggaatcggcgacccgcggatgatatttgcagtgcaatctaaataatcattacctcactctaacaagtgatcaggctcacaaattcatatggtgggctccacgtcatttcgtaagacaacaatatacaatcatgatgacgcaaccagtgcaacaatcaacaaaagaagtccatcaattcgatgatgtaactatgtaaggctgtttctcactcacgcaagaagattttgtgatgtgttccctgaaccattttctaacagcgtgccaacgtataaaatactactaccagccgaacaattaagaaaaacattaatcttccttgcaccgtctgcctacgttcaattaacctcctcagatgctacaccagtctttttttttcttcaactcttctaacaaacaaataactctaattcaaagagtttaggatgtacaatattcagtataaaggggtaaattaaatggagttataaaccggaattaaaaaccctttctccaacagtgaaatggagttctgttcccaccaaagaaagaaatagaaaactttatttcacgaataaacatattggaggtagatcgatcactggattacatatgtgatttatactacatatttttttcgaacaaacatatcctgagagtctaaataggacctggtctcataagatttttttttcctctccaccaccgccaagcaccaattaaaacacctagctgacagaccaagctatctgtaccaatgtaccatacagtgatcgttcaacactggctactgttatcactactagctagtgccacccatgaacatatatggaataagagacaacgatgaccacacttccacacaattaagggcggcgacgacattcttcgcgcggaaccaacttgggatagatgagaatacagtactacaatcatgccagtaaagcctagcatgccgcctattgctccacagccattttcgctatcatgcatggcctcacagcgcaggacgatcgagcttgcattgggagctgaaaatcacccggaggagtcgctgttattcgaccgatgcatcgccatgggtgcagtggtccccggagcatatcaaaacagtcgcccaatggctgcttgatcgtcaggtctgctgttgctgccgcatgtcgtcgtggatggcctcccggccatcagtgtaagatgaagctgtggccgttaattgctcgactttgcgtgcgtccggcgccgggacccgccggccatgcacggtcggcttgaacatatgtccgtcggtcnnnnnnnnnnnnnnnnnnnnnnnngctgctggacagaaagaagcatattctggtgtcgtgcaataagaatctagaatgagccctagagatgtaggctttgcaagagaagagaattttatatagccacttccttgttcttcatatatatagctagaagaaaccagggataaaaaagaagcaaaagtgggtatgtttcattggtgttttggttgaaatttgcgagtaatatgtgttacatatttatttgaaagtgcattgtatggttgtaacctgttagttaatactatcactttttttctctaccacgacaatgtcatgtgttttatcctcaatccacctaaccagccaatcaccaatcatatataggtctcaatctactttctccaccattccccaattatatatgggtgtaacccgttataatacacggacttatcaataaaactttcagtaacgtgcaccgcgtacatcgtcccagcatactgcgtttagtgcaagcagacaggcacgcacgcacgcagaatcgaactgtatcacgtcgatcgggtgctggatttgcgagaaaagcaaacctgatcagggacaagcacgcgcactcacgcggatcagttcctccacattctagaactgatcgacctgcctacaaccacgagactgaatgatattgatcgatcacactagatgacaaatgagcatgcatgcagccacatattcacacactgatagatacgactgatcaccgatgcatcacaacttcacaagtcgcactgaaactgaaataagtcttcggtacaatgacaagcggtagctaggtagcgtctcctgaatcttctctgcatgcatggccatcgtgacatgtcgaatcagcgacagatgcacgccgcacaactctctactgaacggtcatgcagggtcaggcgcgcccaatcagtgagcacctgcaaaaccaagcacgcatccttgcctcaccgcctttagcttatcacatttcacatgcatgcatagtgctacacagtctcggtgtgctttcaaccggtcggcggacggcgtctcggtgatgccgatctttaccttccatatatcagggcgagcgagcgatcgacccgccacccggcgccacctcaccgtcgccgaccactactgacaccccggcccaccccgccactacgccgaaagacgcacaccacctcgcccgctagtgctcgccgtcgcgctcatctcgacgtacccccaacccgaccccaccccatgcatctcacggtcacggacggctgcctgctcgatcaaccgcgcgcgtgactgcgtgagggagagaatctattgtacggctcggcgcgcgctgcaatcgatcgatcggcagcgcgcgcgtcacgccgcacccacggcgaaatccgcgtaacaatcgcgtcgcgtacgtcgcgtagcgcggttgatttgccggacgaggtgagcacacacgactacacgagccgcgcggcgggcgcactcgcgcacggttgggtgggtgttggtcgttcgatcggtcgccccgcgccttttgatccgcgggatctttttctcgaccgatccgatactcgccccgtcggcagcttttgacggatctttggaggcgagacgcgacgtcggctacgtgggactgggatatttggctggctggctagcttctggcgcactacgcgctcgtgcacatctcgtcgcttgtttatattaaactgaaatgtatcatgcatcgcttttgagcgtgatacaatcacactaaataagcttcttttaataaaaagaacaatcacactaaataatttggggcccttttgctgcaggcagcgggtggggagatcgatcggcctcacgttcctttggtgtgggcgatctgggtctatcatcctgggattgtatataatactaaaaatcttctctgcaaagcaggggacacagtggcacactaaccatatgtacgccacacggtttctttgatctcctttttcactggagttttggcgaggtggaaagtaaagaggactcgaaccttgaatgtttgaactttgaagggactgcttaccggatggacgtgtggcgatgtattttttaactgaaagaaatttggcaaaatcacctgcgcgcattatagtgcaccagtaaaatcgacagatgcctgattcctaagactcggacctaaaggtgcttttgtgttacgcatcgcatccatctataacaggtaacccccaccatttccacgactcccttaaaaagctccatcagctgcttgacacatgacgaactatatcgaactaggattcttttggtggtaattattgttctcctggtggcctttttaagtttaatcctagtaactgacagcggggatggtcatgagggatggcaattcaacatcaatgtcacgaaatgtgatagtagtgcgagctaaagtaactaggttcttatcacctgttgcgacaaatttgtcatgtgataaaacgattagatttggatgatcacagcgactttttgtgctggatacaatgcactagtgacttgcatcatcgatccttatgggtttcaaaagttagcagatatacgtaaaagaaagcaggcaactttttcccctcaagaaaacatggatgatggatatcgatggccagttacgtaccttagattattattcacgaaagacttgattgaactcccgtgaagcggtgaatgcaacaatcagaacgatatgcggtgaagacttgattctctttgcggcccagatgggtggtgacagcccattaagcctgaaatttttgagctgttttcattaagtacttctctcaaaaaaaaatattaagcgctcctaattaacaatgcaatacactggaacagcattacagactctgttttgcagttcagtaggagaaatgtttctccttgttgcttagtaagagcttaagctgtgcaatattgctacagtaatgagtttaatgggcttcagatgttaacactcttcaagacctgggctctggtgtggtggtggtgtgaccaagaacagtcgagtaatatggaagtttgactgcatgaaattttgcaaaaaagtacagcacctagaattcctgaaccaactgcatagacatgtcaagtagaaatgtgaatcaggacctttcaggaacactcgcttagtttgcaagtaatccatgaagtcccagccctagcctccaccattgcaccatcatgcatgaatacatgataaaaacggtgaaactgggaagctgctactcggattgatcgtcgtgtctgtttcgtgatcactgttttttttttcctttctcctggacgtgatttacctcgttcctagtcgatgcaagttgatttccactccgtgtttccgtcgcgtggttctagagaacaagtgtggagtaagaaacactcattgtcttctttggttttatcagtttgggaatgggagcgtgtagcatgacttatgttagacatgtacagatgtactaactctggtttaagtcttggaatatagtcaaaagactagaagaaaacaagcgacaaaactggagcttcaccagtttaaatattccaagctgaagaaggcttaaacgaccagaggttaatttggtgtcatcatccaacaaagtcaacttggtctacagattacaagcacatttttacctatccatttataacatagactttcaccaagggtgtcagggctccaagaaatgccacctgcatccagctctgcagcgccaatctcagcatttcttgctcgataacaattggatataaatgcttattcttcactcatactgctactactatttattggcgccctacgctgtagctgttttgaaactgtccctatacctttcgagggcagagtgctttcccataccacacgtgcacgggggcaaaagccgatgtgccacgctcggcgtaccacgcggttaagcgcgtgtgtaaacacgcacaaacacggcctaagcacatcgattagccgcgcaaaagtacaagggaattaaatttggagtctgcaccctggaaacatgggatcctggatactaacaaacttattacatggccacgcattgcaaggggcatgagaaggaggataacttgaaccggaagggtttgactcagctcacccgagtaggggctagctactgtactacacttgctagtagtaacatcaaacggaggccgcacgagtgggttggcattgggcacagcaagatcgaggtcaagcaagcaagagacaaggaactagccatacctgtcgaggagagaggcagatacgcctggctcaccaggtcagtcaccagctcgaacgaccattccaggacaccatgctacaaagggcagacaactgaagcaataagcattagtaatgtatctacatatgttaacactccaccgtaaaaagtctgtaaaacaagagtgcatgtcacctgcttagcacacaataatttaaaaggtactccctccatacttgtaaagaaaatcgtttaaaacaatgtttaagtcaaactttgggaatagaaatcataaataactcttaagttgttaagtttgaaaatgtaaaaattatataaatagatttgtcttgaaaaatactttcataaaagtatacatatttttatagaaacgagaagtcaaagttgtgttttggagatcgtgtcgctatccaaaacgactttctttacgagtacggagggagtattagcacaaaaacacatctatttgcaagatttttaccgctagttatttgtaacaagatcatactaatgcaggaaggaatactcgtagaaatagaactggtatgaacacttcagatctgaatagaaaactgcataggttttccacggaccgactttaggcatttgaactcagaggtttgaccctaattacccctctataaaccccctacaagtgacctcttccctcatttaattctaagcttcttacactgttgggtgcttggacgacagggaaggaaaacttgggcccatgggattttgggttgcataattttcctaatttaatttcctgatgcaagggacaaatgagagggctgcacttggatccatgcaggattttcgcatca

SEQ ID NO: 37824 - DNA, 1895 bp, Oryza sativa
cggcatcattatgtacttcctcttcatgcatagccagggggggaggttgtagatacacatcgtaacgagccaagtgctatggccgctgctcatctctccaaaaggattcatgccatccgtactcaaaccaaaccgtatgtttcgtgcgtcctttccaaattctttaaattttctgtcgatgtttcgccattgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcaaactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacagtgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaactattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtccccccctatatatatgtcttcttcctcctccagctgcccgagcaagcttcaaaattttttcaaaaaagaggggaggtcatgccaaaatttctattgaatttattttggtgattacatacaaatcggaggggcctaaaaggtttgcaacttcatcctccaaagtggtttttggcatactacatttgcacctatgttttgcacac

SEQ ID NO: 37825 - DNA, 10722 bp, Oryza sativa
cggttggtaacacaaaccgggactaaagatcaaatatgcccgttacccttttgaaccgggactaaagattatctttagccccggtttttattgcatccgggactattgtggaaatcggccgaccgacgaaagatggtttctccaccagtgagacattggcctgaaacatgaacctacctgcatttaaacgttggcacggagaacaatcatatagcatggacaacactgggtcgcgcgcagtgtgcctcccaaatataaaacggttttaattagaaatatagtaaaaaaaatgtcattcagagtaaggtaagcatgccaccgcccccgccgacggcgtcggcgctccagccaacgccgcccacgcgcatccttctccgccggcctgcccccgtctccgcagcatcgtggccctcgcccacggcgcgtcgcacccccagtgccccgtcgccgttcccagcaccggccccgccatcgcctccgacgtccctgcttccgtcgccgccgccgcggctgctggccgggggtggccgcaccagcgcaagatccatctcggtggtcctggagacgctagatccgtcgcacaccggcctgcgtcgctcgttcgcagaagttgtcagaggagcggcatcacatttttcaaattcaaaacaggttgtttgggcgcgttcctcagctagctccggcttaaactcgccatttacttctcccgtccggaacaaccaccgctccactcgccgggtcacttcaccacggagagccgccccctacgatgctagcctacctcaacgtcgcatcgccgagcaggatgatgggcatggactgcaagatcctggctggatccgggtgcagcggaggagctcgcggagacgcgaggcgcattcaagcggcgtctgcctaccacaacgctcacctcaatcaagcaatgcgcttcggccgtcttcaagttgacgggacgctgtacggccaagccgagactacctctccgcctcacatcgagagttcttggctcagaccagtggaaggtgtttcatttgcctctctcgtggacaccgagcagcccagtgcaggacccaatctgctgcttcctctgtcagcgctccggtcaccgcgtgcgcgactgtcgtcgccgcggctcggcgggtcgtgcgcgctcgtcggctcgtcttcgcgacgtgtcccgtacgctccactcatactacggggctcgcactcgcacgccgccaccaccgctgcttcgccaccaccttgccgacacgcgcccgccgcctctgcttcgtcgccgctccggcttacctcacacctccgctcgacgcgagcgttcgccagtcctctcaccctgcaagcgcgcctcccccacagctcagccagcgctcctgtcacgcccggaaattcactaataatttccgaactaatttgtgcataaaatcctcatccaggaatcagccgaggtacacaaactgacaatttaatatacaaatccatcataataataacgttacatacttacaaaagaaaagaaaaacagcaggcacggctattcgaatagttttactctggccagaggtgtaccactgtacccacaagacacagcctcaacatcatgtctaccatgcgtcgtgatactggaaagtacccgaatagaggctgtgacaatacactctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattagccatcgtgagctaccattaaatataaccataaataataatgtagtatatatgattcatcccattagtgagctaatgtttctaagcattgcaaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgctctcacaaaccttcgaaacgacggaaacgacaagctaacacgcaaaacaaggaaaacactaagaaactccaaataaacaataaatataaagtaaaaaaacatgtagatcataattttagatgtattatgagacttgaacggcctcattctgacttcatatgaatttattacgaattttacaagatttaatctaattaaagcctatttaaaaagaattaaataaatttaattctatttatggataattttaatatgtagatctttattttatacaactttagagacttgaaccaactaaacccgagctaagatgaattagttatgaatttttaaagattaaaccggattaaaacatttatatggattttaattgaattatgacgcaataaagaattatttttgaaaaggaaaagaggattattgcgtcagcgggctcggctcacggtggaccgggtgcacagcggcggtctacggaacggacggccgagatctaccctatccaaaacgaacggccaagatcaacttgatctaccgcggttcacgggacatggcgacgatgacgtcagcggtgacgtcatcaccggcggcgactcgggagcacgtgctcgacggcgaacggcggcgagacggcgcaaacggagggtaccaacgggtagagctcgactcggcgaactcaccagtggcttggacggtggcggacgacgacggatgacgacggcggcgaggctgaggcggcgacggccttcgggtcggcggtgacggcggtgcttcggtgggaaacgtcggcaacagagaggtggacaagatgctgctcctcctcgcgatcccgatggtggcgacggtgaccgaagacaacggctgcaacagcggcacggcacggctggaccgacggcggcggtggagagcttcggggcgacggagtcagcggcgctccgacggtcttcggcggcggcgaagcggtggacggaaacagcgacgacctcacgatgctgatgaaggagacagcgatcgacggcgatgaccgaagcgacgacggcgaccgactagacacccgccggcggcggcgacgcagagagcaacgcggaggcggcgctagagaaggcgacaagctagggcgaaggtggcggcggaaagaggaggtcccggggatgcttataaaggggctagcgagcggtgacggaggcccacggcgatcggcggcgagatggaaagcaagggttggagggagaaaagtcgatccgaatcgagctcaaatccgtcggtttccaaacgaaattagccgaagtttctaaaagagaaggaagaggagatcgaggagattatttcccctcaaatgatttggctggagaaggaatggggcggccggatttggaaggagacggtggcgcggctcggctagggttcggccgggcgacggcgcgaggttgacgacgggtccgacaggtgggctccacctgtcagcggaagggagcgcgcgcgcagacggctgctggctgactgggccgactgggccggggagagagagaggaaggttttgggccgactttcggcccaaagccaaaagaggggtttaaaaacatttttctatttaaattattcatgaaatggaattccatttattaaaaatactttcttggctcaaataaatcccagaaaaatctaggaactaaagattcaagagaagtatttaacaaaattttatctagccaaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatagttaatcatggagaatttaataaaaattaaatccatccaagctttatatttaggaaattttatttcccacatttaacttcacttgtaaattaatgaacatttaatataaattctattaataatttattagataatttctaaatcctaaaacgaaaatcaggctgtgacagtttcccaagcaagaacgcacccggctgccgccgccaccgccccggtcgacccagagcaagatgtcgcagctcggtgacccggccacgcgccccgaggaggacacgtgcttcatccccacctcttacgccattgacgaggagctgcgcgagtggagcgagactgcggctgtctcctgggcggcccacgcgccgtcgaccactacaccgcgcgacgtcgagcaggccttcctagatgagttccagcttcgtcggggcgaggtggctgtctcgctctaccatccacaggccttcctcatcaagttccaacatcgtcgccattgtgaggaggccctggtcaaagggtacgtcaagcgtcgcggcatcgagattcatttcatcaagtggcgcagcctgcagagtgcgctcggcgtcgcgcttatgttccgcgttcggctgtgcctcgacggcgtccccatgcacgcctgggctgccgacatcgccgagcggatcatcggccgcacctgcgcactggagcagatcgagaccgacgttgtccatccggtggagtccggcaacacgcgctccatcgacctctgggcgtggacggcgaaccccagcaccatcccgaagaggatgtggctcagcttcaccaacagggcgaaagatcccaagctggcacccctgctcgcggtggaaagcccgccggagcactggcagagaggggtgcgccatccggtcctcttccatctggaagaaatccacgactacacagcggcaacaattgacctggaggagcaaggtagcttccagccgaccaagcgtcggctgccgccttggagcctgggagtgctcgacggcgagcaggtcccaggacgggtgttcgaggattttccgcatcacccaccgccgccccgctcggttcacgaccgtctcggcggcactgagcgggaagtcgatcgccacgaggacgatcgccgcgatcaccacgacgaccgccggtccggccgcggcaccagggacggccacactcgccgtgggcgcgcggcgcggggcgggcgccctcgcgacgacgacgaccgtgatgactttgatgacgaccaggacgaagatcgtgaggaacgtgaccgggacgatgaccgcggtcgaggcgacgatcgcaaggaccgtgaccggggcgggcgaggcaggcgacgggggtccagcaacgaccacccgcgaccctggcgccgcattgatcgggacgatgatcgcgacaaccgagactgcgatcttggccacgactgtggcgagcagcgggcaagcgacaatgactaccgccgcgagcgcacgcgctccctgcggcggcgggacaggggggctctagccgctacggcggcggtagacggagaccggctgacactatctacgactcgagcaagcagctctcctcgacggacgcctttgctctgcacggcagtgcgctccaagcagaggtaggtgagttccacttattgcacgccctgcacaattcccccttctcgctgcaggagccccaattgccatcgtcagtggaccagctacaacggctctccttcatcgcgaacaaggctctggcggggatgccgccactcccggagcacgctctcccggcggacccaaggaatgaagcctggttcagcatgcagcctggaagccgatcccggtggagagcgtcttcgcgcgcatcaagtcgaacctgccaccgccgactgcggcgaccacatgccaacaagttgaagaagcgctgttgcggctcgagctggcggcgacggcagcgatagactgcccagtgggggacgtgtcgcctttgcaggccgcctcaccgccacctcatgcttcgccgactctgcttcctctcgaaagccaagtcagcctcatgcacgatctgagggaggtggtggcggaagggggcaacaaggatggcaatggcagccatctggcgccgctcccacatactccgtcccccatccagtcttctcaggtggcggtcccggcatcgccgaactcaacgggcatcctcgatgcctgtttgcatcaccgccgcgagcaatcctcgcctcgccaccagcgtcgccgccaagatcaccgtgcgtgcatccgatccagctaacacggcggctcaagatccagccaaggaaatgcggtcaggccacccggcgcaacaaacgcattgccaagcagacttcaaggccgacgatggagcggtgccagcgagttctcttcaagaggctcgggatcctcaacgacgaaggcggcacatcgatcgagcaggtccttgcccaatacatcgccatgttcaatgggctgctgccaccccacatcatcgccgccctcactgcgatatttggcatcgacgacgacgagcaggacgccatggacgcggcactgatatctctggtaggtgaaggagttgcggaagtggccgatgaggtagagaagaacgccgcctaatgtgtcctggtattgaccggacctggaatgggagccttcctttctccatgtatcgtcgtcttttgttgggtggatggagtgctggtggcctgcgagctatcctctccgtgtcaatcccctctgtgtcaagctggatcgccggcggcctcgcaagaacctcttcatttatgttgtcaagaacctcgtttatttcccctgcagtgtggcgtcttctgtgaacatcttgtctacgcatcgtctttacctgcatcggcgctagcttcggcggacttcaccgccaaattttcggccgcacattacgtcgaacaccttcgggccactgtgaacctgtcgaaccagtccagccgcttcctgggcctctccagcgaaccaggccagacacgatgtgggccgcctaatgggcctctctccgatcgtcaagccacccccctccgcttgtttctccctgaaccggccgatgggcctcaggccgccccctccttagcatttcccgggcctctatgtgccctcctgcgcaggcccagcggctgggatggccatggccagcgcctgctgactgtttgggccgccgcccctacacaagaccaagcagcccacccccttcgtgggccacgaatacggagaacaattttactaaaatgatgcaaatcctagatattatttcctagaacgtgagggagctcaattcggctgcgcgctgtaacacgatccatgagcttatggcagacacgaagtgcagcttggcatgcttccaagagacaaagctacagaatatagacgatggtctcgcccgctttttaggaggctacaaactcgacaaatttgcctttaagccggcaagaggcacgagaggggggatcctcctcttatggaatagcgcagtctttgacgtccaagaggtccgagtcagtcgcttctcgatttctgcgcaagtgacggtcatactcacaggggccacatttctgctcaccggagtttatgggcccacaaggcaccacctcaaaagcgccttccttcggcacataagaagaataaggcccggccccgaggacggatggcttatccttggagattttaacatgatctatcgagcaagggacaaaaacaacagcaacatcaaccttgcacgcattaaacgctttcgctcaaccatcgatcgatgtgaactgcatgagattcccttgcaaaataggaagttcacctggagcaacgaacgacgaagggctacacttgtcaagttagatcgctacttttgcaacgagacttgggacttggccttccctaaccatgtccttcacgccctacccacagggccttctgaccactgccctctagtcctctccgacccccaatgtccacgtaggccgagagccttcaagtttgagaacttctggacaagaattccaggattcaaagacaaggtcaaggatgcctggtgtcagccttcgtcacacacagagcctatgcaccgcctaaatgaaaagcttcatcgcaccgcgacctgtcttagagaatgggcaaaaggaatctacaccgaggccaaactgcagtttcacatggcgctcgacgtcattaaaagactagatgtggcacaagaacatagagacctctctgcccaggaaacaagactaagagcagccctcaagcgtaagatccttggcctcgcttccattgagcgggcaaggaaaaagcaggcctccagagtaacacatatctgtgagggagatgcgaacacaaagttttttcatctcaaaatgaatgcgcgaagaagaaagaacaccattcatcggctgaaaaaagacaatggttgcgctgtgacacataaggagaaggaagcacgatccatgaccattttgcgagcataatgggacggccggcgccaagaccaaataagttaaattgggatgcccttgacatctcaccgattgacctagccaccctaggggagcccttctctgaacaggaagtacatcaagcaatcaagaaaatgccaagtgacaaagctccagggccagacggcttcaccgggattttctttaaagtctgctgggaaatcataaaggaggacgtctttctggtcttcaactccatttacaatctcagatgtgcacacctgaatctgatcaactctgcgaacatcgtcctaattccaaaaaaagagggggccgagggcgtttcagacttcaggccaatcagcctaatccatagtatcgctaagatcttctccaagatgcttgcattgcgactaaggcctcatatgcacagcttgatttcgatcaaccaaagtgccttcataaaagggagaagcatacatgacaacttcctcttcgtgagaaacatgactagaagataccatcgattgaggcgggcgatgctgctattcaagttagacataactaaggcctttgattcagttcgctgggattacctgctagccttgctgcagcgaaggggtttcccaacaaagtggatagattggttgggggctctgctatcaacttccacctcccaagtacttctcaacggcttgccagggcagcggatcaagcacggaagaggccttaggcaggggaaccccctatcgccactccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgacggcgtccctgtggtgagggcaagtttccccatcaagtacttgggcctccccctagctctgggaagactgcggaaggtggacttgcaacctgtctttaacaaaatttccggaagggtagcaagctggagaggaaaaaacatggcagcggctggaagaactacgctcgtcaaatctgtgctaacggcgcaaccaatctaccttctgaccgctctgaaaatcacaaaggaatccctcgagcagctagacaagcagcgacgccacttcctctgggcaggcacgggtgatattaccagagggaaatgcaaggtcaattggacaaagacgtgcatgccaaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataggggacagaaacacggtgcgattttgggagtccgcgtggattggtgggcgaagacccaaagacctcatgccgcttgtctatgcgatctcaaaaaacagaggaaaatcccttcggcaaggaaaggaggaggacgcctgagtgcaagatttgaagcttgattcacaatcatctatcacagtcgacctcgtcgaacagctagtcgcactgtgggaagcggtccgaaatgtgcacttagacgttggagaacaggatcagattaattggaagttcacaaacaatgggcattacacggcctccttggcttaccatgcgcagtgctgcggggcgccgagtacaatcttcaattccttgatttggaaagtgtcacaccccaatctgataccgccgtacaacggcacctgacaggagcgtgtcgtagggaaacggtgcgaaccgcttcctacgaaaccgg

SEQ ID NO: 37826 - DNA, 5869 bp, Oryza sativa
caacggaccaacacccaacaccacaggcgacggctgggaaccaggacgaaaccctaatctcacttcactttatcttctcttcagggcggaggaactatatataaatatttatatagagcaagggtgagtactttcgtactcagcaagtcacgggaacttaggtgtttaatgcaagcttgaaagagaggcaaggttgttttgcaaatcttttgtttgaaatcattttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcaaagcaatccgcctccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcatatccgcccatgaccgtgggcacggctgttcgaacagttagttaacctctgcagaggggtacactttacccacaagatacgaacttattccgaacacccgtcggtatcggaggttcgcaacaaagcttttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaatggtgtttgtgggatatttggtatacgcgctcaaagagcacgaataccgaggtaccacaagggtggagcgacaaggaatcagggtattacgacctacgaaaattagtgcgactactgggtaggtccgtcggtttggcacgcaaaccgaggccaagcaagttaagtgtgtgattctactaatgcatgttgcaaacaaaataataatgactttgcaattataggggcaattggtcaaagggtgacttgccttgctcaaggtcttcacgaagcttcacgaatcttcgagaaaacccgcgatcgacgaaaatccggtaaccgcaactatacacaaacaatcgaaaacctaaacaaaagaccaagaaaaggatcctatttagactaaataatagtgccattaaatagatctcgattttacgggaatactggaagtggaacggggtcaatcggaattacggatcgggagatatgaattttggaagtttaattggagtttctagaataggagaaatggtttatggaatttatagaaataatattctcaagaatattattgacagtcacggacgtgcgggaccaagggaaatgattcatggaaattttggaataaggaattgatttatgggacaaaggaaaaaaggatttattaaatccctgaaaaaaagaaaggatggagggatgttaattggacttgggccgaacgaaggggcgcggcccgaagagatgcgcgggcgcggccgaggcgagcgggccggcgcacgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcagtggaccgggagacctttgaccggtctccgcggggccgggcggctgaggtggcatccacgtggatgccacgtcggatggggaagggagaggaggccgggcacgctgatccgatggccggcgatgagcgacgtgaaccggcgaacggcggcgaggtggattggggggttagcaccagaagagagaggaggccaagggggatcgattcaacggagcggattagccgggggaaaaacgacagcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggctcacgcacggcggcgttaggcggcggcggaagcggtgacacggcgcggagacaagggagaaggccgacggccttggggcagccagggggaggtcaaggggatccccgggagcatggcggcgagaggaatcgacgcgagaggagccgacgacggtggattgcggcggcggcaatcaccggagatcaaaaggggaaaacacgacgagacgatgagggttcgattcaaaggggtgggagcatctccggggttcaaggaatccgtttccggcgtcggattggacggagcggcaccgagattggctggcgatgagaggcggcctccgggacagagcaagagcttgtggcaagctatgccgaggggcggcgggcgcggcgcatcgtgcggcaggaggaggatcatggtagggagctcaccaacgaagaggaggcagcgttggcggcgcggtcggtgtcgcggcgaggtggtcgcgacgccgaggcggcacggcaccgagagggcgcggccggggaagaagggagggagaggtggtgcccggagctcctcgtcacgcgtccacgcacgcaccggctcctccggtgctcggcaacggacggcaacggcgagagcgggacaagcagcaacaaggcggcgacggtggttcggcggcaatggcgcggtgggtgtgaggactgaggcgagtgaaaacgagagaggaggggtttggggtggcttggttttatagtggaggaatgtcggtttgggagggggaaccgacatagagcggtcgagcgctcggctggcggtcacaggcgatgcaagagcggcggatgccgaggatgcaaggagcggcgaaggcgatggatcgggcggctgaaatcgaaccgctggagcgcaggctggcgcggtcaaggtgggggcggcgagctggcggtcgcgcccgtggcccaggcggtggcaggcggtgacaccgatggtggtcgggcaaaaggaaaaaggaagagggaaaggagggcttgacccttgccgaaacgggaaaaggaggagggagaggggtgtgagacagggggaggagagggagagcagctgcttctcctactcttggatgggtgcggcgtggagtggcggagcggcagcgcacgacgcaggcgacgccagggcttaacgcggcggcaaccgggcggctgcgcggcgcaggcgcggcagggctgacggcggcaacgaccggccggtcggccacgcgcgagcgcgggagagagtgaaggcggtggcgggttttgggcggcgacggcgggaagcggcgtcggcgcgagagagagaaagagaacgagagagcgagagaacgcccgagagagggaagggagagagagacagcgctctctctctctctctcggtggtcacgtgcggcgcacgtggagatggagagagctgagaagagatgggccagcggcaggtttcggcccaaatcatcacgagggaggtaaagtagacttttactgagaaagctgatttggatagaattggagagatttagggtttggattcgaattcaaatttgatattcgaactcgagggtttagggatgtatcaaggggaattcaaggagaagtcatgggaaagattcaaaaggaatacttgggtatttgttctcgggaacatagggtggagtcaaggaaggaaacaaaacgggggtttggacattttgggatttagaaatgtatttggcgaggattcaaaggaagggattgactttcggatttagatttcggagacttgaattggaagaggaaatttgaggcggaggattttgatttcgatgagagggaacaacgggatttgatatgagatctcggcacgacttagactcgcacacaaagaacgaaaattttcgcaattaggattttgccgaattagtttttaacgactcgcgaaaggcggagcgttacagaaagcctgggcgccagggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacatcaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggctgcgtgagttaatcccgcactctgtatagtgtacagctatagtggctctcagttttccttttacccctaggggtttgtattttctcctgctctattcaatgaaaaggcactctagtgctgctttccgttaaaaaaaattagaaatatagtgtcgcgagcagtatatagttataccactgctatcttgtgttgttgtggcgtgtgtccctactggctccaaggctggcccgttgatgactgatgtcgtgcgtgccatgcaccagctcgatcgtgtcgtccgtgcatgcatgcgggctaaccacaaaggggaacagcaaacctgcggcacggacacgcacataaagcagatcacgaggagcaatacggataggccactcctgatcaccttgtctttgattgagagagaaagaaaagggcgcttagatcgatcgatcgatcagacggctggggtttggatttgtgggctgcaaattgcgatccgagagaggggccggccagccaggcttgcgctgctgctaataccagggaggcaaaacgggcagaggtcgacggtgacatctgcacgcaggcatgcatgcagatgtagtagtagaggcctctgcttcctctgctgcctgtggctcatgtggtgtttggttggagaaactaaagtggggctaaaatttagtctctctcacaaaaatatatagggacttatgttttttagaaagcccctctctcccaaacaccctctcaatgatctttgctttgccatttgctctgtgcctctgcaggcctctcttctctgtgagctgtgtgtagactacggtttatctgtgagctgtgtgtagactacggtctacggctcgaccgggtaaaaaatttacagtaagtttggttagctagttcacgggtccccggccggtgggccccataggtatatacctctctgcagccgtacgttggcagcagcatgcagcgcatatggaatagcagcagttaacatatccacaacgccacct

SEQ ID NO: 37827 - DNA, 13291 bp, Oryza sativa
tgattgtaagatcaaatcagctggcacccccttgacacactcgaggctagccttggacctgcactggagttaagcaaatcttccaggccgtcatgtttcaacacgcttttagcacgcctagtgggacactcgaggctagccttagacctacactggagttaagaagatctctcaggccgccgtgtttttacatcaacaagatgatagctcgcttgttatttatttctacactttcgcactctctcttactttgtcctgtggtttgcggtgtgtttgttgtgttgcgttcacctttgcagagttggctgatggacgatgctccacttcatgcatccctaggaaatagtaggaggagcagacggatgttagggagaccacggcttcggcaatgacttttgtggaggtcgttcactatagtcgaggagtcctcgacggatgctacgcctttaggtcatgtgattcttgagttgggggggtgctctgtcgctggtgcagctgacacaatggaattaattggtcgggagggaacgactggatctaaaggtcgtgttgtggcatgctaggcctccaccgctgcacccatttttctctttcattttacaacaacaaaaaaaaattgcccaatcattttatgtaacctgacaacttgtaaaagttgatgatttatataggccttttgttagatgtaggcacttgaactgtaagtggaaatcaaggaatttatacaactagtgatttatttagaggtttgttaacagtattatgtaatttactctctatgaagacatgtgagggtgcctattagacgcagttacgctagggagacgaaacatgatattttataataaaaataaaataataggggttgaaagttttagatttggagatgtaagtttcaaaagtttaggtagagattttaaatgctgagttgaaagtgttagatttgaggtggaagttttaaattttgatttaaagttttgaaatttggttaatattttttaagaaaaattgagctcgttgttttattcagactcttattttttttcaaatttaattttcgttaaaaaaaatcacgtatgctatatagaggctggcgttttcagcgttcagtgcacatccctacatgactcggaatcacgtaccacacttatcgcgtccacttgcaaccccgccccctcccaaatgatattattcctagatgaaaacctatgtcatgttctttgttgattaaatcatggtaacttcaatacgtaagtgtatcattttctttatggccgttatttttggagaatctcaatacaaaatagtccatgtcattctaaaatataacaatgttttcatctacatttattttctcaaccaattatattttttcactatttaaattccctagctacctacattatcttctcaatcaattacaagattttcttatttaatttcctcaactttcttaattcatgtcgaaccttctaaactttttttatattttgggaaaggaggcaatacgatgggaatgggaaagaaaccttccgatcgaaaatcaacagctagctacctagcgctagctgtacgtgcaactgtagtaaaggaagaggaaacagcagctgcagaattgcagatgctaatggccgggcgtgcaggcaaaggacatcgcgagaataaacagcgagtactatactcctaccgagaagcaatagtaaagccagcaaaatatgcgcgccatcgctatcatccgtcgcctagcttttgcgggctcgcgcgccggtagctacgcagttgcccttcaatggttagccgccggcagaggccggatggacgaagggccggcggcgctcgcggccagtattgatcatcgtgatatcgaatccggctgatctctgcatgtatgcgtgtattgagggcttgtttgtttcgttgccaccacgttaaccctgtcaaatattggtaatgtaacaaattaaatgtgtacttaggaatgctattaaacaaaactttgatattgaagaaattttcactcttgatttttttctaaattttagtaaaactgtaaactgaacacatctaataaaagtgggtaatctaataatgtggtggttatgttgggaagtacctacttcatctatcctaatatatatagcaacctagaatgagatgagacacctagaatgagatgagactcattctagaactataaatttcgacatcgtttctgctaggctgctagctagttgtcgacaggtttttcaggactgaaaacattcaatttgtttggccgtcgatcccgcgctaagatttgtgctgagatattttgctattggatttgaactctcttttcataagctagtgacactagccagtcccaccatcgcatatttataacagatttgttcaagttacatcctagttgcatgtagttaaactatagttacactatagttacataactacattgttatctctatataaattagatataaagttgcatatattattttaatacatatatacaagttattattattgttatagtcaagttattattattgttatagtgtagttttagtgaaattatatactatagttaaatttgaaagttttttttttaaaaaaaacttgtgatagttttttttaaggtaatctctttggacacgcccaatatttagatttatagctttaggatgagtctcgttcgatctaagattactatatactggaaggaagggaagggagtacaaaataatgaacaagccctaaaggcacccgcggaaaggcgataatactagcatatgtacgtgctccggtcgatcttaaaaacgctcaattaatgcattaagatggtcaggtcgataattaaagactgagactctgagaatagcgcaggcacacgatcactcgtatgcagttgttcgcacttgcgaaatctctgacgtggttatcattatgcatcccaattattggcatatctctcgtgggagttgcggtattgcaaatttgcactagttatgtactactactactacacttttagatactccagagtactagtcgtgtgtgtcagacatggagcggtagcgctgcaatggcaaacatgcgatgttgggcgagttaaatggaggcactgcacaggccatagatgggggtgatacgatcggcagagctagctgcatgcatgtctagctagctctagctggatagtatcatctcgtcagagcgctggctgacagtgcaaattaatatacagatcgatcgacttcatcgccgtaacggctgcagggcaggtacgtaccacgtacgtcgtcattaaggttgtattcaaattaatttgtagatatatccatgcatgcatgcgcaggcagaaagcgtactaactatagtaatcccggatcccgatctatacagtatatgctaatatgcagtgatcgatctatatatatactcctacatttgcacgcagctgtttaaattagccagaagatgtcgcagcatgcagtggcaataattcgtagtttcgtactagtgttgctagctctctgcatgcacatatgcaaacagcaagcggtggcgcgcggggtacgtacgctgctctttacaggccaaaaggggtaggccgccttttggagctaagcagcgagctagctaccgatccgcgtcggatgaacagtgaggcagtacgcgcccccgccaccgcggaccgcgcgcgcgcgtcgcgtctcgtctcgtctcgtctcatggatcgatctgtctgcgtgcgtgtgtgccccagatcgatggttcgatcgcatcatatcggtccagctaactgatcgatcgaggacttgtgcatgcgcgcgaaatttaattaagctatggaccgatgcatctatggcgctagctcgctcgctggctctgtggctaaggcgactgtggctccgtcacgtgaaggcttgtgccgatcgattcggtgcagtatggtatggtctcatttggccttgtgggtgtgtgaatgtgatcgaccagagcggcagaaagtaacagggtcttcttacaaccgttggcaaagcagtggatcgatcgatgatgttcaacgctggtaagaatgttgggccatacgagctgtggttggccttacgttttgggccgaaaacccaatcttgtagccggccggtcccttaaaattcgctcaagacagaaaaaaaaggaaaagtatcagagccaggtttcgatcctgggacctgtgggttatgggcccaccacgcttccgctgcgccactctgatttggtgattggattaagaataaatatataaataatacttggtctcttatgtctacaactccaaaggaggcctagagtctagagatgctgtgaactgatgagtaatcgtgcggacaaggcagcagattgggcagggaccatcgacttgtgagaaatcagcaatcactaagtcggaattttatacggttttacataaaaaacctttctacatgtgcaatcatgctactagccacacaataatcgagcttacctaatccttctttcttaccggtacttttagtacctaatccttatcatgggaaatgccgtgctgtacctctgcaagctgcaacagcgagacaagattctccggaaaagctcaaaaagaaaaatatgcaagaatcatgtcgagagaaacgattctacatccctttcctggtgtttggataaggtggatgtgataatgtgaggcttttgttttaaaagctacttcctccaccctaaagaaaatacaattatagcattcaaaagataataaatcagcagggtaaaaataatctatatgtccctcataaatgagggtgattgatagcgggactgcgggagggttgttaggtacgatgaacaaaaatgaatgaaaggtagttagagggaatttttttttagaattgcattttttttaaaaaaataaagtttcaatgctagaatcgcgttattatggcaaaagtgcagctttatacttatttttccaatttttagaattattttatgaagaaaaaaaattagaatccacaacctataactttatatttgttaattccgaatttctgaatataactaacaggataagaaagtaatgaaaaatgtaagtagattctatacatagttttatagttattaattaattacaagcactacacgaaggaagatatcataccaactacaaatatcagcgaaaatttggtactttcaatagtattatagtattatgcttatctgtagagtgttagcctcaaattcaacccgtatcaagaaaaaaaaaactttgatagttttatgagtataaacatgtcatattttttatatatagatataatattattgaaaatatatgggacaatttcatttttcccccactttgacctctaatattgattttgcctactctttagagttttcgtttttacctccacttttttaaccgaaagaggcgtttacccctggtttggatggaagttagtgggaccaggtttatggcaataaaaatgagaaataaaggaaataaagattttttgaattagttatttactcttttacccctgtgaaagagttaaaactaatctctcctctcctcacctctcgctgcacatggtcaaactgagacctagccggcggcggcgagcgggtggtggcggcggcggcgaagagcatgcgtcggctaggcgcagctcctcccggcgcgagcaggaggcgagcgtgccaggcggcggggagagggcgacgcggcggtgagcggccggcggccaagcagcagcggcgagcgggccaggcgcagcccctcccgccagtggcggcggctcgacgctgggaggatgcggtggtggcaactcggctggggaggaggcgacggtgatggctcggccagggggcgacggtggcggctcaacatggggaggaggtggcggtggcgactcagcttggaaaggaggcggcggcccggctaggggtgacagcggcggtggcccactggcccggccaggaggcggagaggaggaggcggcggcggtggcccgtcgacccggccaggaggcggcgacttgtagaatatgaccttttttttttccaaattttgtccttttttttcaatatttgtctatatttatcacatttgtatatcaaattttgaaacaaattggtttacgaaaattgcaagatgcaaacagaactaatgaacaaaataggggaaaatcagcacagtgagggtaggatgtcttttcgtcaaagatttaacgccgttaacatgtccatcaaaaataggggtaaagcttaatttcgttttaaaaaaataggggccaaaacaaaaaccctaaaaaatagaggcaaaaccaatattaaacatgaaagtaggggtaagaatgaaattgccccatatatagattcaaagaaatatatatagatataatattactgaaaatatatgtatagtttttttctaagaacttttagtgacatttatcaactagtgtgaatggtgtgtgcacgtgaaaacttgtatatataggatacattcatatcatacaaatattacataataaagtagaggacttccccatacaaaatagctagttaaatattggatttgtgataatactctttgcgcatatgtccatatatgcaattatattttgtatagaatagatcgatatttgaatctaggattagatttaatgtacaaacttatgtttatatttgtgtatacaattgcatctttatacaactatattgccatcgctctatatcattatggtttggtttcatcacgatctaacggcttaatattttttattctatgtggcgaacatgatatatcatttccgagatatattgtatatttaggttgtgttcttcaatgtgttggaaattaacccttcacacacgtaaaatgaagtaatggattaccgcatgattaattaaataatagtgaaatgagcgtggctcaactggttaggttccttgtggtggaaccaactcacccaggttcaaattcaagattgacacaggtgcttgcatttacggctaattattcttttagtgataggcgacgtacctgtcgatagtgaagtgacaacccaatcttccggaagtgtttatagggggtagggtagatatgcgacatacctctgttgacagcgaggtgctagcacaatcttttagaggtgctcatagggggtagggtagatatgtcccaatcttccggaagtgcttatagggggtagggtagatatgtgacgtaactgttgataacgaggtgctattttccgaaggagcttatagagggtagggaaaattaagtaatagcttaaaaatcctggaaaatggattaatatgatttttaaagcaacttcccaattttctgtatgtgctcatagggggtaaggtagatatgtcgttcagttttccagacgtgctcttagaagggtagggtatttatttattacatatattatagtaaaaaaagtcaaagatatattttgttattcaaaacatcaaaaaatatctactattatttattggttagtgttgttaaaggggtatttggtttgtggcaacacaattattagtttgctccctgagcgaaaagcaggcaaacgccttcgtaattagagagagagaaaaaaaaaaagcaggcgacgccagcactgcagggaagaagaggaactgaagcctttctcttctgtccgccgctgcgccctccccctctctgtccacgttcccccaccccacctcggcctaaaaccttagccgccggcggagcgggacctcaccggcggcggcgatgagcgggggcgggccgccgaagaaacgcaacttcaagatcgagctgttcaagcaccgcgtggagctcgaccccaagtacgcggagcggacatggaaggtcctggagcacgccatccacgagatctacaaccacaacgccagtggcctctccttcgaggagctctacaggttggtacaaccccccgaggccccgcactcccatgatcctcccgcctcctgccgtcgccgtcgcgtttcccgcttggcgacctagatcctaccgccccggccctaacatgtggttaattagaaaatttcagtgtgccaattctaataagtttgctcctcttgagatgattaatgattatgattactagccgaacattcctgtcgcatatgttgatggttgaaagtgatttctttcgagagaattctcttttagtatttgtgatcctacaaattttcgttaaaatacagaatttttatagtcaacgatcagtattagggagattgggcggatgttaggtgttggatattgatgggttactccatctagtcatctgtagtattgacttagttgttggaagccatgcttgtcggcctctttggtcgtcacagcaacttggtgataaataactattctgaacctcacttgattgtaatttgcaatatttcctttcatctgtgcaggagtgcctacaacatggtgctccacaagtatggtgagaagctatatgatggcctggagagaactatgacatggcgcttgaaggaaatatcaaaatcaatagaggctgcacagggtggtttgtttctggaggagctgaatgccaagtggatggatcacaataaggcattgcagatgatccgagatattctaatgtacatggatcgaacatatgtcccgcaatcccgtagaacacctgttcatgagcttggtttgaatttgtggagggatcacataattcactctcccatgattcatagtcggctgcttgatacccttctggatcttattcacagggagagaatgggtgaaatgattaacagaggcctgatgaggagcataacgaaaatgttaatggatcttggtgctgctgtatatcaagatgactttgagaagccgtttttggatgttacagctagcttctacagtggagagtctcaggagttcattgagtgctgtgactgtgggaactatcttaagaagtccgagagacgtctcaatgaggaaatggaacgtgtctcacactacttggattctggcactgaggcaaagataactagtgtggttgagaaagaaatgattgccaatcacatcatagattggttcatatggaaaactcaggccttgtaaatatgcttgtagatgacaaatatgacgacttggctaggatgtacaacttattccgaagggtttttgatgggctatcgacaatcagagatgtgatgacttcatacctaagggaaacagggaagcagttagtgacagatcctgagaggttgaaagacccagtggaatttgttcagcgcttgttaaatgagaaggacaagcatgataagatcatcaacgttgcttttggcaatgacaaaactttccagaatgctctaaattcatcctttgagtacttcatcaacttaaacaacaggtcacctgaattcatatcgttgtatgttgatgataaacttcggaaaggattgaaaggagccacagaagaggatgtggaggttattctggacaaagtcatgatgctgtttcggtacctccaggagaaggatgtatttgagaagtactacaagcagcatttggcgaaaagactattgtctggcaaaactgtttctgatgatgctgagaggagtatgatagttaaactcaagacagaatgtgggtaccagttcacttccaaattagagggcatgttcactgacatgaagacctctcaggacactatgatagacttttatgccaagaagtctgaggaacttggcgatggcccaacacttgatgtccacattcttacaactggttcttggccaacacagccctgccctccctgcaaccttccaactgaaatccttgcaatatgtgataagttccggacatactaccttggaactcacagtggccggagattgacatggcaaacaaacatgggaacagctgacataaaagccacatttgggaaaggtcagaagcatgaactaaatgtatccacttatcagatgtgtgttctcatgctgtttaattctaccgatgggttaacctacaaagacatcgaacaagatactgcgatacctgcctcggatctaaagagatgccttcaatctcttgcttgtgtcaaggggaagaatgttctccgcaaggaacccatgagcaaagatatatcggaggatgacacattctacttcaacgacaagttcacaagcaagcttgttaaggtcaagattgggacagtagtggcgcaaaaggaatctgagccagagaaacaagagactcgtcaacgggttgaggaggacaggaaacctcaaattgaggctgctatcgtcaggattatgaaatccaggagggtcttggatcataacagcattgtagctgaggttaccaagcaattgcaagcccgattcatgccgaatcctgttgtcataaagaaacgcatagaatctctaattgagcgtgaattcttagagagggacaaagcagataggaagttatatcgctatcttgcatagaaggtcattatgtgattattgatgagcaaatggcttgtattcatgtaaaacggtttccatgacgtttgagttcagttttattcgttccactttgtccactgaatcatagctacttctcgtttcccgtaggcaagctggtgttcagagttttccagctaatactgatgtcatgttacgagttgctgctatcttaatataatggagatggatcgtcaaattcacagccaacatgaaatgattcccggccggctgcttcctgatcttgcatgagacagtaatcgtcacattggcagacaattatctttgccgtcgatcccaaaatctagtattgataatttcacaatgtaagtcattctattatttcccacattcatattgatgttctagattcattaacatcaatagaaatgtggaaaatgctagaacgacttatattatgaaacgaaggtagtagtatatttttatacgaatatgttttctcttgcccctgtcatgcagctggctcgctacaataacagatggtctcactctcaccccctggagtttgcactttgcagcaagtctcgcagaaaatgttgtgtgccaacttgaactgctctatgttagtcccccaatccagactccatttagtactaattatgtgccattggtgtgaatatgtattaattaattataaattatgcagagagcgcggaatgagactcatccgccaccatatatgtccggttgtccccgtttaaatacgagcgttctgcggttctcaactgtacgtgaccgaatcaaagttaacaacgtaatagtgttacctttgtctacgtatctgaatacaactttgtctcgttggttaattaattactcctagctagttataatctcgtttgcatcaggatcgtttcgagagcggcaatcgagacatggagccgccgacccaggcacaattagaagccgaggtcgagggcaactactgccgctcaggagtgcccgaagggagacgcgcgttcgcgatgaagcggcacttgtacacgtacgcccacgcgagcaacatgatcgtccagaaccgattcggcgtgtggtcgcatcgagaccaggggtacatggcgtacatcaggaggacccgctacttcaagttcgtcaagatcgggtgggggctctcgaggctgaggcgggtgtgccagcagcacggcgtgttcgcgtggtaccagtgcacgccgcggcgggaggagttggagcccgcggaggccggcgtgcggaggcttttcagccgccacacgcctgcttggatgaagaagcagaagcggctgcagagacgcgagcgagagcgagatgagcggtgtctcaacaagcagaagcggcctctcgcattgaagcagcagcagcttaaggcgcaggcgcccatgacccgtgcagtactactgtttgcttatgtatatgcatgtgtagttaaactttgttgttatttaagaagaattattcgtgcgtagcgtgtagatgttgttctatctggataaaatgaagacaatgtgtgtttctttctttgaagacaaaatggaagtgatctacatcttcgttattcagccttgacaaaccatcatattcctcttacaaaagataacctactataactttcatcgctaggtcgtcacattatcaacgcgagaatatgctcaagttctgggtttcctttttccttttctttcttttttccttctttttctccccgatccctccctttcttctttgtttggccacccgtatagattttattcctcttaatataaaagtgtacaatctttttacgtattccaaaaaaaaaaatttctataactttctaaagtcacatagattctatcccgtaactctatatgtactactacgataacttacttggctttgtttctgagactcccatctgctaggtaggctgctctgatttgatcatttgagtctcctgattcatttgaaccgctgtatatgtacgtataaaagtacgtccgcagcacgtgtggggtaatcaactcctgtccgggctgaacaaattgcgctcaactcggcataactgcataaggctatgttcgattaatcctaaagaggaagggatttattttacattgtggtgtgaaattattcccctcaaacccctctaatctccttcaagccccttcaaaccgaacaaggaagaggggaggggtaatccctttcgggcggaacaaattgtgctcaactcggttgaacaactttaaattgtgctttaaactccgcataaggaaaaaggcatgcatggtgcccaggtttagaactagtactagaaaatggagtatatgtaagaactatgaagtcgtttcagcttagcaattacagaccagagatcgacagaagcaaaaacaaacgacacatggtctatgccttaacttcctccaaaaaaaaagagagagcattatcttctgagagctcgaggaagaggctgctggtaagagccatctgtctgctgctgttgatttgggagctccccaccaaattgctgcatcgtcggcaatgcccagacgtgcactatcaaatccataaagcccccacaaatatgactctaaagaagagagcccacgatgcccctgcaagctaaacgagaaagaagaagccgacatgctctgcgtgagctgaagtggtagattgggtaaaccagtctggccagcagtagggaaccctgatcaagaatactcccttcacctggcaatgaaggaccagcagcttgggataggacatactgaacaaatgaagaactcctgagcaatgc

SEQ ID NO: 37828 - DNA, 1097 bp, Oryza sativa
cagtttagttatcgctcttcgttcacaatcctgcctattgatgtacatcttattaaccggtgattaaactattctttaaaattgttcataaaaaaataaagagatttttatggagtttcatgttgggacataaaagtgtaaatgcatggactcctatgttttgtcattacaaagtaattcaaaccacagcagcagaaattcagcaaggaaaagaaatgctttaccagaaattttattaccttaaacatattgaggtgaaaaggttttccagtgttcattctccttagcttcaggtaagtatatgcaaaactcaactgatctcgtgaggtgaaccggttaacctcattaaaccaaaggcatgaaaacagattagacattggtgtatgggcacgtacaatgaaagatccttcaggcacatctgcacaattgtgatgtaaaagatcaatactgaagaaatattcatactgggtaatttatcagatcataaggtaatgatacgaccaacttggaagaacaggctctctgccagattcattgaacttcacaagaccatcagattggtaaaagtaaaattgctcatcaatagcagtgtggttgtacttgttcagtcgcttgttttgaagcacttcctccgagacacaagtacgatcatagtgcactgaaatggcatattctgctttatttctccataagaaatactcaacgataagcattggatcagcattaaggcgcagtttactatccaaccaaatagagtacctaatgaagtacaaatcttttgttaaccaagtagaggaaacacggatcatggatatataggagattgatatgtaggaaacagttgaaagaattcacaaaaatcctaaacagcatagggagtagttaggacttaggaacttaggatgctttttatcaacttgttacatggtaagtaaacagtaactattgttgatttagaatttataacatgtcttttattatagaaatgttcaactgcaaataggacaatttagctttagccaataataaactcctcatgcacctaaacaaatcctacatcactaacaccaaacatattctccatgaaactaggcaag

SEQ ID NO: 37829 - DNA, 11971 bp, Oryza sativa
ccagtagtttctgtactgtgttgatatggacgagatgaggagtagtgacatagagaagcaagatgaagtcatgctacctggcttcaggtttcatccaacggatgaagagctcgtcagattctaccttagaaggaaaatccagcagaagtctcttcccattgagctcatcaggcagctggacatctacaagtatgatccatgggatctcccaagtaagatttgttacttccattttcattcttttttccgttctctgcacagataaataaagaactatgaagcctttctctttcaagataacactaattatatgtttcctatttttactttatgactttcatggtgcatgttccatcatgtttcctatttttactttatgactttcatggtgcatgttccatcatgctgagacttcgtatcttagtagtaatagttttttcttctttttgccaccatgttgaagtcgaactctaaactttttgcatgcatctttatttagttgtctctgaggttttgataaggaaataagaaaagtaactacctaagagttttcaacctgcctcttaagcgctactactataatgtccattcatcacgaagcccatgcagttttagggttaagcctcataaaacatttagagcaagatttgcaagtctaccaagctattaatgtcatgatgtattctgagatttggctttcagtagtgttaatgtggtataattgatttacaagtatcacagttgggctctcaagactaaaaaggcatgcggatagtaaatagattatttttcatgtgatgcatatgccttttatcagtcagaccagttagcctagctgactagctcacgttttgttttaagtcagtgttacacaatagacaccatttaacttatttctagtcatatttacttaacaaatccttttttcaccgtgaagagttagcaagtactggagagaaggaatggtatttctactgcccaagggataggaagtaccggaacagcacaaggccaaacagggtgactggagcaggtttctggaaggccactggaaccgataggccaatctactcctccgatggatcaaagtgcataggcttgaagaagtcccttgtcttctacaagggcagagcagctaaaggcgtcaaaactgactggatgatgcacgagttccggctgccatcgctcactgacccttcattgccacagaagaagccactcgagaagatcattccaccaaatgtaagcaactggcatgctgcaacatttgaaaacaaaaaacttcaaaccttaacacatatgctacaaaagtagcttaggcatagctaccaaaactggcactaaggtagatgatctgagcaatacatgtctgcccataattacaatgggaaaacttgcaatataaactgcaaaaggcctagcatatgtagtgctttccgagctaattcagtatgacaccaacaatttcatataccatttccttgtgaagataagttgaatgcactttttacctgaaaacactgccctaatcttattcttcttttttcttatcatgagcaggattcctgggcaatctgcaggattttcaagaaaaccaattccacggcacaaagagcgctctcacactcatgggtatctcctcccttgtccagcacaaatgaagcctacactgcccctgtctcgcagaccacacagagaagtcagcatacctcagataacacatcatcagtaatgaccgatgccatctcctccaccatccagttcaccggaagtagctacttgccttcaacagttccttcatgccacaacccactcagcatgattgacagcaacagcaggccagatgcatctgtacctctaccctcaccggttgcagagcatcagaccatgggtatcctctcagcaatcccacttgatattacagctgggattgacattgcatccatggttttcaatgcatcatccttcacactcccaaacatggatagaatgactgcaaacatagagtttggccaaccacagaagtgcaacagcagcagcagcatgaccaacagatgtgtggtcgacatgcctgatgttgctaacaatatcaacagcggtccacggtccatcaacttcaacctgcaaggaacactttctgatgactggagaatgaccttgccatgggaatcactcccttgcacgacagaagtctcaacaaatttccagtcaaccaagtgctatacttaggtttctagtaatgtaggtttggttttagaatgcggtagtgaagattagcatctacctctgtctgctagtattactgttagcatgaagaggtattcgaatttcgttctgttaacagtgaagctaacagaattaggaagcaatatgctactagtccacaatgtaggatgcatcatggaactaattacctccttatgcagtgcaagagtggttgtcgtccgtctcatgtgtaatcgtagctcggttccaattttgtccatagttgcatgtactgcaaaatgcgtagggtattagcaaatactcccctgatcagctgattgtcttcatttcttcgtttttcctagttctgaacattgacagttgttgcctttttggttcacataccttgcgcacataacacctcataaatcgaagaatcgatagcagacgcaacaagagggatcctcgctgcagtgatggtgaggtccccgtgcactccgcccccgtcggacttgaattctgaattagttggaatcccgtacagattgggtcacttacaaatcctcgaggtgtggatcgtgctcgcgatcgactgaagcggcgtgcggcgagccgcccgtccgtggcgaagtcccgctgggcattccgccgaacgggtggcgcgcaccgccaccaagcggcactcccccggcggcggtcgccgtcttgtggccggatattagcccgctactgttccttcacgcccaacggctggcctgccaccgccggctgcgagttcacggcgcctcgccgacatcgaaaccgcgatctccatggagccctcagccctctcgtttccgttttggcgaggcggcaggagagagagtagagagagactcatcaggactgacgtttcgtcgcttcgacagttcgacctataatcggcccggataaaaatctattcctgtccagttattagtggaccaaatgggttgacctttgtctcaaactaggcccagtttggttagaatactgggcctgtcgtgatggttgggcctaaatccgaataggttatctgcatccagattgacagtccgctcgttcacactgtcaagatatcggcaactccaacaatattgttaggcaaatcatcgacatgccaccactagccatgatagtgcgaccaaaccaaaaccaatattttaacctttttttccttagttgcgacacacaaaaaaaaaagtcaatgcaccctcgcaacacccactgacatcgggctaggataacccaacaatcacattgtcaaaacagaagacggtattctgcattctgcactaacatggttggccgtcgtcatccggcgccttactggtcatcaccaactcactgctcctctcagtgtgccactaccggacacactgaccattaacccacttcaaatccgatcgcacaaggaggttgggagaaaagccccacatgtcagtgacacggccagcctctcacgtcaaaccgttgaaaccccaaatgtacagtctatgagtcactggcagaagggcccacgagaacctaactaaacccacctcgccggcgttagaaagcgttgcgcgcccttttcctccgcatttcgcctcgggattgctcgacggcgagcgattccgacttcacgcgctcccatggcaggcggcggcggcggcggcagagcttccgcgcagcggcgggcggcgctcgcggcgctgatcacgctcctcttgcttgcgtccctcgctttcctcctgtcggcgacgggcaccgcctccgccccgaactccgcacccttccggctggccgccattcgccgccacgccgaggaccacgccgccgttctcgccgcctacgcggcccaggcgcggaaactcagcgcggcctccgcctcccagacggagtctttcttgtctatctccgggcatctcagctcgctctcgtcccgcatctccctgtccaccgtcgcgctcttggagaaggagacgcgcgggcaaatcaagcgcgcccgctccctggcaggcgccgccaaggaggcgttcgacacgcagtccaagatccagaagctctccgacaccgtcttcgccgtcgaccagcagctcctccgcgcccgccgcgcgggcctcctcaactcccgcatcgccgccggctccacgcccaagtcgctccactgcctcgtcatgcgcctcctcgaggcacgcctcgccaacgcctccgccatccccgacgacccgcccgtcccgccccctcagttcaccgacccggcgctgtaccactacgccatcttctccgacaacgtgctcgccgtgtccgtcgtggtggcctccgcggcgcgcgcagccgccgagccggcgcgccacgtcttccacgtggtcaccgcgcccatgtacctcccggccttccgcgtctggttcgcgcgccggccgccgccgctcggcacgcacgtgcagctcctcgccgtctcggacttcccgttcctgaacgcctccgcctccccggtcatcaggcagatcgaggacggcaacagggacgtgccgctgctcgactacctccggttctacctcccggagatgttcccggcgctgcggcgggtggtgctcctggaggacgacgtggtggtgcagagggacctggccgggctgtggcgcgtcgacctcggcggcaaggtgaacgccgcgctggagacctgcttcggagggttccgccgatacggcaagcacatcaacttctccgaccccgccgtgcaggagcggttcaacccgcgcgcgtgcgcctggtcctacggcctcaacgtgttcgatctccaggcttggcgccgggaccaatgcacccagcgattccaccagctcatggaaatggtaagctagctcaccgcgatccctctcgatacggctgaaaatgcaattcgctttcggtttttttgagcttgatgttgctcgtgttcgtgccatgcagaacgagaacggcacgctgtgggatccagcgtccgttctgccggcggggctcatgacgttctacggcaacacgaggccgctggacaagtcgtggcacgtgatgggactcgggtacaacccgcacatcaggccggaggacatcaagggagccgcggtgatacacttcaacgggaacatgaagccgtggctcgacgtcgccttcaaccagtacaagcatctctggaccaagtacgtcgacaccgagatggagttcctgacattgtgcaacttcggactctgatctttgctacgatttcaatggtaatgatcagatgtaggttcagtcgtttctgcctgccgctgttgttgcaacttgcaaaagcagacgagttaatggctctgctccgctaactgtattgtgtttgtcccccttgtcatttaggctgtctgaactgaagaaatctctcatgtattatggtactagtagatgatatcccgttcattaccgtgggcattttgattttgtaggtattacctaaaactttctaacattgctcatattcatacttagcaaccatatatgcagagaataacggaaatcaaattagaataatggttgtgctaaaaaaatagaataatggcgttatatttttacaagactgcacaaattacttccacccggcgtcaccgttcaccaccctgcacagtcttgttgtgcacccacttggcaatatattttggggcatttgcaaatttgccaccggttttttgaatattgcaaggataccactcgaatgacagttctagtggcatttttgcaattttctagtggcagttttgcaataacgattcaaagtagtggtaaatttgcaattgccccatatatttttgaaaaaattacgaattacccctctgaaatagggctgtcaaaaaagctcgaggctcgccgagtagctcgagcttggctcgtcctaggctcgatttgagctcggctcaagctccaaacaagccgaacccgagcctgagcaaaagctcgcgagctttacccagccgagctcgagcttctaccgagtctaggtgagcttgactgtatataatttatattacatgtttaccttattaatataataaactaatagataaatatatattagtatctatttatacagtaaattagcatgtgttagcacaatatatttattttaatcattttctactcttttattagtgtgattagctagaaaataattatacttatcaagagattatcattaaaatatatattatactacttatagccgagctcgagctcgaactgagcttgcctaaaagctcgaagttgcaataggctcggcttgagctcgagcttgggcagacgagttcactcgagtttggctcgttgacagctatactctgaactattgaggtcgttcgaattacacccctaaactgcaatatcggatattacaaaccctaaactcttaaatccgaacgaatcacccccccttaactcaattcggagtggtttttggtctatatggcatacatggcagcctagtcagaaaaaaaaacgaaaaaaaacacagtggggcccagttgttagtgcatcttcatttcctctccttcctggcagctcaatcccaacaggcatggctccggtgatgtgggccatacggtggcaggaagaggaggcgatgcggcggggcgcttgcagaggccaatggcatggaggcggaggcgaggaggttgggatccaagaccagcaggctacgtcgattcgtggtagcgcagaggcggcgatggagacgagctatgcgacggggctcgacgtgccgattgcgtcaaatccaggcgtgtcggagcatgaagcagcacatcctcctttggcaaacgagaaagagaggaggaagagtcagagcgggaggactttggagctagcggtcgggggcggagctcaagcctcagggaaacggcctcgagatcgacgttccatagcttcgccgacgtcgtctaggctcgtcggcgccagccaccgcagaggagcttcgcctccaagccgctggcatctacaggcgccccgccgcgtcgccctgtctccccgccaccgtatttcccctaccatggccgtctccaccgccgcaccttcgccttcgaccgcgtcgcccccgccgccggtcgtgccgtcctcgcctccgcctcgatgccgtcggcatctgtgcacgttgctgctgcccctctcgatctttctcacgctttgttagccgcgcctagaggaacacaagattttggtgtcgctgctgctacgtactaccgccgcttgccatcttcggcctccaccgacgggcacctcatccttgggctccaccgctggcgcgcggctcgtcctcggcctccgcaacatggcgcgccgctcatcctcggcctcccgccgctcgcctcagtgcgccagatacggggagagaggggaagcggcgaagaggaggggggaagaaggggaattaggctgacaagtgggtcccaccatgtttatttgttttggctaacaaatgggtcccatatatttcttatgttttgattgactagactgccagtctaccatgtatccggtttgtaaattttagggttaaaaataatcggtattagagttcagggttaaaaatcggatgcgaggggtaatttgtaatttttccaaaaattttagcaataatatgggcaaaaattcctgttgggcctgggcgttgcgcgttcaccaccgtcggaagcccgaaaaactcttgctaagtggtccatgcagcccacctgtgtcaggtatagaagaaaggaataagttcatctaaggtctcttaaattgtcaacgaatccgattttcgcccttcaaccacaaaaccagatacaattggtccctcaactatcaaaaccggtgcatattaggtccctcggcggtttcgatggcggttttggctgacgtggcgcctacgtggctaattttgactcggtcttgatctgacgtggcactgatgtggcgcttacgtggcaattcgatccgaaaaataataaaccccgtgggacccacatgtcagtttcacacacaataataataataatggtgggacccacgcggaccccacatgtcagtctaattaacccctcctcttctgcttcctctctctcctcctccccctcttcgtctctctcttgcgctgggtcattctgattctcctcttccccatcttctctgtcttcatctctctcccctctcctctctctcttctcttcggttcacgggcggtggggagaggacggtgtccggctaagagaaggggcgcggcgcggcggctggtgggagggaaactagtggagagaagggaaccagcccggcggcggaggcagtgccgccgcggccgtggctgcggacgacgtcgacgtcgacctcggcatctcggcggcgggatgaacgtgtcccgccgaccggccgacacacgcgcgcatcctcggaggcggccgtccacgtgggcgggtgagggggccacctcgccggcgggagaggggagaggcggccggctgcaaagacgaccccagtgatgatgacgaccgtgcggcgcgcggcggaggccgatcccgtgagcaggaagctcttcgtccacggccttggctggggcaccagagccgacgacctccgctccgcgtttatgtgcctaatcatacaaaggtagaagcaatagcgactagtactacctgactggagtatattttgcttcgtcatcatcatttgcttgtgttatgacgaggttgatgaatgaatgaatgatcattgttttgggcaagaaaacaccgttccggccggattgacgaggaacccatatcgatccgctcgccgtggcccatggaaacccaacaggagatggcggcgctaccttccgctgccggcgactactaatggtgggtgatgctcgagcacattgacgaactcgaggtcgacgacgaggactccaactacaactcctgctccgccgctgccgacgacaccgccaatcccgtgagtccatgatgacttcgctcacctccgacggccacgtcgtaagagtctacttccacctcgaagcgcccccggcgatgtcacacctatgcccctagcggtcactcttatccatttccgccgccgtcgtcgccggccgcatcccctagcgcaagagagagatgaagagaggagagagaggaagcagaaaaggaggggtgagttagactgacatgtggggcagcgtgggttccaccattattattaatttttttatgtgaaactgatatgtgggtcccacggggtttattattttcccgggtcaaattgccacgtaagcgccacgtcataccacgtcagatcaagaccgagtcaaaattagccacgcaggcgccacgtcagccaaaaccgccatcgaaaccgccgagggacctaatatgcaccggttttgatagttaagggacccgttgtatctggttttgcggttgaaggacgaaaatcggattcgttgataagttaagggacctttgatgaatttattcctagaagaaatccgcctccttgtagccaccgctccgtcggtcagttgaaccggtctcctcgagcgctcggaggagcggcaggcgggcgcctctcgatctcccccctcgcgagtccggagtccggacggggaggcgcacaactccaggaatccaggtgctccctccgtccctccccttctcctctggtaggcgccgcgcaactgctccactcgtgtagcgtagtcgcctcgctgctaggaccgccgcatcggggcccgggacggcggaaatcaggcaccgacgacgtggaaaacttcggtgactggtctgtcacagtctcggggtcgtccctgttgccactgaatccgatcttattagtcgtccccgttgccgctgaatccgatcttattagtcgtccccgtcgccgctgaatccgatttataataagagtataatagattggggacatctctcgtaagtcccaacgctaatatcatcgcgacgcgcggtcgtacgagtggtcgtctcttactttttcaggtaataaaaagcgcaggcacccctccccttatccaggtccggatttgggtttccctcaagttttttccgttgttcaattggatcgaattaaacgatttatgcccgtacagggtttggtttgagtagaatcatctgtggtggtatattggtattctatatactttttttttgatttggctgtttcgatcagccatggtgaagacgtcggccaacccgaatgccaagggcaaggccgcagcttcgtcctctggtcttccgtcacccaagaccacgcccagaggggtgaggcctaaggcgtttaagaagaaggccaaggccgatccagagatgcagaaggtggcagctgcggaagccgccgccactgctgagactgcatcggcaccccctctgaagccggctgaggtcagcccagcggcagcggtggccaaggagaatggaggacagaggatgagcagaaaggaaaagacaaagatgaaagagggggaccagatgaaggaggataagaaggggagaataaaggggaaggaaaagaaggacgataaagcgagggagaggaagggtgaagctgggtttatattcatgtgcagtgctaagacaaagccggagtgcttccagaatggtgtgtttggcttgcctaaggggaagatcgatgtggtggagaagatccagccaggggcaaaactgttcctctatgacttcgacctgaagctgctctatgggatatacaaggccaagacaaagggagggttagatcttgtgcgaggcgcgttccatggaaaattccctgcacaggtaactctttagtctgtgtgttcctttcctatgttttatgttcctttcctatgctttaggttccctgcacaggtaactctttagacttattgtcagtgcgttcctttcctatgctttaggttccctgcacaggtaactctttagacttattgtctgtgtgttcctttcctatgctttagggtattgggaggacctggtctgctattagagcaatacaactgtcttgattatccaggcaatataattaaaatttaaaacaacaaatcagaactagaaacatttcctcaggcttaggggtgtgcaatgtctaataacgaataataatttcaggtcagaactgattattgatgtttgactcttgttttgttgttctgattggtgttaataattggaaatttaaccctaatggaacggtaaatgattgccaaggtattttttctagcatgacattgtggctatttaaatggtcaaataagttctatgttttcaaaaaaagggacaatgatcatcggtcatcattaacttaaatccccatttgtacacatgtttttctaacctttttaacataattcgttagcccatatgttattcgttcagattggtctatcatttttgtaagcaagtgtcatgcaactggcactaaaatacaaacagctcaggataaactagtcaacttttgtcatgagttgatttattcttaatacttgttgacaacttgagaaacatgattgctcatttttatgggggagtgcaacagttatgcctataagttaagctttaacaccagtttggaatatagaatgtggccacatcctattgttatgtttttgtaagacactaaaatttgagaaaattttgcatgtggcagcggctgtgtcattttcttttttgcatgccatcttcaaaactatatttttgtgcttccacccaaaatagcttatgttcttatccatgacactggtgacttg

SEQ ID NO: 37830 - DNA, 17333 bp, Oryza sativa
  unsure (1)..(17333): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaactgaaccttgattgctgccacgttttagagcaaatcatgatccataaactttgccgactttttacaataaaatagtccactgcattttcattgttcctttcaatacacatgcttgagtataattttgaaatttgatttttttaaaaataatttcaggtataatttttactcgtcttcatcgcaattatgaaaagagagttgggtaacaaaaaacaagcgaataaacttataaatttggttctaaaattgaaaatctgaagaggtggaattgtgagaaaaaccagatcatcacaaaatcttccaaggcctcacctaaaatagagccatagcaaaattagcaaaggacaataaatactccactggaagagaggctctctaatttgagagatatttatcctccacacctaccaaccctactgtcactaataaatcattgtttattacttaatcacacgacatcaacctcattgtcccctaacagcaacatccaatcccatgcaccacgacgattaattactgaacaggaggaggagtagtagagtacagagataacacacacagacaaagacacatccaaatccattctttctccaccaccaaccagatgatctcctcttctcttctccaagagaaaccattccattattacaaagctcatttttctaattacaaagtccatttctttttatgttttctgaataatttttcttcttctccctttggcatgttgctgtaggtcccctacaaaggtctagaggtcactagtagtacacactcctacaaaaggttgtaccaccacaccaccagcctcattgctctcattgcattgtctcctcttcctactgctgctgctgctttctctctctaggctgcttgctttgcttgcccctctctctctctctatctacaaatgttctcttcttttgagagaagagaggaatagctgcaacacaaaggaaggcactgcttgcactgtgcagtgtgcaggcacagccaagttttcaaaagaacccgccatcttctttctctctctactgtcctagcaattctctctctagctccagtattaatttctttccatcctccattttcttgggcaccgtgcgagcttagctctgcactgtttgcctcagttgggttggtttggtttggttgcttcttctctgcttcaacggttggtcgacttcaatgcaagaaagcatcggcagcaattgctcctcccgttgagtttttcgtcgtcgtttgaaagcgaaggagacggcgacggcgacgaggaggaggaggagggattaatgtcgtccatggcctccaacgaaggtattcttctcttctctctcaaatattctgtttctcgcatacaagtttgctcctcttttttctttcttcttctgctctcttctctcttcttcttctgtccgtcttggggaagagagagagagagagagagagagagagagaaattcagaagaagaaattgttggtgatgacgaaactgaaggagtatttggtgattgaatctgcagaggtcggtaatgaagatgggaggcaggaggatctgcttgttaaggaaggttagctgtggtgattttgattattttttttactgcttaatttcctcatctctttgctgcatgtgtggcacaattagtgcttgtctgtatcttctctttctttcttgctttagtctaagtgctccattagtcctggaaaaatcatggcttttttttccaggcatgctcacagctttgaagctctaacatgtcattttctaagagggcaacaagagattaaaaaaaagagagatgtcagctgctggattctggtcttctttgtaacttttaaatatgctattaggttgggcaggcttccattccctatcatcatatagaagatgggtagattgtcaagttcttccaatttttctcaccaaaccaaaatctttgaaatcgacatttatgttgatttaagcaccctcttgatgatctttcgcaaattgcaagcaaatcacagagatgcacaggttattttcagacttagttgtgtgtctgtctgtgtgtgatagatagaaagaaagcatcaattttggaagggtgcagagggtggtgcgcatgtcaattcttggtgcaaatctctgaattatagaaatgcctcagatactgtcgactggcagcatgtggttttcatgggaaacgagacaaacacaagcctctccccccttatcatccactgtcaagggatctgagagcctgtgtttgtgtgtgtgatgatgatgtgtttcttgccttgacttgctttgcactttgtttgtcttgatgtttgtagtagtaggtagttaatttgtcttcttgataaaattcagttttgtagcataacaaacctatgataatagcccatgctatgtctacatctcctttgctgtgttcagggccaggggagcaccaagaaaacaccatcagagattccgacgaagcgaaaaatgaggattgcagcaatagcgggtcagtaaccgaagccgtcgtatcaagcgaagaacccagtgacaggagcagcactgaagaacccagtgacaggagcagtactgaagaacccagtgacagtagtagtggtggtgacagtagcagccaatctgctgattctgatggaggtagcaaagaggcgcctaagatggattcgaaggccggtaacgatgacagcagcgagtgcaccgatcagagctctcctcgcgcggtgctagacatctcggtatccggtagtgtcgactccgatgagagctcctccgttgagcagccagcggagtcgaatcacaatacgcagtggaggaacctgatcagtggattgatactcaggaggaggaagtcgatggcgagagcggggacattccctcagagaaccaagaccacagggcttaagaggtacctggagaggatgcggagcggcaagaaccagatcgattgcggcgccattgctcctgagatccttcctgagatcagcaagtggaggccatcatggagaagcttcgactacagtgagctttgtgctgcaactgacaaattcagttcaggtgatatgcaaaacttacttctttgttgctgcaatgctgtcactcgattaggccatgttactatcattgcagaacttatgggatgtagctttaacactaagctatgaatttataactgcagcagtataatttcaccaaggaaacatagggcttgagattcaaatcatgaactgttatttagtgtaatgatgactgattactgattagaagttagaaaagtgagaagtattaaagtataagtgcataacactgtaataccaaatcattaacaaatagggcctgattttgttctacattgcggtaactctagcatataatacagaaatcttagctgttatgctctgcctctatatcatagctccaagggtcatgtgatacaaagtacagcttttggcctaattatattatcttcatctatgttaaatattctctgaatcttttgcttcatgcttgatattactagaaaatttgatcggaaaaggcgggcatgctgaggtgtacaaaggacatcttgctgatggacaatttgtagcagtgaagagactaacaaaaggtggtaacaaagaggacaggattagcgatttcttatctgagcttggaataatagctcatgttaaccatccaaatgcggcacagctcttggggttcagtgtggaagggggcttgcacttggttcttcagttctcacctcatggaagcctggcttctgttcttcatggtatggtttcctctaaatattctttacttaatgaatccaatttctgagagatatgctgcattgctgctatgtggtggcatgttacatcatatatcattttttagaaaagtaagaaatatatagaccttactattaggaatcaactagagaacagatatctcttgacattcatgctaccatgtagtacaacatattcatttaggcagtatctgaactatgaaatgtagttctccaataagtatgtgcgaatttgtgatttccattttggtaggcttcatacaaattttacattatcacttcttgtagccctcatttcaattgcctcttaaatgcatatactataggccgtatcacatatctgaactcaagcatcatcctctttctaaaaaaaaaatcaatataagagaatacttagaatacccttagtctggtgataaaatggagttcagctgaacaggcacaaagggagccctcaagtggaaggctaggttcaatattgctcttggaattgctgaaggactgctttatctacatgaaggctgccatcgacgcataattcacagagacatcaaagcatcaaatatccttctaactgaagattaccaacctcaggtatgtattctactaccagtctcttgccgtagtcctatctgttatatgattcctagggttcttttaaatgcaacagtttttactccctcattgcacagatctcagattttggacttgcaaagtggcttcctgacaaatggactcatcatgttgtgttccccattgaagggacattcgggtgagttcgataagtttttttcagtttcatcacaatgatttaatcgtacccagaaaaagaaacaatgccattgttggttttaacttagactttacaccctttcttaggtatatgtctccagagtatttcatgcacgggatcataaatgagaagactgatgtgtttgcatatggagttttgcttcttgaactagtgacaggacggaaagccgtggattcctccagacaaagcctagtaatatgggtaataaaagcaaatctctaatatgctccattatacaaaaattcaaatcagctcattttatatcattgtctggtcatattgagagaggcaagtgatgatcaaaagttaattctacaatacttgaatggataacatgaactggtataatcacatacatctgaagcccttgaattcacaagctgttgtttgtcatgtgcataggcaaaaccattgctcgactcgaacaacatgaaggaactagtggatccttctcttgatgttggatatgatccagaagaaatggctcacatcctagcagtggcatccatgtgcattcaccacagctcaagctcgcggcctagcatgaaatcggtgagtgcgatgaacacgctaactatacggccattgtaaaggctaaaaaagaaacaatttggattgtaaactgacctgttggtttgatgcctgtaggtggtccgtttcttgaagggggatagggaatcactcgaaatgatgcaaatgcaaagaccaaaactcatgaaacccctcatgttcgactccggcgattcagaggattatactcgctcaagttacctcaacgatctcgaccggcacaagaagcttgccttggagcagtgatacttgagttgattttgactgccatcttttgtacatcatcatcattatcaacattgtgatcctcctcctttccaaaggtgtagtagtatgcaggctgtatggatggatgtaagggttcagtttatcagttgctccctttgttgctgatcaccatggtgtcattttggccaaatgcatgttgtgataccattattcgatcgatggaccatttcagccctcgcctgtgtgttctatctctgcatgaaccttgttcaccatgtcaaacaaaaaaaaaaagctcctagatccaatcaagtaacctgaatttcaaaaaggtaaatcagttcaatagaagagatgcacttgatattgtagcggtaaggggggtgattccgtgtttaattctaaacacactcataatttcttctaattattggataaaaaagctccttctcgatttcaattctctagaatgctaatcaaccaaccatgattatcacaggcaacaccaatttcgaatggatattctgaatcctaggttgcacctgtactccactgtacctttttttgtcgccgccgtcggatcccccagctgccccgcggactccggcgcagcaggcggaggctcccccgtcgcctggaagcctctccggcggacgagcaggcgaggcgcagcaggtaagagtgcgctcgttaaccctgcatggctgcatcgattcccgtggaccggcctcgcgcggcggggttcgccggaggtccgccgccgtgtggagtagaggagagaggaaaggcaaaaggaggatcgaaatgcaaaatgcgaatagttggagggtcagtcgtgcaaatatcggcccaagtaaaggccccattagcttctgattaggatacagattctatgcgtgcgaaaaaactttttgtatgtaaatttctttaaaacatcaaataaatctgtttcaaattaagcttgtaatgattaaaatttaattaattatgtgttaaaatttaattaatcatgtgttattggtttgttttatccatatcctaactttcatttttattagaaacgaatggggccaaggctcatcttttattaaagggtaaatttcacatctggtcatttattttgaccaagagttaaactaacattttcacttaacactatgcatcattttgtttggattaagggtaagggtaccgacgaaatatgtgagggaacttcatatgagatttacacagggatacatataaaaaacaaagcattgtactatgtttttacattctatttagtttgagtggtatctaattaagttatactttctattctatttttattcagttgccctccgtatagattaatttgtgacacttttaaacatattcacatcaccattttagtgtgattttttttaaaaaaaaggttgttttctgattttctaaaagaccatttgatgggattttctgagtttctaaagatatttatcgtgatactacaacactaagaatgatggtttgaaccatttctttgacattctctgacaaacacctatgatattccaaactgcaactgtaaagatatgtggtgtcaagtgaaaatgttggtcaaattccaatgtgatatttactctttattaaacttcagtgtgatgccgcccctgggataggaattttccaaacagaccgtgttcaattttaagctttgaaatgatgcgattactgttaattagtccaaccaaactgctcagggcattcaagcaagcatctgaataactgtacaaatgcaacctgcaaattcagtcaaaattggaagtttgattggatgtgtttagttcacgtcaaaattggaaggttgattgaaattggaacgatgtgatggaaaagttggaagtttatgtgtgtagaaaagttttgatgtgatgaaaaagttgaaagtttgaagaaaaagtttagaactaaacaaggccttagggtgtgtttagttcacgccaaaattagaagtttggttgaaattggaacgatgtgacggaaaagttggaagtttgtgtgtgtaaaaaagttttgatgtgatgaaaaagttagaagtttgaagaaaaagtttggaactaaactcggccttattatctctacttccatcctcacattcaacattagcagaatgacaacgcaaaagaatcgattgtgatgttttctgctatatattcacacttattgcaagtaattaaattgagggatagccatttatttatctacgcgcatggcatgccagaaatcatctgcacatctagcacgaatagttgcaaccggttgggaccctgtgtcatgtgtccatgtagcgtcaaccagctagttgattgatggcttaacagctcgcagcgataggttcagtagctttcctcagccattccttctcctgctcattcaggtaaggttgcaaaatttttctgcaatccgagtgatacgcatttacccattcaatctcagcaggggtaagtaaggtggtgtctatcagttttgtctggtacggagtctgcatagcacaagaaattcatcaatacatgaacatgagcaaaacaaatgacgcagatacatggtgagcagcattttgtatttagagatcatgaaatgccagtcgaactggcaacaaaggctgactttaaaatggtcatacaggtataaacagagcaacaaaacaagaatacaatgtattatcaaccgggatatcttgtgaaattgatacggagacttggagattaccaaagagaaagttaataatttaataaaatggagattgaagaaacttacccatgttatatgttcaaaagccaaataacccttatctccaaaattaaatttagtattggcttctttaactatcagaacattctccaaccttataccaaagcttccgtcttcatagtaaccaggttctgcaagaaaagattgtgcaagttgaactttacatcgatcattgcagcaagagggactatcatcgaagtaagaattacaaagtagtttcacattaaactgttgatagtcctattaaaataaatagtggttaatttaggatatttactgaccatctgttacagtcatcgatgcttgtagtggtacatttctagcagaaggtctgaagctaattagatgaggacctgggttgtaagcacaaacagaatggattaaacatttcaaggtagcactacaatcagataatttactgtcatagaagaggatgaaccagcaattgagtatctgaccttcatgaacattcaaataagatccaataccatggcctgtaccgtgccggtaatcaagaccacttctccaaagtggtgttcgtgcgagaatatcaatagcatgccctgttaaggtttaagtaacgcacaaatatcatggattttgttgaaatataacttgaaaaagtaagtataacacaatgaacataaattggtgtcaaaacatggtagtataaatcattttcttcatcacttgctagtttctgtcatctttttttttttcaaatttagtgagatagtctatcactaaataacattagtgattactggaatcttcttacagtttccaaatgttaaagaaacaatggagtctatcactaaataacatttgtgattagtggaatcttcttacagtttctaaatgttaaagaaacgatggacatgatctctgaggcaacgaggctttgagaaaacatgatgtcgcatgtttataagtaaatgcactcataaagaacaataatgttatcacatactacactattaggtgatgttaaaactccatggtacatctggcagctattttatcattgggacacatgatcaatgttaaatctcctgagttcatatagatggaagtataaaagctcaaaacactcactcacctgtggttccattgggaaatacagcagtgtccagtgcaatgtggcctttcaaaacctatttccaatgttcgatatcacttgcattagaaatagattaaatagtagcaaagaaaattaaaacctcacagacaatatcttgtaaactattagattcaagcatttaatatgatgtttatttctacaagagaaataaagtaacaagtgtgtaaagaaaacttgaccagccactgttgacataatattcaacaatggaattttcagctccattaagtaggggcaagtaatgcaatacaggaaatgaggaaaccaataacattgcaacgtgtcagaaaacaaactttcaacatgttgcatgtcagccactaagctcttaaattcatggaaaataatactacagttgtcaaataaataaagatagctagcagttatgcagctatgtcctgcatgctggtctaccgtatttagtaaaacacatgaagcggttacactggtaaggctccagctcaagtcaactgattattggacactcatatactccctccatttcaaaatataaggcatattactttgaccaacaattacactattaggatatcattcgttctaaatagaacttagtatttgacatgtcatttgttctaaataaaagaaaattttagcaagtgacgaaaaaataaacttacagctgtgtagcaggacttctcatgctcagagggtttgccaaaatgtacagttcttgtaatgtctgtagtaccatcaagatactgcaaacataccaccatagaaagaattagactcaagcaagtcttttaccacaaaatttgagtttgactgaaatgtactcaacctgagccccagagtcacacagatatattttatcagcatcaagttcagcacatgaacttgcttctggtttataatgaatcactgctgcatttggtcccacggatgaaatcgtaggaaaactcagacctttgaagtgctgcagaaatattaccagttagtcaaaagatgtagtatagcaggagactatgaactgcaaaatgccctcatttggctctgtagtttctatggctgcgttcggatgaggaggttcccaacccctttccctcgtatttcgcgcgcacgcttttcaaactgctaaatggtgtgttttttgcaaaaagtttctatacgaaagttgcttaaaaaaatcatatcgatccatttttgaaaaaaaattgctaatacttaattaatcacgtgctaatagaccgctccgttttccgtgcacaggatttgggttcccaacccatggtatcgaacacagcctacattcatctagcaaccaaagaaaagatgttccacgaaaacaagtctttttttttggttactttgacataaacacacagtaagcagagaaagaggggacgactcaagaccctcaatgtcctgattcctgaatgaagagctcagagcgaagtcagtgaatgtagaattttttgtgcaaaaaataggccttatttttggactgtttacgcaaaagatttatgcattcactctgggctctgcactgagattgaggagcctctgatggttccctctatctccacttaccatgtgtttacgtgatagtaacaatacatataatgtcatccagagagtattcttttatttaaaaaatatgcttacaaagaacagtaaaaacttcctctcaaaaattgcacaagaaatacaaaatagttagtatagtagaattttttccattgtctctttaacggatacaaatgaaaccgatgggccttggctatatcagttccaaagtttcaatggatatttggggttgctacaacaaagtcataggtaagtatgaggaacttgtttattttaacaatttccataataccaaaagtgcacttactggcttttgacttttaaaaatggtaatggcagtaactatagctgtttatggcagttataaaagatctctagtaatatagtatacttaagcttgaaaaaaggtcacgttagcagcatacctctttagatgcacggaaaccttcaagtttatcgctcacagaaacctctgtaagttttacattcctacaggagtgaaacaaaaacattaacacaaccaaatgcacactattattcataattaataaagtggacgataattgattaatataatgcatagaacaaatgacgtatcaagaaaatggtaagattctttatatatataacaaaaatcaggctaagaacaaaggaatcatggagcattgaaacttcagacttcaggggatttgccaaatgtaaaagtcgtactccatatgtattatcgtagcaatagtacaaagaagcccacaaggtanaagggacccccaaaaagggttttaacccccccaaaatttttggtacaacattgaattttagaaaaaatacacaagggggcagagaaatacaacttgtctgagcagagcacacggtgtcatactatcatggtcagtgaaaacaacaaaacaatgtgcacacctcccaaaggaaataaatgggcagtgtaaatgaganaattggacaaacaaaaattccagataggtaaaccaaagaaggaacatgtcaaccttggtctatgatctgaatacagaagatttttttttctgaaagcgtgttcagagtaagcacacactactgagatgcagaagtgaaaaaaaaatgaaggaactacattttaaatattatacaaaaaggagcaatgacagtaacaacgtatattaaaaaaaatgcgtctcaagtttgcaaccaagttacgttgcagtattgcacatgaagttcaagaaaactctatcacaacctccttagaaaaatattctaaaatttataattatcaggaaggcatgaaaccactgatttagacagttctgacagccaaaagctgggcctaatgaggataatagacctaagctacaaagaaaagctgggcatcttttgataatagatggttccaatttgtataggtgaataaaaggtcaatactccatacaatgatgatataatttcgtttgacactcttttgtcttcagggtgtgactttgaccatgatttttttattatggtcaattctaataatttcatgataatattaaaatacttttcaagacaatatctatgcataccatttctatgttttcaaactatgtattttaaaatttattgatcgacaaagtttcaaaagtttgactggaaaagaaagtcaaatgacatttgtggccagagggagtatgttcccaaaagaaccataagtttaatatcagtgcatactcacatatgctcctttttctgtgatcccttggcctcagtaaagtaaccagaagctccataattttcttgcatctgtcattaaaacaagatcatctgagctagtagaaaataattagaaggactacatcacaactaaacaaatttgcagctgcaaaagaacacttgcttgaagtccaagactaatacgccgcatgagagacaaattcatactgacctgcttgtcaagccaagcaaggtattgcacgacagccgcaccatctcgaatatgtgccttcctcaaaccatccagctctacgggattctgtaccatgatacaagaaattaaaaatataggcataataaatgataaaacttgcaaatatagcagattttcaaaccatccagctcgacaggattttagtataccatcattagaagaaataaaaaaagagatagattaataaatgataaagcttttaatgtcagatagcagattttccatagataaaaagcctaaaataaatagaatgaaacaaaaggaatacttgaacaaaatacacttctagtgtaaaatgttctatccccgttcttctgaaactttcagcaggcgtggtatgaattaaaaacaaaagaaaaaaaaaccttcacagcctttggaagagcaataggtgattgcagcatcagaacttgatattgatccagttttgagtagagtgcaaggcagcatgaatttgaatcaatccaaacttttgaattctcattcatatcattttccccatgagagctaccattgactgcagaaccttttagctgtccagatgcaagcaagcttgcatctgattgaaccatattatagtctttgatgtcaataccattctcagtcatgtagttctggacctggaccaaacaagagccacagttcactacatgcccctcaaaatcatgactacgattctatgaacgacatagtggaataattgaagaaaatgtgttcagtggattagctgacctcaacagatacttttctcttatccacataaaagaaagcactgtgcaaggttacaatagaataagaatggaccactgggctgtagtgcacatcatttcctctaatgttgtacaaccacgcaacctaaataagaataacaaaaggacaactattaaaactggcaaagttgacaaaattctcaagaaatcaaaattgaatatattgtagtggataagaaaccaagaaataaataagtctaatagtacctcatcaagcgcagcaattataatgcccctagccttttcatgttgtaatttttctcttaactccttaagtttttcggtaacactacacccagcatactctacaggttgcacaaatacaggtagagcattaacaggaggacgatccttccatatttcatctaccaagtcagaagaaagctgaaacagtgtctggtgcttctttgaaaatgcatgctcatatctctgggcagtgtcaacagagatgcaccatggattaattccaatgacagcttcatctgacaggttctgattgcacagcaacaaacacaagccacaaaagttagttagaaacaacattattcagaataaaattaaacgctaatcatgagtattgctatgcaatgcagatcaacaaataactaaacccattctctctaatcattgaataattggcatgactattcttagttttctccctagcaaaataaaagcctcaagtagatctttaaatttctgcttgcatttggtatgatcaaaataaatttatgtgcccaaaattctggtagttctgataattttggaaggaactcccatatatcaaaccaactatcatgcagttccttgaatctacagcagacaggaagaaagatagtaggcttggggtattaacaaaacaactgaatatggttaacaaaatgaaaaggaccatatttgggagataaaactagctaaaattaacaagaataaaaccacttttgggatttcacaacacaaaaactgtggcagaattcaaaaagcaaggataaacctttgatctggctgttcaaaaaaaaatgagagggtataaccaaataaattcatttccatggacaagttttgtgaaccaatatttttattatgtaagacttgggaaattaaactcatgaacatgatcaagaagagatgtcaacacttacatcagctatccaaacttcaactgggggatcttctcccatgcgcatcaatttccagcgattagtgagttgctgctctgcctgcaagaagtaacgcccatccgtccaaagtagcgcctccttcatagtgataagcgccaaacctgtgtagcaacgcaatatagctcggtctgagaaattaatgcaactctctgattacgacaactgggggaaaacaaaagaaatcaacaagttcaatatgttacatccacattttatgatattcaactccatcctactacaaaataggaatcaattaagctcctcccagtacaaaggtggttatcattccatactttagtccagctagattaaaccataactataaatggtagcgaagctatcaataattttattacgatttgcttggtcgaagcaatgtataaaacaatccagtccaaaaatgtctgttaatcacctaaatttccaaaaacataacagtgtcataaatcataactgctcctaaaatttcaaccattagcctctattactagtcaactgctttctgattcatgtcaggcagagcaaaaagaactccactttgtgtatcaccaaaatggtaaaaattgcaaccctgaacaacgttgcataatccaattgcactattgtataatgaactcatcgcaacagactcatcggctggtggtctaggacaatacacagcgttcatcgcctgggaaacgagaagggatgaattgaggaagcaacataccagcgctcccggtgaagccggagacgaactgccgccgcttgtcccgctccgacacatactcgctctgcaatcaatcaatcaatcacccacaaaaccacacccaaatcctcaaccatcatcgagaggaagaagagatcgcgcaaaacggaaaatccaacaacaacaacaacaaaaatccaagcccgatctgatctgatcgactccgcgggaggtggcagcgggcgcggacggacctggtgggcgtcctcggacgggacgacgagcgcgtggagcgacggggagtgggccgccatgagcgcgcgcagctcgtccaggagagcgtccctccccgccgccgccgagtccgccgacattgtgctccgcggctcagctctcgtctgtggtgcagagccttctcgagaagaaggaggaggcggcggaagtagaagggcggcggcggcggcggctttccggcgaggagacgggagtcgaggcagttcagaacggtttttgtttcatggacgcaataaaacggccgattagtccgataaattaggcactgtttagttcaggtgaaaagtttgtgtgtgctccgtcagatatacggacacacatttaaagtattaaacgtagtctaataacaaaataaattacatattccgcctgcaaactacgagataaaatattaagcctaattaatccgtcactagcaagtgtttactgtagcatcatattatcaaatcatggcgcaattaggcttaaaagatttgtctcacaatttacacgcaatctatataattattttttttctatatttaatactccgtgcatgtgtctaaatatttgatgtgatcgccttagtcgattagcgattaatcaccgaaaattgctatgcttatgacacatggacaaaaatggacggtgtctctaattatatgattgtatatctctaattatacataaatcatacaactggatcacacgtatagcagcagtctttaatcgcttggttaagttgtttaatgggcatatcacaacaaatccaaataaagtttttttccaactcaaacttcggctgtttttagttcagcgtaaattttggactgaaaaattgtgtgtgtataacaaattgtgtgtataacaggttgatgtgatggaaaagaattaaagtttggatccagccttctttacgtttcatcaagttaaaattaacacgtctagccactggtctggatattgcaacacgtctcatcgcaatcacacgtccggaaatgccctctagttttgattgttccgtcagccagcctgcctgagaaaaacagttcaagttcaggataagagagctctttacactgcctaataagaacagcaatttggctgcaggttgtcctcataggtaggaccagttcaactgaaggctaatcacaccaagttctatagtaagcaagggctttacaaagttgcagggttcatagtaaaagttactcttattgctgctcttaaatcgaactaaccggaccacattgcagagaagtgtacagactgcagagacaaaagaaatttcagaacacgttgcagataaaagtgtccatgtagccaaaggatgcattacatataaatttgtgttgtcccttccattt

SEQ ID NO: 37831 - DNA, 14858 bp, Oryza sativa
cggagacaaaaccaaaaaacctgccaggtaaaaacatcggttttgcaaatacagagttctccagtaggtccccctgttctcttttcgcatgctacattatcttcagacctcattatctaaggttatatatcttcacacctcatatccaggattaaccttctgttgcacatctccatagctttccaactcaagcatgtcctccatgcctcccaggaacaatggcagcctctggtgcagcttcacaggctgaatcgagaggattctgctcttgccatctgaacccctgccccctgcctgctcagcaaggaaactcagaggatttgcttcatagaccaaccgaaggtgatccctggggttcatggcaactccaccgtatatcagcgtccggtggaaatcagcaaccagcgagcacacgtaccgtgccgagtacttcttcggatgctgtcccttgccttgtctgatcgtgtcaatgtacttccttaggccctcaggccagtcgaaataccgcgcatcattcaccgaatatatctgtcctggcatagctcaggattacagcttttcagcaaagatgaaagcatgcatttctaagttcaacacagttaatatttcagtcgttcagttataagaaatttctctacgtcatgttctcaaacacaatgcaagcactcttgccgctgttcaactaaaacatctcctcaaattactgacattgataaactgttcatccaccaatccataaattgagaaaacttgcgctactagtgtaagtgaatttaggtgacatctggttaacatttaatgaagactaagggaattagcaaattattgaattacagcttattagttacctcttgggggtatttggatggaaggatgtgttagaacaaattctccagtcaagtgatccaaggtgaagccatgggtacctgcaccgaagctgatacagaatatggtggcagatgaatacagcacataccccgaagcgacaaggtgagtgccgctttgcagtgaattgagctgagctctctcctcttcaggtagatggtcaagctctgccagcctattgtatatcccaaatattgttccggtgggaatggatacctcaatgttgcgagaaccatcaagcggatccgtaacaacaacatacgggctgtcgttggaaacccaaatggggagatgattttcttcagaagccatcactgcaacctttccagatcttcggagtgatgacaagatgatctcattctaaattgaaaaatatgttagtcttgatgttgttggaagctataatgcaagttagtagcatcagacaaacaataactgtttttttttgcaaataggaagtgcttctgttgatggttcaccacaaatgcaagtagtattttgttgagaatgcaagaatgaaaatgtggggaaagtctcttgtgtgcactttgcacaacttacctcaagtaaacttaattagtaaatgaacattttacactccaaatgagtgctactccagctgctaagcgtatgactgagatgtgataacaatctcacaaaaaatggacctattcttttttttttaaaaaaaagaagaaggatgaaatgcatgtagatagatgcgagaaccagaatgcagacaataataacccacgcaaccctgacactgcacgcaccgacaattcgtcgagcggcttgggcgcgtcccgcccggccgccaccgccacaccaccccccgccttcccccgcgacagctcggcgttcccgggcgacgccacgagcgcggcgatgcgcttgcacgcgctctggacgtgcgccacgaggacgacgaggtcgtcggccgcgccagcctggcccatgtactcgagcagcgtgggcggcgtctccgccgccgcggtcgccgcggccatgccgtcggctggtacggcacgggccccggaaacgggcgaacggcgcccgagcggcgagtggcggaggagggggaggaggagggccctagagggaggcggcggtggcgggtatttgaagttggcgggaacggagcccggtggaaggggaggagggagaaaaaagataccggcatagtgtagccagtggtagtagtggttggttggttgctggatgatgcgtggctcgtgtggatattgccctccacgtttcattgcaaaaattggaaaaatatattacaaaattttattttattttttaataagacgtttcattgtagtattttttaagacatatttaggcccgttttgcacggctttatcttcagctccatcactcttagatcataagcttaaccaaacttcactcaaaaatagaatggagttggctgaagagctctcacaaaataaattagataggcatagctgcgtttaggtaacttcaaaatttcattctagacctaaaattaaatttcgaagttagaaccattcttaaaaaaatatctaaaaatctaccattcgatcattataaggaatcatacctagaacattggcgtcgcttgacaatgctttttctcaaatgctaacatttttaaatgtgattgttgagaataagtttaggtagaatttttttaagagcgccgaaaaaatccactaaaaattaatcttaaactcaaatcctaacatttagaatgagaccagacttttagaaatagcagtgtgcaagagagctggcttacattaaaaatagattaatatgattttctaaagcaacttccgtatataactttttttaaaaaaaaattacactgcttagcagtttgaaaagcacgcgcatagaaaacgagggagataagttgagaaagaaggaagaaaatctcctttaaggctatggtcgtccttctttcccaacacacttttttttccgcccacacgtttattcaacctgctaaatgatatgtttttttttcacaagtttttttataagaaagttgttttaaaaatcatattaatccatttttttaaatttattagactaacatttaattaatcatgtgttaataataatatttgttttccgtatgtggaggtggagttcctaactcaactcagcaactactccctccttccctaaatgtttgacgccgttgacttttttaaatatgtttgaccgttcgtcttattcaaaaacttttgtaaaatgtgtaaaactatatgtatacataaaaatatatttaacaataaatcaaatgataggaaaagaattaacaattacttaaattttttgaataagacgaacggtgaaatatttttaaaaaagtcaacggcgtcaaatattttgggatggaggtagtagtatactatcactttttgcaagtcttcctaaaatgtcaatagatagtgaatacggagcagtacaaacccaaacccaacgagcacgcgtgaccgtcaacccactcgtgtccactgaagaatcggtcagtctcgactctaacctgccgtgctttgcccggttgcactaataacaggagaccaaacccgatcaagactcagccgaccaagttaattaccaaagcgaccctttttaccagaaaaaaaacaacatttttcacctattgtttctgatgaaatccacacaattcctgcaatatgcccatccagaagaacagactaggaagtgtgttgatcttttcccttctaccatacgcatagaattgcagaacactgctgctggatctcctctctctctcagacaagagttgtctttgaagcaagcaatgcaagtacgtactgtgtcctcaacaagaaattgaaagttcagagacggattttagttgggcatgatgtgtccattaaggtaagcaatcacccacataacaccccctcaaataatatagtttcagaacaagtgcagtgttacatctgaagaaatatcgtatcactacaaggcatatattccatatggacaatatgatcgaacttgtgaaccatcagacatgcaaaattaattaattatttttcccttgtttttccttgtttttgctgcaattacaagtaagcattcttgatgtgagcccgccccggcgtgtagcagcagttctgatagatacctgcatcctggaaaaaaaatgtttttctatcatcagagaacaggtcagggtcatgttgacctcatcttgtagatattactccaactcttaacatcatgaaagcatcatcaattaataatccccaagtgaatttcatctcaaaacagtctcaattccaaaatttccagttcatcagtttgtcaaaaaaaaattgtcgctttcgcgctcctactctatataccaccccatctgctagtagttggatgctgcctcacacctctcctcctctcaccttctcttctacgtcacaaaagttgacacctttgcccctctcgaaccaaacggatttcagtacaacccaagcaatccaatcccatttattttttcctctcaaaagatcacaattttttcatcttcttctcgtgatatcctttgttttttttcatccatccatccattcccctttgcacggttgagctcgtctcacagttgttaattaacagcaagaacatttttttccttaaatttctatttaatttatactacttgcgagcgagagccacctaatcttggtgcccaccaagcataagcttcatcatcttcttcttctttgaagtcgtcttcttccctcctcctctcgtcgcctcttggaaagagagagagagagagagagagagagagagagagaggtgatcgagttgcagcaatggcgaggagggcgccatggctcgccgggattggggccgtgccgttcttgatcgtcgtcgtggtggcggtggtgggcgccgccgtgccggcgatggggaggttcgtggtggagaagagcagcgtgagggtgctctcgccggagcacatccgggggcaccacgacgccgccatcggcaacttcggcgtgccggactacggcggcacgctcaccggcgtcgtcgtctaccccgacaagaaggccaccggctgcgccgagttcgacgccaagttcaagtccaagtctcgccgcccggtcatcctcctgctcgaccgtggaggtaggagattgatttcaaacttccaatgattgattcaattagtttgtgcttgttttgatttgcataagtatttttcaagaaatttgtgttccaaagtctgcaagtctgaactgaacaaacttgagaagtagtattagtttttgatgattatttggattttgagagtttggtttggtgatgatttgattccaatgttctaagtcatgccaatttttgttctgttaatgggttgtgtcaatccaatggttagctagtccactgattaaaaaaacaacaaaagaaatggttagcaagagagtatcaaggtaggcatgatggttaagttgtatagtattttaattctttgatgtggattgttgtccaactttagaagtctgaaagattgcattcatatatattttttttattgtggcgagggaagggaatttataattcagttctgaaagcagagttgaacgatggtagaccaaaactttttaatttatttttgaaattgtttgagaactgagatcacttactctgaatcaaattgttttgtttgtttcgccttgaaaaacaagtccaatattgcagaatactacctaacataataccaataactaggacggaatcttagttcagagccattattgaagacatgttaaccacttcttattcactacttataagattcaaacacacacttagtttaattactttcgggattcggctcaactttaagcatttcgacgagtttgttcctttctttccgtcagagtttcagataactctgaaccaaggaaagcgagaataggttcttgatacatatgccgtacatttatccattgcaactttgaattttgaatctcatacctgattcggtatttgatccaaccactgcaacgcacttgatcacaactcctccactaccaatcagcaggtgtctctcaattccttcaagccaaaggcagcactgaacaacctgttcatccttcgtttccaagccactctccatcagattctgaactctgcaccaggacacttttaccatcagattatgaaataggaattgcaaattgacccacttattctgtactaatatactgaaattctcactcaattcagtgcattttagttgcaataaagaagaagcaattttaatatttttaatgcagataatcagcttcatcgtttgaatttttattctttaacttatcagtcaactatttgaattttaaatctttattttaagtatattttggttattttttaccgtaatttatttttcagcattaacttttaaatcgctaagaacatgtatataaaaaatttaccaataaattatttttaatcgctaataaacattatggtttaatttcttttgtcggtgataaccttacatactatgactatgtgggatgtaagtgaccaacccgcgaaatccactgtagtaaatcaaaataaaccacgagcccgtttattttgacctataagtgggcttacgccgggttagccacttacgccccctgtatgtatgtgagcctgacaaactgttccgtttgttgatattcagagtgctacttcgcgctgaaggcgtggaacgcgcagcaggcgggcgcggcggcggtgctgatcgcggacaacgtggacgagcagctgctgacgatggacacgccggaggagtcgccggagacggagtacatcgaccggatcagcatcccgtccgcgctggtcaaccgcgcgttcggcgagtccctcaagaggatgtcgtcgccgtcgccgtcgtcaaaggcggcggtggaggtggtggtgaagctggactggcgcgagtcgatgccccaccccgacgagcgggtggagtacgagctgtggaccaacagcaacgacgagtgcggcgcccggtgcgacgagcagatggagttcgtccgcggcttccgcggccacgcccagatcatggagagaggtggctacgccctcttcaccccgcactacatcacctggtactgccccgaggccttcaagctcacccagcagtgcaagtcccagtgcatcaaccatggcaggcaagtgacttccttcgtttcagattataaatcgtttcgatttctttttttttaatcatacttccttcattttatattattattacgtcgttttcacttttcttatatccaaacttaaatttgattaagtttatagaaaaattagtaacatctacaacaccaaattggtttcactaaaactaacatttatgtatattgataatatttttcttttgtgtcggaaatgttgctaagttttctataaatttggttaaacttagactacttataatatgaagtacctcttttttaaaaaatattggacattgttactttttttttacaaacttttgaccattcattttattaaaaaaaattatgcaaataaaaaaaaggcaaaattggttatataacatcgaaagttcacgtttttggttttatagccccgaaagttaccggttcactttaagaacacccaaagttcaccatgttcccatttttaacacttccgtcaattctcgatcgttttccgtccgtcttgatccagccacacatacgatatgacgtttgtacccctcacaagtataagtataatgtatgtcaatgaggggtagaaatgtcatatcatgtgtgtggcgatcaataacgatcaagacggacggaaaaattgacggaagtgctaaaaataggaacatggtgaactttggatgctattaaagtgaaccggtaactttcggtgctataaaaccaaaaatgtgaactttcgatgctatataaccaattttgcctaaaaaaattaagacatgcttaattacaaaacatttgacgacaaattaagttacaatgaaataaatggtgattacatttttttttcaataaggtgtatgatcaaacacatataaaaaaaagttaacgacgtcatacactgaaaaactgaaaaacggaaagagtatcatagtatcctcttcttcgtctccggtggggacaccatcatgcgccatgaatcgatggagtggttgatcgagctccggtgaggatgggtgcgtgcaggtattgtgcgccggacccggagcaggatttcggggaggggtacgaggggaaggacgtggtggtggagaacctgaggcagctgtgcgtgcaccgggtggccaacgagaccgggcggccatgggcgtggtgggactacgtcatggactacaagatcaggtgctccatgaaggagaagaagtacagcaagggctgcgccgaggacgtcgtcaaggccctaggtgagaatgagatccatggtaccatacattcagtgtgcatatgctcatcgatcagttcatcgttcttcgttacttgctctaatttgccattacacgaaagacgcaccttgagtattatactccctccatcccaaaatgatcatcatatatgcttatgcatcaagatcaaggataatttaaattgcatcaatcaagacatcatatacacattctctcacaatgtatgtatcgattaaaacaccatatcaattacaccctagtatgtacagattctcccatgctatattaattgtattccgatgaaattcatgtccatgcaattatatgatgatcaatttaagaaaatttagatttctttatatgatgatcaatttaaaaaggagggagtattatgcatatcacacgcatgtaccttgagtatgtctacaaagatatagaggccagcaaaaagtacttaaattcactaatgggagtggtttatatttatgacgtcatattttttatcaaaaaatagttaaatcgtttcgtgtatcaaactaaagctgaattgaacacatcttactactataaatctggataaatatgaatactaggatgcgtcggttactatattttagaacggatgtagtatgtgcatatgtaacttttagaaaagatccactttcctaactccatattaaaaacatactgcatatgtaacttttccaaaagatccgctttcctaactccatattaaaaacatatgtgcaattgttcatatgtaacttttaaaaaagatccactttcctaactccgtattaaaaacatatccgcacatgcgtattatctgtagacactataatttgaatttggtgcttttataatagcaaatgttcttttgttcttgacctttttctttccttaggtctgtcgcttgacaaggtgctggaatgtatgggcgatccagaggccgacaccgacaacgccgtcttggccaaagagcaggaagatcaggtatatatgcaaagtgactgaaactatactgttcatggtgtcattaggagaagaattttttttagcgttttaatcttcaggtgtcagagatgttggccagtcacaatctcgcaggtctcttgcattacatgatgtgttaagccattaacgtcggtggttttggtgcctttgatcagattggccgtggatcgcgaggggatgtgaccatcttgcctactctcgtcatcaacaacgtccagtacagaggttggttggcacatctctttcgccaagaatgataattaagaacaaattagttacttgcaaacactgaagctgattagagattcctaacaacaataaaaatagctttctgtaataattaactgtagctctttgagtaaagacatagatgttacattccattattaaaaaaacaaaaatggttgtgaaaaatgaagggaaactggagaggacggccgtgctgaaagctgtctgtgccggcttcaaggagggcactgaacctcgcgtctgcttgagcaatggtgcgtagaaaacgcagagaaacatattgttttgtttcgtggaattctgaaaaattggaatgaaattctaatgaaatctctgttttcatttcttcaactgtagatatcgagacgaacgagtgcctgcacaggaacggcggttgctggagagacgagaaaaccaacgttacggcttgcaaggtactacatggttttatagattaattgtatcatctcgatgtaattgtctgatatcgataaagcttttttaatctgattttttctggcgtcgtgttcacaacaatacgcaggacacgttcaggggtagggtgtgcgagtgcccagtggtgaatggcgtccagtacgagggcgacgggtacatcggttgcaaaggtatagttgtcgataggccatgaaaatctgtaaaattcatgcattccaaaggaacctcgatttcaggctcaccatgttttgaattttaatgtaattgcatgtttgttctttttgtttcagctgttgggccaggcaggtgtacggtggacaacggaggctgctggtcagagactaggggtcatcagacgttctctgcttgctctgtaactctctagccttcacttgcagaaaaacctctcgttgtttgttatgatctttgctaatcactctctgcacaatttcataggacactgcattgactggatgccgatgccccccgggtttccaaggagatggccacaaatgtgaaggtaaacatatttctgaaacttctctgaagaaaaataacttctgaaactgacatattggcatacaattactactggactatcaagtgattgatgggctagtagtggtgggtgtagattaacagaactgatgaaatactgaacaaaattctgtgctccatgtgttaccctttcagatttggatgaatgcaaggagaagcttgcgtgcacttgccctaactgccactgcaagaacacctggggcaactacgagtgcaagtgcaagggcaaccagatctacataagaggagaggacacatgcataggtgataatacatcacataaaaatctactccctccatttcataatgcaagactttctagcatttacccacatttatatggatgttaatgaatctagacacacacgtgtctaaatttattaacatctatacgaatgtgagcaatgttaaaaagtcttatattatgaaacggatgaagatagttccaatttcatgtgacgatggcatgaaacactttgcttttcgacatgaaaatatgaaacatagctaaattttgggtttataatgcagccaacagcatgtcaaggttcggctggttcatcactatattggtggcgtcgtgcgtagccggcgtggggattgccggctatgtgttctacaagtacagactcagggtatgtttttttctaacaagaaaaggaatataattaaactgaaactgttgcaagtatgtgatgttgaaaaagaaaaatgtttgatgtgatttgtgcagtcgtacatggactcggagatcatggccatcatgtcccagtacatgccgcttgacagccagaacaacgagaaccaaccccttcgacagcatgattcagaggcttaaggtaactccagcaatttactcccaaccaatacaattgcacaattgtgccctaaatttaataccagataagctaataagtgatctcttaaaatgtctgtgatctagggacctggccatttgatggagaatttggttagctatataccttgtgaagagattgatacaaagatgggctatgagttcaagggaactagttatggtgatcccagaccatactcagcagatacttaagtgtgcttccaatgattttagcttcatttttgtatagtaaaagaaatggtttgtaccgagccacagtgattgagcaatagagaagtagctaggtaggcatttctgctctcatgtggaacgacatacaatacaatacacacagaatttttagaaaagaaaaatacaggtggcggtgtatcatagtcatagataaccatattaagaaaaatatggatggcggtgtatcaaaaaccataaaataaggtgtttctgtctatttggagttgttttggcatgctttcctgaaaacaccaggctcttgttttcagaaatccatgataagagagttgatcacttgctggttttcttgtgggctatgatatcggccgacggccaagtatctaataaaagattcttgatcagggccatgtggagtgatcataaaaccttcttcttcagtggcacttattgggcaggacattattaccagattaggttttgttggaaacatttccattacttgctaactgaaggagcactccctgcagagagctggccttgagcacaaaattccatctattgctagactaccccaaatataaaaatgaggcaggaatcagatcaaccccatggtcaattcaaaatatgaccagtcgatatagcaccttaagaacttaaaatattaacaaaaagggtaggggagttgcaatcagcgttgtttggatggcccaggaattgaagggctgagatcatagcagatctcatactagagcacccaagtaaacatctcccaaaagaaatgtacatgtttatcagtgattttatttatctaattagcataccaatacaaaggaaaagaagtgcacagactaaagaaaacctcacttttctcaaaatagaaaaaataaaccacaaaatcttcctggggctaagtgagatcttacaacagtgtatgggagttttctatttgtatagctctgaaacttcacgagcaaacttgtccatgaattggcatttcttgtcaaaaccccagcctggattgttctgcaaaagatataaggagaaacaagaacgaattcatctcaataagcagcaccttgtgtttcttcaaaggaaggtgaaacaaataggaatacataaacacactgaacagggtctccagacttctttttgtaatatgaatacaggtaaaaagttctaatggctatgaaaatattttatcaaacaagatgatgacaaccagtatggtaaattttgcacatgtgatgataacagaatctccaacatgtagagtacttcagtcaggtgaactagccaacttaaagcatgtgcacttcgccatctttgagagcaataggataagaaactatcaaatatatcatctcagatggcaagtgatgataaacacagacatgttatagaactagcttagtaagaccagaccacagggcatgtcagactacagagggactttatgccttgatggttggaacgaaccattaaattgtagatacattgcattaaaaaaagctaaattgatcatttgtgtagctagaattcaaatttcaaatgctaattgaatacagctctatttttgaaagcaagcttagaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaaaccttaagagacagtagagttttatcagtaaaccgctttactgaagagggtatatttcctgggagagtgttggccactctttgcagctcttcttcttgttgctttgcagttacaacatcagggccactgtacatatctatcagctccttcatatggggtgcccttgccattacatctttcacagcttcctattagtgatacggtacattatactgggtcagttgtatacatcaccaaaaaaaaaaaaactcattttagcagcaaggcgaatacagctgcaagttcaagcatgtactggttcatgtaatagtagaagcctatgagacaagtgtctaatgtggtgtcatacaggaatttccaaacagggacttaaagctgattagcagaaacatggaagcggaataatagatattcttttagttcaataagtccaggactgcaggaaatacataaaagctagaatgacccaatcctgttaaaatctctaatctaacgtagccaacagtccctctttacttggattttagaacaagttgaaacttatctggagattacagtttaacctcatcagaaaggagcaggcacaattactaagtaatcagctggacagcgttcatgcaacaaagataataaatcctttgtataaaccttatatccgctccatttgtaatgcataaatcagcttaccaaataacatgttctgaaaggtgaaacaacacaaaatctactaatatcattttcagcccgatctaggtatatcagtgcaaagctaggccaatctggctgtgaacatacttacgtaccacagcaatatgcatctgcaaactcattagaattatttctgaagcctcaatcaggctgaatgattattccaaacagggaacaagtctattaacatgctcgagttcatcagtttatttatgaaaacttgataatgcagctaggattctaatgccatccaactatagacttgcagcgttgcacccgttgagcatgctataatcctattgctggaaaaacaaagtatcatttacactatttatgcaggctttctccggcattttctaatgcaatctggttcctcaatgctgcaagagaacatatgtaccaaaacatctactcgcacaaacatttctgtggagaaaaataatatagtacaaggtccatcaaagaaatcacctcccattcctcctggttctggatgccctcatacgcaactatgaatggcttcaccttctgtagcatatcctccaatgacataggtggcttctcttcgatatctggattattgaaattcacatgatactctggctcaaactcgatctgcatacataaacccacaggaaacaaataattcaggaaccaagcataacggccagatct

SEQ ID NO: 37832 - DNA, 8901 bp, Oryza sativa
ttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggttaatgctgacactgcctacattttgctttcaggttgctagcatttttgttccaattgtcatcaccttgtccatgattacattccttgtatggtaagttcaacatatactaacacaatttttgagtgatactatgtttgaaacttcaatttttctgacatgtacattggctgcttttgtaggtttttatgtggatgggtgggagcatacccaaattcatggatttctggaactagcaactgctttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggaatggatcttggggatttcctcacattagtagcatctgcagaggtgaggttgaacttaagttgcttgtatggttcatatcaagctgtagtaaatgtgtttcggtattgtaactatgcttcatatgaatgtggtaatgccaaaatatgttttgctcctcagggttttagttaaaaaaaaagtgttttggtcttgttcatattgacttgtcaaaagtaaaaaaagttcttttgttttctactcaggcaagcagtgagcatcctctggcaaaagcaattgtggaatatgcattccatttccatttctttggcaagctccctacatcaaaagatggcattgaacaaagaaaagaagacagattatctcagttgctccttcaagttgaagacttctctgccttgcctggcaaaggagttcaatgcttgattaatgggaagagagttctggtgagtcacataagctaccataactcttccttgcccttcttgcagctgagttgaaaacagtgtacaagtctaacccatctactgctgtaccatttcttttaagcaaaccactgattatctagacataactgttttgcaggttggaaatcgtactttggttactgaaaatggtgtgaatgttcccccagaagctgaaaatttcttggtagacctggaactgaatgctaaaacaggcattcttgtgtcctatgacgatgattttgtgggtttaatggggataactgatcccctgaaaagagaggctgctgtagttgtggaaggactaaagaagatgggtgttcatcccgtgatgctcacaggtgacaactggagaaccgcaaaagccgttgcaaaggaggttagtctctaatctctattaccttccttgatccataatgttcatcatttacctgaacacctcttcatatacatgtctgcgattttctgctcttgcaggttggcattgaggacgtgagagccgaagtcatgcctgccggaaaagccgacgtggtccgctctctccaaaaggacgggagcatcgtcgccatggtcggggacggcatcaacgactcccctgcgctggcagcggccgacgtcgggatggccataggcggcggcaccgacatcgccatcgaggccgcggactacgtgctggtgaggaacaacctggaggacgtcatcacggcgatcgacctgttcaggaagacgttcaaacggatccggtggaactacttcttcgccatggtgtacaacgtggtcgccatcccggtcgccgcgggcgcgctgttccccttcacgaggctgcagatgccgccgtggctcgccggcgcctgcatggcgttctcctccgtcggcgtggtgtgctcctcgctgttgttgagaagatacagaaacccaagcctgacgaccatgttgcagataactgtagagtgacattggacgagtaaagagaaggtgtgttgacggctgttaagtaccaaattaaattcgtcaataccagcataagaccgtaaatataaaacatccaacatagtggtagagtttatttctaacaatttccacgagtgttggtgtatattcgtatgcaggtgacaaactacctaaattgagaagaaatatatatgaaagaggaggagaatcaaactcgtatccgaacttatggagttttggacccaaaaacctaattaaacacctccaaatgtgtcaaacattcataccaatggattgaggggaccaaaataagtgtccaggccgaaaaccggagcgaacatagccgtctcgggtttggtcgaaccctcacggaggccgttggcccaggcccaagttcagttcggtagaaatccgcttcccaattacggttatggccgttttcaccggtagaaaccgtcataagcatggacacttgtcaatacaaaagagaagatgctctttggatgcttggagcatctccatactcccaagacacttttctacctataaatacccctctcatcctcacttgtaaacagacatcaagatgtagagctgaattataagaggctctaagtatacttagggctctttatatgttctatagtatacttagaatagggagagagtaaagtagaaaaaattggaggaattccagagttgtcggtaatcctctcattattcttgtactttgttaattactccactttaatagaaatatcattctgagtaattaagatttgcttagtgagaattaattcttggttagttcctaattactatatgggatcattgttcactatggtctagtaatatgtagtgattgctttaatgcttggccaacgttagagtagtaattaattgcgtagacgcggtgtctggctaattaattttcagtgattactgtgtatctcacggtacgtaggtgggtgtagaggtggtgacaaccctcaagagcacttaagtcctccacagtacgtaggtgggtgtagaggtggtgacaacctcaagagcacttaagtcctcgtccggtacgtattagagcgacatctggaaatagcgggttgacagttcctgaagtatcgtgttaggattaaaattaatctttctatagacactgtttttcacttgaaaatcctctctaccatttgcatatgtttgctttgtgtccttggatgaaattggagaagagctgagcacacacgttccttgtggaaatcgatactcggaatactgaatactgaagctacatcggtattctccgtgtgcttgtagattttatttgtgacgttaagaaataccaacaacaatctcgtttaccatgtacgcggattcgaggctacttcaaagttaatgtcagggatattcacttgataactcggtttatggccaatgggtttcctttaattggtaatatcccctttacatctttgtttacatttctgaatgatggcgaaatatattatcctccaatgctagatgcacattatcactcggtagtgttgattggttcagagattggaatcaacaatggaaaatcatcaacattctatgtagttagagacagttttggattcattcactgcagctaccaccttcaaaactatggcgcactactagtttatttgtgacttgtcttaaattcttattatccagtttagtaggtggacctatctttgttcttatgacgaagcgtcaaatctatgtatgcaattatatttgtggagttttgattctcatcatggaggctcaaatctatgtatccagtgtaatgtattagtgtagtatttgtgaacttgttctcttgttatggatgaaagagacattatccttaatttatcgatttatgtatccaatccagtatttgtgttatttcttttattttcattatgaacgaaatagttatcaatttatgcatccaatccagtatttgtgttatttcttttattttcattatgaacgaaatagttagtattgttctggacatgttcgtgcgacggaaaaaataattacattacttgcttcaaataatttgttgcgtgcatgctggaacacattgggcatattttctttttaattaagtactacactaattactactagtaatcgtattgcacgtttcccataatatataagcatactcaaagtttaatgcattgattttccaatgatatgtatatcacacgacatatacaaagtactaaaagtataaaattgtctcaaaatagtactctagtaaataacatttacatgatcaacaataatattctatcgtgtgaccagtagaaatttatatggtaagcaaaccatagaggtttatatctcagttactttcaagacattaattgtcacgtaatagtactctagtaaattgttatcggaatagtactcggtgtagttgccttaactgcagtgaacagaaggaaatgtcgagtgtgaacatgctggaaacgtcttaaaaattgaaatggcaactctgtatttctggtatggacttacagtgtatcccgtgaacatgtccaaactatattagttgagcactggaagggatttcacactgcacatgtccatcatcctagcagttgcaacccctcctaacgaaagaaaaataattcaataaggaaaaacttatcaaaggccaatgattttgaacccatcccttcgtccaaagaaaccccttctagttgtgattctaagttatttcactctacaagtaaagtgatattcaaatgagaacacatcatatatacatatattatttgtatcacaatactccacataaacttttgattgctgagaaaaatagcaattcaaaatagcatcctcaagcattcatatcatcaaagatcttgtaaaatgtgaggcacatgattttctagtagcagattagaatagaaaaataatatgaaaaacatgaattatttaaaaattacaactctgacaaaatgaagaactaatgaatgcattgaattccctcaaatctggacctaactacataacctaacagcacaggaatcaacacttcagggtatttatggcctaaacagaattcacatgacaccaattgttgggaggaattattccttaatgaaaattcaaaaatgatgaggaaaaagagcaccctctctttgaccatcgcctgtacatcgcaatgtttcatcatcaaccatccataaatcaagactattgataccatacatcagttgtcctcacacacatgatgtaaaattgtatctttgttaaaaaaaagtgtacatgttagtttggcaaggtaaaaaagtatcttgcagtgctttatagggaaacaaagaaaaatggagaaaaaaaagctacaattgacagttttttagaaatattgtgaattgaagaaaatcataaagttctacacgatttatatcaattaagtagactaaatacacattattcttgttctccatgaactacagtgtagtatacatgtcaataccaataaacatttgcactaaaattgacacatcgacactcaagaggtgtactaagccatttaggaacttcaagtgacaccctttctcaccttttcttttcgtttcctgattgcaacctttgcatagttggatttgttcaaaacattagtctagaccagatcaagagagccccagatggttcattgtaatgccatcgaatatattcaagtcatctaggctcctgtcatcgttgaacacctaacatccaatttatgcttcagaataatagaattcgaacacctgacatccaatttatgcttcaaaacaatagaattctcttggtcaccgtttctgcaagcacaaccttagagcagaatgattcagcaatttcactttaaaaaaataaaaaaaaaagtcctcgagctatttaaagtgtaatataagctcaatagtgtacagcgatcgcaggcttcagatttaacacgctatggacttttttgtattccacgttgaatttctaatcctacttgcgttatacttgaaaaatacgggaaataaaatttaagaattgctaaaagttgtttgacaacacaaagaaaaagttaggccctaattagcacatctatatcttgtatgacataacttaaaagtacatctatatcttgcaaacgatacatagtttgtcctttaaatagtcagtgtaccctaagcaagcaaatattccactaatttcctcacttgtcgcatagcacaatactcagtgtacccaaatctaaattggattcgacaataatcatatgtgtattccttagattacaaaataaatatcaaaaaagaagaccatttaactgaagatataaaaaagaactgcttcaatccaaggagctaaagctttttttttttcctttcaaaactctgtagaaactgcttccatctatgcatataaatcttttcacagatgaatacggaaacaaagatttaaacatgttcatgccctctcgacgggaggtaatactctactcttgtttgaggattgtatccgtcaaatattgtatttgatcaaatgatcttgttttggccaatgccctaagaggggtcccagctctgtttatatgggttgggggtatgtgttgcaagtagaaaatctagccaaactcgaccgaagcttccttaataaatattacaaaagaaaacccaaatagggatatagaatcgtaccttctcgcagttgtggcccaccttctgatagcagtcagatataaaggctatatgtaggtatcccatatctataatctccatgtgttctaataaatatgtgccataataagatgctaaaatgatgattttcaattatatccgtatacaagttaaagcctgaacttaatggaaaatgaactaatcctaccaaaatcttgcaaagtttctacattcctaaacaggctacgaaagtgtcgaccaaagtctgtctgcagtagatcttggtgtcatactttgctaactggccaaccctgatcaaggtagctagtacgaagagcaaaatacaacacacatacgcacacatggttagaacagaactactggttgagctgacaagtaattaccaaaagctattcaggaaagtattggacacgtgatggctgccactgttacgcatcagtccatcaccagatttcacaacccacggagaagaccgccatgccttgtattgtcgattggagactttcttaatgtatctgaaatccggctcaaaagtagcatgggttcaagattctatctgcaatgtttggatacaatgcgcctaaggctctgtttagttccctagcaaaaattttataccctatcatatcgaatgtttggacacatgtatagagtgccaaatataaacgaaaaaataattaattatacggattgcgtgtaaattgcgagacgaatcttttaaacctaattgcgccatgatttgataatatggtgctacagtaaacatttgctaatgatagtttaattaggcttaataaattcgtctcgcggtttacatgcgaattctataattatttttgttattagactacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatatatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaataaaacacttgcaattagggcactaaccatttatgatgcaaatgtcagtaaat

SEQ ID NO: 37833 - DNA, 10053 bp, Oryza sativa
tttcatcgaacaccatgaatgcacagttcgcactacaaaacagcaaccacacgtttagggaaataaatggaacaaacagtgcactgtagcttgctcaccaccgctggcccatggccacgaccgataagcgcggccttcacggcctcgagcggaggccagcagtggggccaaccaccgcggcacgcccggcggcatagtaggagtaggacgcggttgacgacgcagggaaggggcgggcagtgggcgaaaagccggctggccggcgcacgcgcagggtggccgcattggctggcgcctcagcaacgacgatcgtggaaggaggtggcatcttacaggtaggggtgggcattcggttttaccgaaaaattcggtctcggttttcggtttttcggtcagttcggtctttgaaaactcaggaccaaatttcatcaaaaaaatctcaggatcagcaaattcagtctcggtctcggtcttaccaaaatttttcaggagtaagtttggaatgaaaaaatttgacagaggcggcgctggcgcgatggaggacggaggcgtcgccaacgcggtggagggcggaggcggcagcggcgcggtggaggacggtggcggcggcggcggcgcggtggaggcagtcaggcggaggccaagcgcgatgggagtgcggcaatggtagggttgtatcatttctagggtttgttttagtgggcttattgggtttcctaggcctattgggctaaaatttcggtcattttggttaaccgagcccaataaccgaaatgaccgaaataattcggtctttcgagggctgggaccgaacagataaccgaatttctcagtgttggtctcggtctttttggttcacttcttcggttcggtctaaatatgcccacccatacttacaggcgaggggtggctctggtgcggacgtgcggcaagggaggctccgaacggatcgacgagggacggtactgatgcagagcagcacgctggagacagcccgcgaatagtcggtgaagggacgactatttctttgcaaggcttcaccatatctaccgttggttcctaatccaatggatgtgtgtgcaaattaaaccctggaatcggcagccacgtggcgcactaatcacccgagatggtgcgtggaattcggtataagagattgagctcaagctctgtctctacttcctccttcacgatccttgcagaggctagccggagcaccgcatccgcttcattcactgagctcgcatttatcccctccaccgagctttgcacccctaagcttaaccacctcgtcaagtttgagagcggcggtcagccaagcagagaaggcggtgctagagctcgacagagcagtgacactcttggcatagaggagggcggcgaagagcgctggagtcgagaggatggtcactagcgtagctcacgccatcctccaccacactgatagttcgacgcccaccgaagtcattgccaccaccgctatcggctcgaatcgagtatgagcccaagcggcagtggtgcgtccatcgggtttccttggaggttcagagaggatactgatggcaacgtctttaaaagaagtccacactcggcatcagtaatcaatgcatagattgaatagggagggaaatggagaagagaagggagagagaaagcaagatggtggtcaatggcaagtggactctgtaattttttttttaggatttttcttattggatagccacatcaacatcatgcaggtgaaatccgccttggtttggcctaagcagggtaaggtaaatggtattaaaaagctaaggaggtgtcgatacacgattttaaagttgaaaggtgaactttaaacaaaatgaagaattcaggagatcaaattaatggactaatccctgaacactaattccatcgagggattaacatcctagtccaaagttcttctctggacttggactagtgcctggcttgctagctgccctgcctgagctcgtgagcacatagcaaagagaaatgtcacatatatggcacgtcatcagtatcggacaatgctggccacttgtcatagtgcttttcattgagactttaagaagtttctactccctccgtcaaaaaaaaaacaaatccgagttttcgtgttcaacgtttgactgttcgtcttatttaaaaaaattataaaaaaaattaaaaagataagtcacacataaattattaatcatgttttatcatctaacaataatgaaaatactaattataaaaaaatttcatataagacggacagtcaaacgttggacacggaaaccagggtttgtcttttttttttttggacggagggagtatgtcagtattgactagtggctattggtgacgaagaagacacaagcaaactgtaaacaacacatacagagaagaaagttgtaggcgatttttaattttcgctatgattcgatgatagtgtcatgaactcatgataaaaggcacacgatagtgtcaaaagggcaagagaaatgccacatgtcacatcatcggtactataggggtttgggccatcggtgactcggtgctgcaaaagacaaaccatttgtaatgttctctgatcatgatagcactgaatataccaaaaaaaaaaacgtggttcagctaatgcagacatgaaaaggtcacatttacgatcgatcgtgtcatcgatcactacgtacggtgcattcttaaccattggccatgcattattgtactaacttgcctagttaggacttaattttgctccattatacagtgcaattcttgcgtggaagcataataatctcaccttttgcggctaatagtcagagattcttacacaaaacgtatcgattatcatcattatcactttaaccattcatcgaaaaaacttcaatcagcacagcacttattgtttttaagataataaaaatggtttacattttcggactctatcgacagagaaacaaccaataaattaaaataattatatagagtgattggacatgttgcattgaaagttaagataaatagaatatattttagtaattaattatataggtactatgctatccaaaacgaaataaaaggctacaacctccaagagtatagcaccacagtgtatagtatcttactatttttgtgctagcatcaaagataagtgtgaagccagatgagagacctgaagataacctgcatatagcctattttctattataaaaactttatcattttagtaataccaattaatttaccaatattatgcaccagcttcaaatggaactagttttcttgacctggacatcccccacaagtcaattcgcaattatatttttgccacaagtcaattcacaattatattttttgcaccatggagaggaggacttttcaaagcaaataagatacatcgccaagcaaattgctcaatatgacattcaaagaaatggtattgaattgtctcttgcacattagaaaacaattttgcttatcaccccttaatccccttttgcaaggttatcctttgataaaagattaattacttgaccaatattatgcattggcttcgaataaagccaattttcttgaccgggacatcccccataagtcaattcacaattatatttttggcactgtggggaggacgtttgaaagcaaataagatacattgccaagtcaagcaaatcgatctatgtgacattcaaagaaatggtattgaattgtctcttgcacattagaaaacaattttgcttatcgccccctagttcctctttgcaaggttatcatttgttaaaaaattaattacttcttatgaaagaaccacataaacattttgatgatttttagtggcaccttcgtcttctataatattgccttgcggcgcatgatcgtagtgaacattactatatcataagattgagtgaacattggttatttttatgcctcaatcgaataaagcaatcatttttatttgaaaatgttatattagctagccaggtacgtatcaaatcatctccttcgactagcttgggaccaataattatcaacatttagtgatattgtgccataacattgattccttccggctacgttacataaataacgtatttatcttttggaggatatgttcaatcaacacagcactcatggattttagtgatggcatgcaaatggttctttttggaaaagataaacaatgaagagaataaatgtaaagaaccagatttgattataaatatgcggccggattttgcatatgtaagcagcagatcatcagaattcagagctaatgcattaatccatcatccacactcgtgagggctgtcaggtgcccatctgacgccacgtacgtccaaccagcgcgtttcatgctctgcacaaactagtactccctccgtctcctaatacaagagaatttgatattttgctggtactgtttgaccactcatcttatttaaaaaatttatataaatatacaacataaaaagttatatttaaagtacttttgataataaagtaagtcgaaaaaaataataattgtaaaaattcttgaataagacgatggttaaacagtgtaaacaaagagtcaaaatccgttatattaaagaacggaggggcggaaaaaagagagcaatagtttgattgttattcatgtactccctccgtaaaaaaaaaaaaagaggatgtgaccactcttaggagtataaatctggactatcctttgtccagatttgttgtcctaggttgagtttttttttgacagagaaagtactccatccgttttaggttacaagtcgttttgactctagttaaagttaaatcgcttcaaatttgaccaaatttatagaaaaaaacagttacatttttaacccaagacaaatttattataaaaatatatttaattatcgatttaagaaaataatttggtattgtaaatatactatatttgtttataaagttagttaaatttgaagtagtttgactttgaccaaagtcaaaacgacttataatatgaaacgaagggagtatcgttttgtttattaggtgaaagatgcatatacaaaactattctcaagcatttcacgtgcctttttatcgtgcatttaatgtgacaaaaatcaacggcaaaaaaccctacatcaataaaattatattaaaaatgcacatgtctaagtagtactgtatatatttgtgaagaacaagattcaagtgatacttgtgaacgccaaattaagttttgaaattgatggcatatggttccacatcacaccactggtgcttattaattaactaaacgatcgatcgctatcattggctgattttcgtgaaatcaacatttgtccccccgccaaatattggtaattaagtgtgaattgagcataaagttaaaagtgccaccttttcaaatgtggtaacaacacttttattggagccatttattttctccgcaaaaattttacttcgttacaaataaggccttagcatgttatggttgatgggactagggactgtttaagtaattttagattatgagaatcaactaatgggaattcagatggtagaaatctagaaaaattggaaaaaaaacatcttctgacttatagtgaatttcctggattttaatttctttatgattaaattgattgtaagagatgccgcagcggctaaagacaccctaaatagcttgtagatattaagatacacatctagattcatgatgtatcacttctggtggaggcctaggatacaagcttcatgcaaattctatacaattttttgagagaaaaaagcttggattttacatatagaaccagggcaagatgacataacttagttgtaggcgtgtcttcaagctgactccataatttgagtacatatataatagtctagtttagtatacgtgctatgtatatcctatcggttcattctactttacatgcgagtggtggtcgatcgagcagagaaacttgtgggttcgtccattcttatccgtcctcagattcagcctaaagctcttggcccgtcacactcaacctattgatctgaatatttggcacaagtaactaacacttgaacccaccaataaatcaaaataaataaatttacaatttattctaaactacaaataagttaacggtttagccgcacaccgttaaagccgctttttgggtctcctcacgcaccaggctgcacttgagcggcagaatccaaccccaacacgtccatctctccctcgatcacttggtgaaaaagttttttttgtgtcgcattaaatatacggacacgctaaaatattaaacatagtctaataataaaatatattatatattccttctgtaaactgcgagacgaatttattgaagcaccatattatcaaattatggtgtaattaagcttaaaagattcatctcgcaattagtttttctattatatttaatacttcatgtatatatccaaaattttctgttcgagaactaaacggcataagataagctagttgcatgcaccacggcgtccacccgtggaccggccccacaccatcctcgtgggcccgcttgtcagtgacgttacgggagctacaacttgggtagtcgcttgctgggtttgttgttgttgggggactcgctggattccagattctgttcggctggatagcgacggccaccgttttgcgaccaccaccagattctctgcgcgccactcctacctacgatcgacttgtgtggatctcttctacttttcgagttttgtcccgtgtgtgtgcaatgcattgcacctgcatggtcagccagccgcatcatccgcccgtacacgtgtcctgcatcgacggcgcagacggtctgtccagaaaggtcgtcagctcagggcacttccgtgatgcaagggcactgtgtgttgccaaacggaatcccttcagttcgctccttttcttttcttttcttttcctttttctataattttccttgctttcaccattgctctcaaatctggctccgttcatgccatgcatactctcctcctttcgtgtcactaaaagatacgaaatgttacacattattagaatctgaataggtactaaatgtatcatattttatattggacttatttcaccaagagagtaattattgggaaggttttacagaagcagatttggcaagaggctcatatatgcattgagatcctctgcctctaaagatatcgtgccattatcattctcatataggatatcttatagtattacgaatataaacaggctatcattccgaattcgtagtcctaacaaatatcccattcaattataggttctatattttgaaacggatgagtatattcaaggttcatcggacccacgtgtcagctgattgcttattcttatattataagacagatgaggacctgtttggtagaactctaactcctaaatttaacttcagaagttagttatggagtggagttgtggagctgcctaaacctagcttcacttctttagtttattttgtgagagagctacacctagcttcgcttctatttttggtggagctgaaactgtagatgtgcccggagtatattcagggttcatcggacccacgcgacagctgacggcttcaagggctctcgtgggaaattgagggtgctataaaagcagccgccatgagccacagccacacccgctgtgggaagggaagagccagagaggccacacacacacaagcacaacacaaaagtggccatggctctcctcctctcctaccccaggcgccacccatccatccacctcttcatcctctccgcctacgccctcttcctcctcccaatcttgggtgggtcttggttcttggatcatccacttcattgccatctatcagaaattgcttcttctttctgattttgtttctttgtttgtgatggatgtttttttgtggtgtctgattgttagatggattggagctgggaggagatgggctctacagggagatcctcagggatgagacggtgctcaggctcaaagaacttggcaaggtcaggttcttcatgtcgttggaatattcagttctttgatccactttttaaggggaatctcgtccggattgtatagattgtttgggctcctgcatgctgctacctctgtttgttgctaattcagatagcttcataattggaaatataaattaattctaggtgttatatgtggacagctattgacacccaaatgaccatatataggtttaaaaaaatatctgtggggttcatgtgtgtacacttctttgttcatcagatgaacagtgtaaatttcatttttaggatacaatttcactctttcctcggagagaatacaatttcattttgtataacttaccagtacagaccatatcaagacagctagctgcaggctactcgaaaattatgcaaaaggattgcaaatatattctaggcttctcatctcttcttttttggggtgaatttcattttactaggcgttaaagcatcaaacttttgtaaggcttttgttccttttctctattagttatgtttattggtcattccaaagaatcatatccatctcctgtattcgggtgagatgaccttacgctatgaaggttgctcaatttttacgttctccaggttgaatattaaatatatataaaccgaacaaaatcctggtttcaaagatccgtgctgcaccctatttttactctatttgctaacaagttagccatgcagtcctaacacggcgtcgttttgtgtgaatcagatatctgatggggaaggtaccttgagaggacatttttgagtcctgcctcaatcagagcctctgctgtcattatcagctggatgaaagatgccggacttaccacgtagatttttcttctcttgtttatactgcagtcattttctcaaactttgacctttgctgaccaatatatgccttatattaaggtggattgatcaaatggggaatattcatggtcgatttgaaccgaccaactcaaccaaggaggccttgttgatcggatctcacatggtgagaaatagatatatcttttcatactgtcgcacatcttctagttaaataaaatcactgataaaaaaaataaatcttgtttttttttggggggaaaacaggacactgttattgatgctggcatgtatgacggagctttgggtattatctctgcaatctctgctttgaaggttttgaaagttactgggagacttcagagacttactagaccagtagaggttagataaaaattaattaccctagataaaatgttttcatcagtgtgctagtgatgttactactttatcatcatagtttgtttctttcataagaatatatgtattgggttacattagtcgctatcctactccttactagttgcatgatgagtcacatgtgtcctacaaataagacatttatctgcacataacttgtctctgtcttgtgtattttactagtatcttagtatgtgtcatccacatcatcgatctcgtgttgatttaaattagcatagtaggtttcaaagaacgtgaatgggctgctatcacaatagattatcagaaagactacagatatagacatatttaatccaggatgaatccattatataatgtctctttactcagttggctgtttccctgcttatgtagagaagaacctataccttattctgatatctataattcataaagctgttgggcctcacggttgcctggtaaacctcaggtgattgcattcagcgatgaggagggtgttagattccaaacaacttttctgggaagcgccgctgtagctggtacactacctgaatcaattttacaagtatctgacaagaggttgtcttttttcgcataaatcaaccgaactgttttttgaaattgtttgctgattcagtatatattttgcattcaacttcttcagtggcacgacagttcaagatgtcctaaagctgaattctcttgagggcactgctaatgctcttggtgaagtaaggtacagcccggagtctgtcgggagttatgtcgaggtatacaagactgtattattttaatctaggtgtataacag

SEQ ID NO: 37834 - DNA, 9586 bp, Oryza sativa
  unsure (1)..(9586): unsure at all n locations
aggttgtcttttttcgcataaatcaaccgaactgttttttgaaattgtttgctgattcagtatatattttgcattcaacttcttcagtggcacgacagttcaagatgtcctaaagctgaattctcttgagggcactgctaatgctcttggtgaagtaaggtacagccgggagtctgtcgggagttatgtcgaggtatacaagactgtattattttaatctaggtgtataacagatataagaaatttagcatttaccattctttttcattactattttggttaggttcacattgaacaagggcctgtcctggaagcccttcgttatccgcttggtgttgtaaaaggaattgcaggacagacgcgattaaaggtgcaatcactttctagttaatacttttttggtcaagagtaagcggtgacacttatagaactatatatgtgagccaaaacaaaaatatgacttgtttctgaaaacaaaactaaaagatgaccaggtagcattgcatactaaatttagaccaacttttccaaacaattggcatgctaaaatgaccaggacctagtaaacaatcaagtaagcaattatattgctggtcattctttagcaaagaatgtcagtgctcgaagtcaacgctgaggtcaggtactattaatcagtgacaactgaagaactttattagtacttcacaagattctcgtttaacaaactattttgaaagactgcaccagcgtagagttggtacttgcaaatcaagtaaaatgttatagcatgagctttctttaataaacagtgataaccagcttagctgactatcaccaaggttgatgtttgatattgttctgaattatccaaatccgttaatctcagtgtgattttagcatgagcagtgcttccttacactacaaaaactaattaaactagttttcaatctcgatgcccacagtaacagattagtaggtgctggccaaaatataatcgatcaaacaagctgggcttgctttcaactgccattgcttagcaactttctggtttctttaggtaattataaatggttcacaagggcatgctggcacggttccaatgaaattgcgccgtgatccgatggttgcagctgcagagctcgtcctgacactggagacgctctgcaaagaacccaacaagttcctcacctacgacgaggaatgcggctgcttcactgaggaatccctcgccggactcgtctgcaccgtcggcgagctcctgacatggcccagcgccagcaacgtcataccaggccaggtaatgtaatgtataattcagcttgatcattgctggtgatgatgcttccaggtaagctaagctggctctgctgaagcttttggagtttggtgatcttatgcaggtgaacttcacggtggacatacgcgccatggacgacaaggtgagggagacgatcgtcaccagcttctcgaggcttgttcttcagagatgcgacgacagattggtcgactgcgccgtcgagcagaaggtgccaagaaaccgaagcatttcgcttgtgatttcgcgatgttttttttgttttgcaggtggtctggtgttaaaactgcggattggttggtgtttgtttttttgcagcacgcggcggcggcgacgccgtgcgacgcggagctgacgtcgcggctggagcgcgcgacgcggtcgacgatctcgtcgatggcgccgggcgtgcgccgggccgccggcaagacgccggtgctgatgagcggagcggggcacgacgcgatggcgatggcgaggctgacgaaggtggggatgctgttcgtgcggtgccgcggcggcgtgagccactcgccggaggagtccgtgatggacgacgacgtctgggccgccggcctcgcgctggtcaacttcattgaccagaacgcggtggatgcggcggcggcgacggcggcggaatcgtgacgacgacggcggcgattcttttggtaggtgtgtgcctagtagcctacaaattgtaaatatggatttgcttgttacatttgtcaagaaataaaattgaattcaattcgttgagacgttcagtactgcttatctttattttatattttatggttgcagttactctaagttcaagttcttaagtttaactctctatagaatcgaatttcagactgcattatttgaaaggctaagtttacaattgggaggctgcatatatttaattggatgtagatgctagataaaaagtaccattctcagagaaaaataataattttatcttttttaatgttttttcgttatttttgagtgagaatcgtgctgcatcacgccatcaatactgtaactgacgagttggcccaacagatatagaacgtaagtttgccatcaatcccgttccagcccaaccaaatatatataggcccaaaatggttccgagtgccgctccggcccaatatatatgagcgtcacgtagatcgtactccctctattctaaattgatctacatatttcatagttacaacgagatcaagaaaagctaataactttctcatactatatttaaaagctaataactttctcatactatatttactctagcaacaaactcgatgcatgcaccatccctattatttcctagccaatagcaaatcaagatattacatgtgggttataaatacttatgtgtatggatgcatgcatcaatatacatttactccaatgcataaataacgaatagacttaataaatgaatataaatatgtagatcatttagaaataaactaaaaaaaatatatgtaaatcaatttggaatggagggagtagtcccgttccggcccaaatagtatgggccgtacgtagctgattccttttacggcctgcgaggtgtacgtgaagcagccgcgtcgagatccaaaacgccaactaacgtgtgggcccgaggttgttggggcccacatggcagtgaaccgtattgggccgggaggaaggagcggacggggctaatgttggatggcacgaggcccaagtttgctagccgaacggataaaagaagtgaaataccggctttggcatggcagtgggtaatatgagtatacactaatacgaaatagtagtagtagtagtagtaaatgataataagattattagatagcacacatcgagagtactagtgatatgaactagtgtgtgtgtatatatatatacacactgcagctggttagtatactactccctcaattacaacattaaagttttgtcctgaatcaaacttcgacctctaattttaaccgagtttaatagacaaaactaaatatctataaacatcaacagttttattaaatccactacaaatatcatcatagttaggatttcatccattccattttgttaatcctattacattttaacggaaagaaaacaacggaaccctaacagtgataacatttctaggaaaaattgattcatgcgatggtatttcttgaaagttacattcgtcgatggtattttttttggaataaaacacttagtttgtcaatgcatggcatttgtccgattttcttctttctatatactcgggagatatttgactttagacataactaaaatgacttattatgtaaaatgatttataatgtgaaacaaaagagagtattattttgttttccattttacatggtctctagtaattaatcctattatggcgtgtgtacaaggcagggatgtggcgagtggcttcgctaggccccattggagccaggtggctcaccagcttggttgcaatcgtgccccatagagggcacggttgagttgcagggctgaggcaaccacgctcgaagtacggatcacgagtcgttacatgttgggcaaggccgtggcctcgtgacgcatgcccctgcgtgttaactaggctagatttgacaaaaggtggtggtgcgatggatgaggttgaagaagataacaagtgcggtgggaaggaagagaagaggacactaccaccacggacaccgtcgagttcatcactacatctgcggatgctgctcaccttgatttgctcattgccaggtggcgctgccttgatctgcaccattgagattgctgttcaatctttgctcgccgatgagggaggagaagaggggccgacttgatctaccagacgcaccgtcgatgtcggatcccaatctctgccgaggttgagcttgccaccaccacctagctcctccctcgttcccacatgtcgtcatagagcttcttctccattaactcgtgaaagagatggcagcaaagagagggtgtgctgagctcctcaccaattctgcaacaaggaataagggatagcggcgaggagggtccgagggtgccacgacagggaaggaggagagtacaactccatcggcgcatgggaggagaggtcctcaccggttctttgaggacaggctatgggggagagagagtgagaaacaccgcaactgggagtggagaggagatggatgaggattttttatattattttctcggttttaggatatgtttagtatacaattttatatttttatgtaaaatgaataaaatatgagtgaaatagaaagcatcaggggctaaaatgaatgaaaaaatgaaaccacgttgtattatatgcaaaaatcactgctgggggaatcatctttagtcccagtttgcaacctcctttagtcctggattgcaaaccgggacgcccaatccaggactaaagctgccccatctttagtcctggttgaaataaccgggactaataaatgtttttttcttttttttcattgttatttttgctacttgcatattgatttcgaaccgaactcaacaacaaaatcatccacattcacaaaaacatcataaaaccatccacaaattcacagatcgaatgaacatactcaaattgacatcacaaactcacagatccacagaatgaacaaattcacatcacaatttcacagatccacaaaatgaacaaattcgcagacatcacaaatgaacaaattcatagacatcacaaatgctgcacgcctccaagtccgtcgccccacatggtgccagcaatcacgctcgcgccgtcgctccaccgctacacaggccgccgtagccagccacctcccctcccaccggatccggcggaggggagggcgctgctgccacccgtcgcctcctcttgcgccgccacctaccgcctaccgcctaccgtcccaccagatctagcgggaggggagggcgctgccgccacccgctcgccggcttgctcgctcattcgctccttgctactactgcacgaaaaggagaggataagggagagggaagagagagagaggagagaggaggaacaaatgaggaggaggagaggataagtgcaagggattatatacggcgcgtcgatctttagtcccagttggtcggttgatgacaccagccgggactaaagatagtgaggggcctgacattttttgaaccgggactaaaaatcatttttagtcccggttgatttatataagtgtcgttgtgcttttgaaccaaagctaaaggtcttatttagtctcgattcctattcgaaccggaactaatgtgatttttatcattcgaacaaagatcacttttccagcagtgaaccagctcagattttagaccggtgacctcaacttaattggcactgtcactgatgcctccatttttcatgtccttatggttccatgcatgcaatgctagtaggaaggttctgcatgcatccctagaagaggccacacagctgctgggactgtaagctgcctgtgagggtaattgtactcctacactactatagtcaaggcaagaaggatggcatgaaggactaacatacaacaatacacagacccaaatcatacaaccatgtgacccaaaaaaaaaagattccccttcttttgtaataaccaaataaaggtttctctcctcctaccaatgcaaatatactccctccatcggtccatcccataataaatttatttttaagctccttttgtatatcctaaaataccttttaagtaatcattataccaaagtttataaaagtagaagataaacatattgggagtagataaagtatgagtaattgtattaagatttaataaaataaggatatttttaatttttcaaaattttattggtagatgtatgtaggattagtaagaaataaacttattttggaaccaagaaaggacttatacttgttacatgcatggccgccggactcgtggaagattaaattttctgccgtggcaacggagcaaagcaaaagatacactgtacggttactgtaccctacacgtatcatgcacctggctggaaatcgaggcacgtcgtacagtacagtacaagtacaagtattcgctgacatactacgtgtagagatcagtacttgtactagctaactacttactccctccttcccataatataagggattttgagttataagggattttgagtttttgtttgtattgtttgatcactcgtcttattcaaaaaaaattgtgcaaatatgaaaaacgaaaagttacgtttaaaatactttgtataataacgtaagtcaaaaaaaataatttcaaaattttttgaataagacgagtggtcaaacagtgcaagtaaaaactcaaaatcccttatattataggacggagggagtagtagcttcctcttgtgcatatgaatgcgtatgtattgctgcagcatatatacagcctcgtacgctacgagtagttcgtactagtatagagatgcagatcgatcgatgcatgcttgtacgtataaacttaataaaggtgaagtgacttggaagatttaattttggacgcgatttgaaagagagagagcgaaaaaaaattgaagtttggccagtagatcgatcgagctagctatactccgtaattataagtacgacgtactccgtacagacgacgcgcacggtagatatcgctagatcgagaagcaagatggtgcgcactatactactactctgtgtaccgctaccacagctttgtgccaaccctgctcttgttaaacgattggggacttccagataatacacaaatggtactgttatatcatgtttataattatataattagttgagtttgacaaaagctttcattgtattaaaaaaggagtaattacatatgttgatggtatataaacttggtgtaataacttagtttccgaacttataataggctagcttgttatgatacacaaacttatctagtgtgtgtaatccaggttcaaaacaacatattataactgattatgttgagttattaggacacccacgatgtgagaacatgggtggggtattctgatatcaaaatataccttagagcaagtttaatagtatagccaacagctagctctaaattatctatagttaatcttatagcctatttatacaatagttaattataaaaatatactacattattaatattcggttccacctatcatacacataatattttagagtgcgtgttgtaactggctacaaatctgtagctcgctttcttctctcttttcttttttcttctcgatatatggttatagctggcttatagcctgctattgtacctgctcttatatattgttagggtcatagagtggtttctagatacgggtgtccatatgattatagcctgccctcaaggcattaaaaaatgaaaaataactcccttctctcactgaccaagagaaaagaagagacgaagggagagagaaaaaaacgattttcttttaaaagtgtgggttccatcttaattaggttggtcccaccttaacatcatcgtactacatatacactgctaaatcatcatccaatattttagacgacattagagaatcaaaatccatcgcaccatcagttgtatatactccctccgtccggatcacgagtttttgtttgtattgtttcaccactcgacttattaaaaattttttggaattattatttatttttttacttattttattatccaaagtacttaaagcacaacttttcgttttttatatttgcacaaattttttgaataagaagagtggtcaaacagtgcaagtaaaaactcaaaataccttatattatgtgacggagggagtacatgggactctatccgtgccaaaatacagcaacttttagcacttagtaggatttgtctcaaaatataataagttatccaccaacattcccttcccaatcaatcacaaccctccactattcactttttctacctacctctacttctcaactaatcataacccctcctatttaattatacctattttcttaataatcgtgtccaactctaaaactctctgtattatatgtatgataagactgagggagtaagttgataactcttttgaaggcattagttattcattgtatttcaccgtggtgaatctttcaaagaactcgggggttgattgttccaggtggtgtgtcaccagtgtttacaatactgtgtggtaaccttttcagctttttaaaccgcggtatatctcacggtagctatacagttttcacggtaaccgcaccagttaccgcgataacctccaaactatggggtgacgggaaccctactatcacaccccgaagttcttctccgaagtctaaatttaatttataaataaccttgagaaaatatcagtgtaaaagcaagagagaaaccctaaaggaattaatgcaaatactaatcggaaaggacatgtgggatttttcttgagttctacatgtcgaaatatgctaacaagatttttagtggaatgttcagagctctagaaataattttaaccaattaaaatttagcacgagcaattatttaatccatgggtattcatttctttctttttcctttcctttttctttttcctcttttttttttcttttcgaatgggccgctggcccattctcttctcctttccctccccgctgggccggccgaaggccaaggcccagtagccagccgcccacgcccctcctcccctagggtcaccgacaggtgggccccacctgtcgggcccgtctcccacctccggccgacgccaccacgccgcaaccgccgctcccgcctcttccgcgcgtccgcacccacgtctcccgccttgctggccctctcccgcacaccccngaaccaaccgcccaattncctcgccgcgcccgagcccgcgcttgagacgaccgggattcgatttttgaatcccggctgtgtgtgctgcccaccctgtcccactccgtgggcgaaaatgcgggtatactcggcacgatcgatcccttgagcctatataaaccaccaccgcccttccctctctttttcactatttcgccgagctccctcgtgccctcttccgtcctagcgccatcgcccgcctatccgccgccgccgccgccgctccggtcgccgctagccgtgcgccgagccacgccatcgccaccgtcgggttcgcgagcccgagggccacgctgtccgcctctccgccgccgatttccaaagcaggaaccacgttcgcaccgcacgccggtgagcttcgccatggccggcgccctagccatccgtggtctctctctcc

SEQ ID NO: 37835 - DNA, 6048 bp, Oryza sativa
ggctaataattgcacaataaatcaattaaggatttttctgtttatagtaaaaacacagtgaatcttctaaaattcatatctaattcatccgtgctccttttaagcccattcaagtctcagtaaatcaagaaaaatgcaaagaatccattaaaaatggttttgttctctgtttcagtagtcttatagcctgtttgtatggtttgttttgtatgtcgcttagattccgactctcctaacgctccggtgtactttgagatagtcgccgaggttcctccagcagcagagcaaggcaagtcatgcttgtcacttgaacatattgaacctatattacaaatgctctatcgtttttcccttaaatactgcattgttttataatgttactatgggatgtttgtctattgttacagccatgccatttttgtaccttactcctttgttagcttggggttgtaacatgattagatgttggattaggaagtgcttagccatgcttagttcaactagcacacaatgggggacaacattaatgcatagatatcaaattttagtaatgatgttggttagtgccaccgctccggtgttggttaattaaaatatattaaatggtgggctgtgggtgcatggttttgatggtagtgcccatggcgattaaggaccggttcgcgggaaaccctaaaagaattcttcgtacttaccataagccagcgtgggcaacggctgggcttgtagtgtagctttcctctagctgacgcatccaggcaagggtgggccctgcgacggcctctgtcgcttccggattcacctagacacgagaggggactgcccgttgcccgctggggacgggggtgaaacctgaggtgtggtgtgcttggctagaggggggttatgcgaaaggtcctgtcacggccttattccggtatgtcatggtggcatgtcggtgcacggtaacgtgtcgtggggctgtgtcttgtgggtacagttgtacacctctgatcagagtaaaactattcgagtagccgtgcccgcggttatgggcggtcaaccagattcaccgtgattagtctcaccctagtttagtctgatggaattgattagttcaggtggatggttgggcttgttgcaacgtggtgtagcgttggacagtggatggttgatgttgattaattaatacaactgttttactgctttcaactactgtttataaatgctcgctttatgtaaatgaaccgctctacctatcctttggttatatcctacatcacaccccctgttccggtatgacttgctgagtacggtggttgtactcagtcttgctctattcccccccctccccagagtttgagtatgcgtcagatggtggcttttccgagttataggcttcgtccgtgccgtcgaggatgcctgtggagtggtgttcccgctgcagtccaagtcaaggcttagctccagttatccgttaattttccgttgtatttatgtaagactttataatgtttgtaagacgtggatctgtatgtcaactttatcgtttgtgtacctcggccggtcctggacggggggttttaatgcacattctgcttggaattctattcgggaatttctggacgtgacacctacccaaaacgatttgggaaaccctgtgtgtcacttcatcaaaagcctatggttttgggccgctactaataataagtcgtcgttaaaatttaaaattttattttgaaattttttatcataatttatcttacaatattgacttttacgaaaatttaaaatttacgaaaatttattgctgcgtttattttaggaccgagtagaagataagagtataaaatgtgaccggagcatgtggagaacttgagagttgtttggtgtatacccctatgccggttgcttcatattcatcacagctgaactgattgattgacctgcgtgcagagccttgaatatttctctcctacactcacctgacagctagctagatcgatctatcgatttgcctgctatcgtgtcactcatcaggaggagaaacagattgatcatcccgtcaccaatcgatcggtcgatctatgatctctctaaacgattgatgagcgaatgtacgaagaagcatttcaggaagggatagcactgtgcaaaaatggaagtggagtagcagtagcagagcaaacgcgaaaatgcagggagcatgagctgagctagggcgtagacgcgtagtagtagtagtagctagggatctctgcctgctttctagggctagcttagcacaagggacagtgacacgagagtggaagtggtaagagacaaactggatgatgcatgctttctgaattctgataggcaggtgcagagtgcagacatggttttgccatcaacttttggcctctagcaacacacacacacacaaagtttggatgtgttttagtttctgaaattagaaaaaagttcaagaaaagttgatagtttggaaaaaaagtcgaaagtttatatatataggaaagttttggatgtgatagaaagttaggagttgggggaaaatttggtgtgaaggccaaactctctcctaatctcattcactctgtctcttctctctcttccttcggctctctttgattttgggtttagttcacgctaaaattagaagtttaattgaaattggaacgatgtgatggaaaagttagaagtttgtgtgtaggaaagttttgatgtgatggaaaaattgaaagtttgaagaaaaagtcgggaactaaaccaggcctttgtttacagaagttgttagcagcagtagtttcttccagagtcaattttttttttcaaataatttagttttttctagattttgaaaatttataattgtaactcgtagaatcttaaaaataaattagaagctagctaacaaccaaccaactgcttattgtagtcgtaagctgtcccacgagctcttatattactaagtcgattttagtcgtggattatctacttgattatagaggtaaattaaatattttaaaatttaaacttaaataatttgaaataagtagtctaaataatgtagcacaagatattttttttaagaaaatgtatttttttgacaatgtaatgtaaataatctgttttaataatcgatgaatgagctgaagagaaatatggtgtgtgtttctcttatctctgtgtgtgttccttctctctctttttatgtgtttgtgtgtgagagagatactacagctttttggaagagaaaggctgatgataagtttcgagttggcgacttcaagtcaattcgtgtagctacgataccaagtgcactagctatagcttagccctagtactgcactggagtaggagtactactgtggttgtcctccatgtacgcaaacaaaaattttcgcatcaaagagacaacgccacagaagatattactgcagagtattaatttatctctactactcgcgatgcactactagccggagtctcaagcaacacatcacacagtgtaaaacaaatccagccacgaatttatacagtgagaaaactatagcaatatccattgcagacgtactcgcgtatattagtagttgtgagataacgctacagccgactacaggtaagggctccgttggaagaatttttttatatttttttagaattttttacttttaaattttattaataaacctctcaaaaaaatatttttcaaatctaaatcttttgtccacgccttgcagtgctggcttgccacgctagccccttgctacgccactatggctagcctggccaaacaacgctggcatggccaaaaggttcagtttttgaaaatatttttttggaaatatatattaataaaatttaaaaataaaaggtctaaaaaataaaaaaattcatgttggaacgcatcattcgaagaacgtaattaagaatagaaaaaaaatagagcatttaggcttcttatttgatttatatagaaatttcataggatttaaatcctatatgatttttttctatttggccctttgatacaaagaattaaagcttttcagatcctatgaaattcctatggaatggctcattgcatgtagatttaggagaaaacatagcaagagcttcaacttcttgaaaaatttcctttgagtttatctctctcatctaatataattcctgatttttcttgtggtctaatcaaacaattatttttatgtttttcttgtgttttgcaatccactattttacatttgcattcctgttagaatcatgtgtttttcctattcctccgtttttcttaaccctgcgattcaaaggggccttttatgtatggacaaatcacgcagaatttcaaaatacatgaagttgtactggatatactagggatttagtgttcttttgaaacacaaatgttgaaaaaacttagggatatgcattgagcttctgaaaggaaatcaaaaccatgaggtttgagcttatgtttgaaatccttcaaaaagtggaggaaagaaaggattcctatgaaaattttcttgaaaggaatcctatgaaaattttctaaccaaatcattcaaaccatatgtctccctagctaggaaaattttcaatagtatttcaatcctacaactttcctttaaaaaccctttgtttcaaaagagcctttaatggaggggaggggggggggcagagagaacatgccttggcctcaccaaacacaggatcataaaaacgcatgaatgatcatgaaaacacacaaattgaaaaaaaaattccggtttggagtacccctaccacttcaaatcctatgcaggaaaactgcatgaatcccgttagatggagcgcaggaaacacacaagaatcatgtcataagagtgaaagacacaaatgatatttttccaataggttgtacctcatgtcaaaattcctatactttgaaccaatccaaagaatttggtaggattttcggatggaaatttcttttgattcataggaccatgtataaaaattttccttaggattgagttccttcaaatttcttacaaacctgtcccaaaggagcattaaaataagatttgagctcatatatagtaaaaaaaatttccaatggaagtgatgcatatgataacagtccatagaaaattgtcatgttcatatcctttgttccaaaacacactagatatatataggaaaaaatccttcaaaattcctttgtgggctcctttggaacaatgtccaacactttcaaaggaattttaaagaaaaatccgaagatattttttgaggaaatgatgaacactgtccaacaaattgtttaaaatcaaccactgccgtgtgcaaaaaataaaaataaaaatgcatagaataacagatcagagctgagacaaaccaaaaccggcgttgcgctacccagacaacaacaacaacatgtcaacaactgctactctactccatatccaatcctttcccctctcaaatttaattacgcaagaacacacagtccatcgatatccatcatccatttatataactgttgctttgcttagattgcgattctcaaatttaatcatgaattctcatatatgcatacctttagctttggcatggctagcctcacatgaattaatcccttggcatctcgagtacaagctagtaccacagtttcactatcatttgatcgcagctgccgcttcacagctgcctcactccactccacttcacccttgaaaattttcagctcacgcagctgcagctgacgacgccgcgcgccgacgacgacgaccatgatgaaccctcgccggctgccgcctctgccgtcgtcgacgtcgtccgcctcggcagcggacgacatggacccgcgcgtgtggcgccggctgccgcagccgctggtggaccgcatcctggcgtgcctcccgacgccgtcgttcctccgcctccgcgccgcctgccgccgcttctaccacctcctcttctcctccccgttcctccactcccacctcctcctctcccctcacctccccttcttcgccttcgtcgtccccgccgccggccacctcctcctcctcgaccccaccg

SEQ ID NO: 37836 - DNA, 789 bp, Oryza sativa
cccacagtcggcttcgccgcgggcccgacctccatcatcgccgtcgtggccggggacgacctcgtgtcccccttcgccgtcaagaacatctccgccgacacgttggtcgccgacgccgcctccgtcccgcccccggcttttgggctcccagctccctgctccctcgcctctcttccctcgatccccgcgccggcatggccttcgcctccggcaggtaagcgcgccgcgccattgatgacgcatgggtaaatactcttgcacagatttgctgatcttgccttggttgttgttcttaggttctactgcatgagctcgtcgccgtttgcggttctggtgttcgacgtggcggagaacgtatggagcaaggtgcagccgccgatgaggcggttcctgaggtcgccggcgctggtggagctcggcggcgggagggagggagcggcgagggtgcgctggtgtcggccgtcgagaagagccgtctcagcgtgccccgcagcgtgcgcctgtggacgctgcgcggcggcggcggcggcggcggcggtggcgcgtggacggaggtggcgcggatgccgccggaggtgcacgcgcagttcgccgcggcggagggcgggcgcgggttcgagtgcgcggcgcacggcgactacgtcgtgctcgcgccgcgcgggcccgtggcgcaggcgcccacgagcgcgctcgtgttcgactcccgccgcgacgagtggcggtgggcgccgccgtgcccgtacgtcgtcgtcgcgcaccacggcggcgccggcgcggcgggtttccggg

SEQ ID NO: 37837 - DNA, 485 bp, Oryza sativa
cccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggcccgccgaggcctcgtcctccgagccaccgccaccgccgccgccgcgcacgctcccttccggtggcgctggccgcggcgtgccgcggatgcagcagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacaacgatggcgggcgaaacggcaggggtcgtggtgcccgtggtagggagcgcgggcgcggcaggggacgtgat

SEQ ID NO: 37838 - DNA, 6174 bp, Oryza sativa
gagtcgacctgcaggcatgcaagcttgactgtcctgggaggcttacgcccaaacttgccgactagttcttcgtggcgaattcctttggtgaacgcggcgatgatgacgtcgtcggtgatgtcggagatcttgttacgttgttcagaaaatcgccggatgtattctcgaagggattctccggacttctgaatgacgttgtagagatcatattgtgtgccgggacgctcgaaggtgccttggaagttggcgatgaagtggtcgcgtagttcggcccaagatccaattgtaccacggggcagtccatggagccaagatcgggcggaatccgctaaagccactggtaaatagttcgccatggccttgttgtctcctcctgctgcgcggattgcgagaccgtagacggtaagccatgattctgggttagtggtaccgtcgtacttctctattccagtcggcttgaagccggccggccaatccactcgacgcaggtcgtcggtgaaggctgctactccatcaaggtcgtcgttgtggcggtccggtgaaggatgatagcctcgagctgctcggcgttgtatgattgtgtcgcgaagatcgatggggcggcgacgaggtggtgagcgaggccgttccactcggcgctccctatattggtcgggaggtgagtgaatggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatcgatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagccggtgcgtgcgtgcatgcatatgcatgtactgtagtactacaccgtagcctgcactgcacctggccactactacacctgcgttcccgccacaaggcgctgtgcgtgtcaggcgccattggatgctttgcatctttgcttacgccatgtttagtttcaaaatatttattcgaacttctaactttttcatcacatcaaaacttttctacccatataaactttcaacttttccatcatatcgttctaatttcaaccaaattccaattttggtgtaaactagacacaattttggttgggaaaagggccctctccttcgttttccgcgcgcacgcttttcaaactgctaaacagtatgttttttacaaaatgtttctatacgaaagttgcttaaaaaaatcaaattaatccactttttttaaaaaaatagctaatacttaattaatcacgcgctaatggattgctctgttttccgtgtgaagggttcggttgggaaccaagtacaaccagcgaacacacccttatccgttaaaggacctctttgatttagaggaaaaacatagtaattttggaagattataattctatatgaaaatttcctatgaagccctttgaatcctatcctttcaaatttctatagaatggacaatcctatagagattttggaggaaatttagtaaaagcccaaatcgatctcttggaaacttttctttgagtctatctctctcatccgactcttgcgttttttccacggttcaatcaaaccgtcattcttgtgtttttcctgtgttttgtaatcctctgttttgcatttctattcctgttagaatcctgtgtttttccattcctgcgattcaaagggaccctaaagcttgttttttttattcatcccccacataccaatataaacattagaatgctcttactttatcaaatccggaagttattattttttactttatctacttccaatgtaattattccatactttcataaactcaaactctgatgcaataatttaattacttagaaataaacttattttgagataagtaggagtaaaaaataacttaatatgatacggaggtagtattatggtggatggagaataaagttggacaaacgaaaaaaaacaattgacgtatgattaattaagatttaattattacattaaaaataaatttatttcattttaaagtaatttttatatagaaaattttcatatgaaacatatttaaaaaacatgctaataaaaacctaagataaaatatgtatcttaataaaaaaagaacataacatttttactgagttctcatggtagttcagttcccacaaagttccttacagagttttactccgtgtttagttccaaaatatttattcaaacttctaacttttttatcacatcaaaattttttctacacacataaactttcaacttttacatcacatcgttccatttcaagcactttcaattttagcgtgaactaaacacagccttagtggtagttcagttcgcacaaagctccttcaaattgcctgcagtttcgaaggaggcctttgaatctggagtgctaattcggcaatggcatattttcgttcctgccgcctcgcatctgtccgtgcgtggccgttttgattggtcaggttttctttatgtccatctattttttttcacctgttcaagaacccctgcatctgtccgtgcgtggccgttttgacctttggagtatggatagtctggatagtggcctagtgggtagagcacgatcacagtatacggtgcaacgcaccagattgctcagaaattcaggtgaaactcaagcatttaatttattttttttcactttcgagacgccaaacatcgtaggttcatgattaacttgtgccgatggcgagaaaaaattctgggggacttgtagcccaacactggaatggttgaactatgacaaaggcccagaaaaacaatggatggactgacaggcccagaattccttcacgtctatcccaacaaaattagtgggttgctgcatcccaacagaatgtttgcgttgattctgatattagacatgcagactatacaaagttgtgctaaataaacaagaggtgcaatgtactgaattcagcatgataaaaaacaaccagaaggttcagaaatatcaatgtcaaacacgttgatggaaggcacatggagacatctggccacctcccggtcatattcttccacaaaacttctatagttgcctgtgcaacaaaagcataataccaggggcacttagtaagtgatggacacaagtgtatgaactcgtatgcatatcttatcatcacaaccaaggttttgcttgttttgtagtgacaggattaaatttaattggtcaggttttctttatgtccatctatttaacaacagagataacaagggaataatataaattgaatttcttacttgtgaagactttccatggttgattcaagttttgtcgcattagcaccaaccacctcacctgtcttccgaccttggtagtagaaatggaatgttggctacaagagcaaaacatgttggcaacaaagaaaaagagatctagataactggaggaagctgcgcagaaatttaggcacacagtcatgagctatagtcatagtacaatgcaacttaccacagagaatatttttagatcacttagtttgcttccaacaccatcctgcaaaagcaacacaggtcagggaagtgcctatcaataaacatgtccaagcatggccataaggttcagataattatttcagccataatcaaaattggtaacatagtgaaacacattttgcctttcaatgtactgaaagtataggagtgttctcaatagagtattccagttattgagtgaactaaccaaacagtgtagcatattagtctttgaaatcagaatacaaaggtaggaagctctgaaccggacaccatcttgattaacagtgattcatggaacagtattacggatattcagtgaaaaattcccatctcataactttgccttctacatatgcagatcccatacttgaacataagtagtgctagaatgatgcgaaatatttcagactagatccagattggtcaattgactcgaggctttctacagaagaacaggattggttcaatcactagcacttgagttttaagcattgtagtttactaagggcacgtttggatttctggaatattttgcctagccaagcaatgccaaagtagtcaggttaggctatatagcctatggcaacaagagagttcatttggtttcatggctgctcaagcaaaactaccaacgatcattgcttgccgctggaggagagctgatttggctctccctggtgggcaaggattttgaggcagttattgcctaacttgccctcaaaatctaggattttttgtttgtaccaaatgcctctcctaacttagcaaggatagaacttcccttgctcaagattaaaacacaccctaaaaagcataagccaaacctaaactttgaaaggacaggggtcaaaaatactactctgcagttaacacatgggaggtaatgcaattatacatgacaaacaatcttcaactatgaacatatgagtaaccaaacaattttgcaattttaatcccaacaacacctatttgagcaagaagaacacttcggcgcatcacaatcgcagcgagatttggatccgcccacttaccatgtcaatgtcaactttgtagataggtatcttggggtaccggctgctcagttttgaaatcacgggtgccatcgctctacctacaaacaccaaacaacccatcttataacacctcacatcatcatcaaccatctaattccaaaaatcccaatttcggcacgaagatccggcacttacaaggcccgcaccataccgccgtgtagtagaacacgg

SEQ ID NO: 37839 - DNA, 10221 bp, Oryza sativa
tattggtcttacttaaaaataaagtttacaataagcaaaaatatcgagtatccttattttttaataagacgaacaatcaaacatatgtctaaaagtcaaaagtgtgatctactgaaagccggatggagtactaaagtagcaaaccgatttttaacaaaaatttaaaatgagttttttctttaggaaaaccacctaagctcagacagtgagcgacagttgcaaagctttgtttgagaccttataaagaatatctttatctttagaccacaagtagagattactaaagaatgggatagtggagcattattgcgcattatcggtgactgcaaaatccatcataaggcttggttataaaactcttcactaacattcactagttgggccacatgacctaacagaaaggataggaaattatttagggagagaaagaacctgatccaccatgtaaaattgagttgcaaggaaagaccaggacctaccaatctatccatatttgtccctaaaggctccaccagactgcatgaaatggaagtagctatgatgattactatttgagagtgaaactgaaaccaaatctgacagacaaattgtgtgtgcatgtgagtcatggtcaactaggtggcactgttgtctctaattaaataagattagtactctagcatgagttgacagagtctgaacaggagaggggaataaaaaggttagttactctgtctctccatgtgctttgtactttaccttgtagaaattcagattctcattttcaagtggttagaaaaaccttgctggtttgctgaatattgccactcaacgttgccagttcttaagagtttgcatatcacatgactagaaactgtaaaatggagtagaataccttttctcttgtaccttttaagaaaatctattgtgcatttgtgatactaataacatacaaaattcctttattgagagtgccctcaccatttgacagcacttgctgctgttgttcagtcaattcatcaccttgcttcagtaatgggtatggtttgatcatcaacctagctttttagcaagtattcaaaagtactaatgcacactgacctgcacccatgcacctaaaaaaaagacagattcagcaaaccaagaaaagatagctagcatgggctgcgtagttgggctatatgtatgaacatataaatgcaaaagaatatcctctgaaaaaaatcaatcgtgaacacatctcagtgtaatataacgaactcaaaatcagcgaaatgatcgtatcctagtttttttttgacaagttcagaagagatccagctcccaagttgacccatgaaagcctgcaaaggcaaaacgaaactatcttttgacctcatgacaccgactgtcgtaaaattcttcacgacagacatgatggtcattgagacttgcttccattccaagggccttttttccatcacccgaacgccaaagccaatgccgttgtctgccggctatctcaagttcaattgcagatcaagaaaaattcaggtgatgaccagaccatagtaacaaaggctgagtttagatccaaagtttggatccaaacttcagtctttttccatcacatcaacctgtcatacacacacaacttttcagtcacatcatcttcaatttcaatcaaaatctaaactttgcgctgaactaaacacagccaaactgacaggtagtacatgttgtagatggtgaccattgctgctcagatcatggtagtacaagttttgccaatgttcaagtacttgcaactagaagcaaagtccaaagctatcagatgtaggatgccttgtcgatttcccccttttttcactgaacagttaggaaattgaagcttagcttcagaaaagaagttggaagagaaggtccaacaacttttgattaggtgaacaggcataccaataccatcactgaaagtgagactttggtgggttcagcactttgcagctgttcttccacaatattcggatgcttttgatcaagacctccaaactaaagacacattcagatatgactaatataaaccattttcagtgtcttaggtactagtactactatcaatttacataatcaagctgaaagaagtaggacatttctgctgcccctttgtaacctgttctttaagagttaggacatgttcagtctgtctgtctgcaggaaccgcacaaatggcacaatcgatgcatgcatggatagctggatatcaagctagtagttaatttagatgtcatggtccaggaagaacatgctaagctacaacatggagtatactaaatcatgatataggaggatatcatcgtcacctgacctaacaagcgtttgcacttattcattattaagccgtggatgattatttattactagtacaatcgtaaagagataggactaatgggtgattaattaatgaagcatcataagtatggtggtggtggtcgtactcttgatctggtcgatcgaatcaccaggacttttggtgcacgcccacaggattcatctggcccctggattttccccttggcgggaaaaaaaggtatctctgtttaaatcaacaccgtttactgaaaataaccaatctgtctgaacaattttatttcagcagcctgaatttgtgactgagcattttgagcattctgaacttttttactgaacatttgagcaccaagtgaccggtactaataatcgagctgcagttacagaaagatttatgtctcagatcactgtttatcatcagaagtggtggtgaaggattctctgacctgtgagtcaggaatcactgggcgtgtgcttgctgaggcagcatccatggcgaggccagtgagatgcagcgcggacggcactgcatgaggccgagagctcatcatcatccaaaagctgctgtttcctttaggctttagcagggtttatgttatcatcatcccacggtttagcggttaccacaagatataccatgattttgaaactgaaaaggttaccgcatattccctccgtcccataaaaaaccaatctagtactgaatatgatatattctaatacaataaatctaaatatagaatatgtaatatcagtcttggattaacgaaacgatggagggataacaatatgataatacggttttgtaaatcccaggttttagctactgaacaaaccaaatatcgtgtctttacatgattgccatcttgcttacttcgctgatagctccaactcgtaagtcgtaactgaagcagtgtcgatctcaaacacggaagttaaaaccaatcaaatgcgaactttgtttttgttattactactcctagtacctgaatctttgcctaacttcagctcgttcatcatcatcatcatcaccaagattcatcatcattcattgcatcgaaagttgaaaattgaaaattatagaaacgaaaaaaaaagcatacagtactaagagcaagtataataatagtaggctataaaccagctaaatgccgaggcaaatgatagaagagatgagagagagaaaagaagcggactgtaaacttacaaccggcttggacacaagaaccaaaaaaattctataagagagacaagtggaccctatagagaaggctaaaaaaaaacttataaacaacatatcgattgtattattagccttgctctaacacacaccagcttgtatgcggaaatgctaaggggcgatcgatcgcccctgggcgctcccctttcctccatatggtttcattttttggcaccacattactttcttattttagtaaatttacgcacctaaagtttgtacaccttaagtttacacatctaaagtttagagacctaaagtttatacatctgattcaaatttgaatttgaattcaaatattttttatatataatatttctatacatctaaagtttatacacctaaaatttatagacccaaaatttataagtcaaaagtttacatacccaattcaaatttgaatttgaattatatccaattcaaatttgaatttgaattcaaatattttttatatatagtattttgtacatctaaagtttatagacccaaagtttatgtcaaaagtttatatacccgattaaaatttgaatttaaattcaaatattagtttatagacccaaagtttataagtcaaaagtttacatacctgttttaaatttaaatttaaatttaatttttttatatatagtatttctatatataatttttttcaagcttatgttttttattttttaaaaatttatggtgtagtaggaagagaagaagatgaggagaaagaaaggatggggggtgttagccgcccccgcttgtatgtgtctaacgcgatgggtcaacctcgacgaaccggatttgtgcatgcgtgtcgtcttggcttacacaccacgccacgtcggatgggccccacactcagagccaagcctacctacacacacctacccctccgacggacggcctcacccaatcacgacccaggccaccccgggcccaccgtcacagcgaccgttatcgatcagcaggtgggcccccacggggatctttgattattaggtgactaggtgaaatcccgcgcattgctgcgggaatttagtatgataacaataaaaaaataacgtgtaagatagctaaataatatcagattaaataaattaatgtggtttatgataatttaaatttaaatagtatgtagaatgatgattcaaacgtaaaaagtaaggtggtatgactttatagaataagaaaagtagggagatagtttggaccgtagattaatcatctaaaggctaaaaacaattgatgtgatatgccttaatgagaggaaaaaaggagaaagataatttggaccatagattaatcatttaagcactaattaagtgaggatgaactatataaatatataggatatatcataaaacataataaaaatatacattgaaacattatgtgaattatattggatgataatttaacatgtttatatttgaaaagctcttaaattataaaaactataaagatatagcatgtttgtatgatgtttaaatgtgatgattgttagtagatgatgatgtggcatcttgttaattaatggattagtggatgatgatgtggcatctttgcatgcatgttaagtttaaggagttggtgggggataactttatagtaagataggattagtaaggcgctaatcacccgattaaagtcgtaacatactactccgtgattagccgcgcggaacacgtgctccggaacctggccaccggcacgcggattcccgcggcgaaaccgctcgtctccttctctcctcgcgcggtcgctctgaatttgtttgattttttttttttgcttcgattgcattttgaatttcgatatgatttgggtgcattttgcgatgggtttatgaaatttatgatgggggttacattttggcagaatgggcgttggttttagcagtggagtggagtgcctgcatccgcaaacacagcgacagcagcgtaagaacaaagcttcactgtcagagcgaaacaaaaatgtcgctaacctaatgttttggactttgtaaagggcatgttggtttagctcaacttatcccaaatcatgctaatttcaaccaaacaaagcccctactatattctaagccaaaaatgtcagaacaaaataatcacaacaaaagctcacatataaccaagcattaacttactacaattacgaaagcagttacgctatagtagaccgtaacattggcttccccaacacggtgatatcatgtactctctctgtcctaaaataactgcaaccatagtttttcgcgctcaactttaatcattcgtcttatttaaaaaattttaaaaaaaattaaaaaaattagtcacgagtaaagtactattcaggttttatcatcttataacaacaaaaatgctaattataaaaaaattttaaataagacggacgattaaagttgggcacggaaacttatggctgtacttaatttgggacggaggtagtaatactagtactaccaaaaagttcagaattcgaaaacccggtcagagagattttcttcgaaccatctgagaagaagtcaaaaacgggaaagttcatatggcgaaatttgcctctcccagctaaacgcacagataacaatttcgagcatttgactaatccataatttacaaataacctcctaaaaaatgcaaaataattccactttgccccctgcgctttaacttttttttccctctccgtttatataatccgcctcgccccattctccatcgtttcgtctcctctctctcttccaccaaatattcccacctcgcgcggctactctctctctctctgacaggcatggcccacctgcagctctcggcggtcgccggcggcggccggccggcggcggcgggtgggggaggggacgagatggaggacgtccggctgctggactcgtacgacgaggagatggggggcggcgccgccgcggcggcggcgggggaggaggaggaggcgcacgtgcgggtcaccggaatgacgtgctcggcgtgcacgagcgccgtcgagggcgccgtctcggcccgccgcggcgtgcggcgcgtcgccgtgtccctgctccagaaccgcgcccacgtcgttttcgacccggcgctcctcaaagttatttccgggcgaatgcgattgcaattgtgatgtgatccttttgcgtggctgagcccgtttgtcgagccgagttttgcgcgtctccgggagcaaactgggattcgtgagctcgttgacgctcacgcggtggtaaattttttgaagttttttcttgcgctggaattattgcgtaggtgatggttggtgcggtagaacaggattctaggaagctggatcgcgctgcttgctcgtggtttttctcgagcggttagaagttggtgaatcggaatttactcttgtctaataataagttgagtttactaattactatgtgtgtgagtgtgagaccgagtcaatcgtgtatgatattgcaattttgggttttagctggagatgattttttttttctttttgacttcaccttgcgatgacgacttttcatgagttgattcgtgaaatgtggttagcccacagtgcccagaggccagagtttttgtgctccttttgctttggcggttggatgagctgtaaccttgttgcaagctcgtgattgtggctggactctctggattgtgggatttgggagctcaaaaaggctggcagtttgctgcgattggttgttgctaccggcagaaatggggtaactgctgtactacgataggtttgattggctggtgaggcagggagcagccgagtcatgttttcggggggaaagggtgctaagttaaggatcccaatttatgtggcttctaagtactcattgaagtttcctttgagcaaaattgaatgcaaaatgatgttacatgctaattttgggacaagcatataatctcattattctaggcccagtaattaccatgcaagtgtataaactttcagcagtgataaaatttagtcttatcatagtaataacagtgtacttcacaattgaaatttattaatgcttatggttattatgttgtgaagtactctacagtttctggttttaatgactgttaatgtgaatattagttgagttgtagcgctagcaactttttgatgagcctattgtagtgcagacggggaatgttgtgtttcatccttttgcttttgttggaactattaaggatggctttcctgactattaagtagacatttaccagcaagttctatctgctacctcctgttcataataggcattcatttagtttgtttttaatggccacctactattcattgttgacacacatttttagattatatgggtcaattagctacctgcaatttttatttgggtacttgtttatacaggttgaggatataatagaagctatagaagatgccggatttgacgcagaaattatcccagatactgctatctctcagccaaaggcacaaaagactctgtcagcacaatttagaataggaggaatgacatgtgctaattgtgtgaactcagttgaggggatcttgaaaaggctatctggtgtaaaaggagctgttgttgccttagcaacctcactaggggaagttgagtatgatccttctgtcattaacaaggatgaaattgttgaggctattgaggatgctggttttgaagctgcattcttacagagcagcgaacaagataagattttgctaggcctgactggattgcacacagagcgggatgttaatgtgttacatgatatcctcaagaagatgattggtttgcgacagtttgatgtaaatgctacggtctcagaagtagaaattatatttgatccggaagcagttggtctgagatcaattgtggatgcaattgagacaggaagcaatggaagattgaaagctcatgtgcagaatccatatgcaggaggggcttcaaatgacgcacatgaggccgccaaaatgcttcatcttctccgctagagcttattcttaagtgtaagttttgacctttgctttctttttcaccaccagcatagttatgcatttttgcacaaagattttagttggatcaatgtttgtgacaatatccttgacatggttgtgacctggaggacccttctggacttctgttggagcattttagttatgtggaaaaacagcaatcatcatgtccctgtgccatttgaatcagttattttctcctaaccacataatagtttagattttttctattaactttcttctatcttacatgtgagatccacttgccataggaaagcatgctgctttaattctaggtttgggggtttgggctgttcataaaagataacaagcacattttacttcatacttgaattaaatttggcagtactgaacatttgggagtgttagatgatatgttccctagctacgtagttcttttgcttctttatatttcagaatacttttgaacttctcttctgcttgcttactaactctatccaactgtgtccttgcaccagattcctgtattttttatacgcatggtctgccctcatatacctttcattcgttcaatactaatgatgcactgtggaccatttcatatgggagatttgctgaagtggatattggtaagcattgtacagtttgttgtcggcaaacggttctacattgcggcttatagggccctgagacacggctctacaaatatggatgtgttagttgttcttggcaccactgcatcatatgtatactctgtttgtgcactcctatacggagcattcactgggtttcaccctcccatatattttgagacaagtgcaatgataattacatttgtgttgtttgggaagtatcttgaggtgcttgcaaaagggaaaacttctgatgctatcaagaagcttgtagaattggtccctgctactgctcttttgcttctgaaagacaaaggtatatggtaaaattttgtccttcaaaacatatacaattaagtcacagtgccacactcatcacattagttttagaagttatttctgacttgttttaggcaaccgcctgtgttttttttttcatttcatactatcaagttacacaaactcacattgttcttttcaaatgcagaaggaaaatatactgaggagagagaaattgatgcgctattagtccaacctggagacatcttaaaagtgcttcctggttcaaaggttcctgctgatggtgttgttgtgtggggaacaagccatgtcaatgaaagtatgataactggtgaatctgcaccaattcccaaagaagtatctagtgcagtaatcggagggacaatgaacttgcatggtgtccttcatatacaagcaaacaaagtaggatccgagacagttctgagtcagatcatatctctggttgaaactgctcagatgtccaaagcccccattcagaaatttgctgattatgtgagtaacctcccatattcttttctgtgatgtccttcatttgctttgtctgtacttattttaagtgtttaccgtgtactttacatattaactttaaaagcgtcagagcattttttgtgatctatttactatttccgatacttgagaatgttgcaggcaaatgttgtttgtttatgagaatttgattgttcatatgccctcttttaacatcatcattcttatgttgctttctacttctgatgtaaaaagttg

SEQ ID NO: 37840 - DNA, 919 bp, Oryza sativa
aggcaagaaaacactgttccggccggactgacgaggaacccatatcgatccgctcgccgcggcccatggaaacccaacaggagatggcggcgctaccttccgccgccggcgactactaatggggggtgatgctcgagcacattgacgaactcgaggtcgacgacaaggactccaactacaactcctgctccaccgctgccgacgacaccgccaatcccgtgagtccatgacgacctcgctcacctccgacggccacgtcgtaagagtctacttccgcctcaaagcgcccccagcgacgtcacacctatgcccctggcagtcactcttctccatttccgccgccatcgtcatcgccggccgcatcccctagcacaagagagagatgaaaagaggagagaaagagagagaggaagcagaagaggaggggtgagttagactgacatgtggggtccgcgtgggtcccaccattattattaattattttttttgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttaagggaccaattgtatctggttttgtggttgaaggacgaaaatcggattcgttgacaagttaaggaaccttagatgaacttattcccaagaacaatcggtacgatccacggcccagaaaccaccgcatcgcaccggaccagcccaaccatttcgtcgagcacctcacgcacgcgctcccctccaagccctaaacccattccccaccaccatgcgagccatcggcgccgccgccgccgccgcgaggcg

SEQ ID NO: 37841 - DNA, 5945 bp, Oryza sativa
ttgacatgtgggtcccacggggtttattattttcccgggtcaaattgccacgtaagggccacgtcataccacgtcagatcgagaccgagtcaaaattagccacgcaggcgccacgtcagccaaaaccgccgagggacctaatatgcaccggttttgatagttaagggacccgttgtatctggttttgtggttgaaggacgaaaatcggattcgttgataagttaagggaccttagatgaacttattccttgttcttgcgcgttatcatcaccgttgattcgtgaatcaggtttttactccatgatttttgtttttttttttggattgtatggcagacgcataacaccacactcacacccgtgaatacgtctcgtaacatatgctctaaagatgaaaatcctgttaaaaaatcatctatacgtgtgtaatattcgtaagcaccaaaatttcagtcttcgtggatagaatcatgcactcacgactctactttttcttttttttcccctatgatttttccattgttatgatcgttttacctgcaaaaatgaacaaagtgaaaagaaattaaaatgatttatagcaattttatgtatatgtttctttgttgatttaaaagccaaagaagaaaataaattatggtaaaaaaaactcaaaattaaattaaaaaaataaatattggctatagctaataaggtaacaaacatataacaagaaaaagtgtattgatgtaagcataccagtgaatcttgacagagagaaaaatgggcatggacgtgtaacagcgtaagaacatcttcaacagcctttctattttactcttcaaaccaaagtttagcaacagtggataaaaattgcattctcttcatcccactcttcaagctatccgactggacaaactccttcccttacttaccaaacttggtgagccaactacacttgccatatgtgggtctaactacctcctattatctttcctcccacttgcgatgcagatcaagtggaactttgccgctgcgcaccttctcgccaccatggtttcccgctcgcaatccccctaacgagacaatcattgtcttcatcgtttgccaccgccatcgtcaccgccacatcccgcacctccccctctactccaccgtcgcagcctacacatacctcctcgccaccgtggcctctactctgtcgttgccgtcttcaaccccacacgaccttcacagcctccgtccctgcatggactcgggggccctcagctctcgttgtctcctctcaacggcgatttttacagcctttgcctccgctggcatggaggaagcccacggcaacgacagggttggggagtgtacgggacgtcagtgagctcaagcgccactatagcatgggtatcgcgctttgttgacggccttcctttcatccgcgtcagccaccccgcctagcgcgctcacggatccgctgtcgccatccgccatcacacaaacatcgtcgccgcacggagggagagggatggagagtagctcagggtggccccagcggaagcaaaggaagaatggagaaataggaggaagaagaagagatgttagaggctgacatatgggttgcagtgtcatatgggttggagtggagagggtagatgaagaagctgttggcgtgagcaacgattttggcttaccaaatcaattggagatatagctgtataggtgtttggatagtctaatttgtatattctgttagagatactatcagcgcataggcaatgtagactgtctttagcattaagattgcaaataagcaagacttggggtgagttcatttctctccttttttttaacttatcttttttcacgtgcaagcttcccaaacagctaaatggtgcgtctttttttaaatctataaaaatgttgcttcagaaaaattcatattaattaatttttaaagtttttagctaatacttaattaaacatgctctaatgagttttttttttgttcacgtaaagggttcccaaaccttttcttcaaacacgttttatatcggtggctttgcaagcgcaattagaagggtttttgtttttttaattaaaactagcaatttgaaatgtaatttcatgcttccgttatttattagtgcaaaagagcattttgttgtctgggaaaaagaaagaggttttgcctattttatgtgggcctgcgaactaaacccatatcagcgaggcctgcaacggtggtgtccttgattcaagcccagttccacttccacggcctcatcgcacgctacgcgacgcgagcgttcagcacgaaacaaacgggacagatgggcttctcctgctcggtctcgatcggcatctgctgccgcctgtgacacgggccgcatcagcttcaagcggccatttttcaacggaataagtctactttacattcctcatcttttcatcgagtttaaattggagttttagatgtcactggggagggtatgggtaacccatatctattttataattagctttcccatacctattgggtatgaaaattatccaatgggtataggtaatttatatgtgggctctatatagaaatggtctaaaacttgcaaaaagtgcttctatatacaataaatcatttctacgaattcaacccaatttgaaacgtttttataatgtgaacacgagttttaaaattttggattcgagctttacacacgtaaaatggtatggataaagtgtgtaatgatgggaacatatcatgtgcacacaaatctttacgtgtatacatcgtgcataccaaataacaaatatcataaaaaaaatctagaaactgcgtagacgtacttccaatagtattactcctacgcgtaaaatattaacctcaaattgattatattttagccgtaacaaaaaaaatcacagttttaaggtttctatcaaaaattttgcttttttttatctctatgtaaaatgaatttgaaggtacgactttacacgtagatatacaattgaaaatacatgtatgaacgtacttttatagatttttttgtggcatttgttaattggtatgtgcagtgtgtacactgtacacgtggggcttgtgtgcatagaatatgttcccggatacaaataggtattaccctcgcttctttatccaaaattaaaatagatatttttctccctatccataaggacataggtatggagatgggtgctatagatacccagtgcagacagtcctagactgcatgcacccgacactcaacacaaccaacctgccgtccctcctcgagagatcgatggtcagatggatcgaaagtgcagcacctcatctcacgcatatggctcaaagaaggtcaagaaagtggtacgtgtggtaaaaaagaacaagagagagagagagagagaaaagcacacaaacgcaaagaagccaaagcaacacacctctcaacgccgccaaagcacacaagagaaaaacaaacgaatgaaagtgccactgccaatgcagtcgcgtgtatacgtccaaagttgattggcctagctagcatgatacacacttttgttgccattcttgaaaaaataagaagaagatgatgatgaatccaacctagagaggcaaggcacctcggccatgaagtgctaactcgagacagaactagacactagtgtggaaaaaaaatatctgtgtcggacgggaaccttcatctgcatcgccgacaggccgcgttatggataattggtcaccgataacagtgatttgtctcaggccgatataaaagaccatcactaataattttaacccaacaaagaagtcaaatcaaagcctgaagattaggtcatcgttaatcaatgttacggtcctataacccaaaaaattgtgatggtcacctttattgggatcggtcttgagaccattacggatgacttatcggtaatagcttttattttagatccaaagtttaattttgatgcgcacccagcaagtcgtgacgttggttttttttttttttctaacacgagagaagctagaccgataaatgcaaaaatatgttgattggtgctcactttagtggatttccttccaaatcatctgtatggtctaggactatagtagtagtataatctgggcggttttgcaaagggacattttgccgacggccgaaagaactcgagtgtgtgcgtgtacccgttttgttcatacgtgttcagacattaatctaaacatcaaatattgggtaaccatgattacgtacttattaaagttgctacttaatgggccacgtaaagcattacatatattttataagattggcaagcaggagaagatctttgtggtcttaatcatttcatgacagagaaagcgtactacccatcactgataaagctaacatatatctattaatcatatatactccactaggaaataatttttccatacggacggcccgtatctaaccaaatgaatgtaaaaatcattgatttttgcaagcgagtcactatgacacccacatatgaagataatttttcaggggaaaaaatagcgcttgccgcctacgtcgtagctggtagcgatcgcgatcgtcgtcactagaagccaacaggtcatgattgaggtcgagatcgttgtcgcatccctagtcatggtcgtcgttgtggagccactgtactagatctaggagcggttgtcgtcaccacctcgactcacattccactgccgccctccaccttacgcccctcctcttcgtaccaccgcccttatcccagaaccgttgtcaccaggccactgccgagccatgaatctggtagcccaaattaatctgatcatctctcgccgcctaggtccgcctcctttactgccgctcttcaccatgcaccccttcccttgttgctatcgctgactcatctctgttgtcatggatctggcagtccatatttgcttcgcccctgccactccgcttgccatcgcccctctcctttgctgcttgcctagatatgcctcctctctcctcggcgaggagtagaggaagagtgtggaggtgggctggggaggacggtgaggatatctgtctccatcctcgctgcctagattcgtccctcctctttgttgcccccaacgataaggaccctcaatcttgatcagctgcttttggcaagaagggtggtgatggtgaggtagagtggctggaaggagtattgagggaacagaggctatagggacttagccaatattgaggctagtcgaagaagccgatcgaggtgactcacacttttaaggtggcaacatttttttacaggcgatgctctttagcacgagattataggagctcattggtattattgcaaactgatttttaataatctgccagtaaaaataataataataaataggtgcctacaaaaaatcgctttggaaagcgatagtagtacgtgtacgctttaattcgggcaagagaaaactcattaatcctagctagggtgatccacatgcaaacatttcacatgtcatgtctcatgggacagcatctcaaatgtgtgcttgaaactcaagctaccatccatagtaactggtgacagcgattttcttagtttaatgagagctaaaagttaaggaccaactttataaaggttgatatttaagtacgtatgcgcgcgcctgcttgcagctggttgctcgctgcacgtggattattttcatacatacatacatacatacatacatacatacatacatacatacatacatacatacatatatatatacatacatacatatatatacatacatacatacatacatatacatatatatatatatatatatatacacatatacatatatatatatatgtatatacatacatacatacatacatacatacatacatacatacatacatacatacatacatacatacatacatatacatacatacatacatacatatacatacatacatacatatacatacatat

SEQ ID NO: 37842 - DNA, 22867 bp, Oryza sativa
caccctatttcaattaaatgaactaaattttacttataaatatatacattctattatggtgtgcgtttgcaacgcgagaatatatacagtgtgatccaccatcacatcatcgatcatatgtatcattgcttccctagttcccttcgttatttgcttctttattcattaattgtacgtctttctgtgcattgtgaatctagagtttggtgctatatatcggaaatgactaggttattctgaagtctcatcaactatgctaattaatattactctagattgaaaagttcatggtgcaaaatgattagtttttttaagtttaacgtgcatatataatattcgagtctgactgaacacaagttaagagttatttacaataacataacttaagacttaaatgacttttttaatatatattatgaaaatgagtaagtactacaaactgtccttttgtttaatctgttgattttatggttgtttatgcagcactaacctataaattttatattaataagcactagaaatcaaaaccaaaatgggtgtttcattggaagctatctaggaatctttgcttaattgtcaaagaagaaagcatctattccctctcgtgtaaagaaaacggcttgtccatccccctcatggaagagtaagctaggaacgattgagctagagcttaattgctttataatgttctcactcatcctctcccaaatgggcccctcaagccacaattttgaccaccattttttttgtttggatttgtatgtgtcataatgggatgcatgcttagtgacgtgtgcatgtatgggagacaatcttctattgtactaaagggagactactctcagtgagattgattgtaagctgctcacttttttgaccctttgtggcatcaatacctgtagacaatttgttcatcacattaatttgctttgaacaaatcatactagtgtgccaaaaaaaaacagaaatgaaatttatgtatagaaagttctttatttttttctttctgaaaaaacacactgtttagaagatcaaggagagtgtgcattcacctattcatcttttaagtagaaaaagagtagctagcagttccagcattatatatatgtaacatacaaaaggaaaaattgaaattgatggaaataaactaatttagctaccaacaagttcaatatcaatttgctatttggttcagtcacctaatcatgcgtgatcctgatcaattctcgcacagattaatgtgtttgatttgccaatatggagtatattgctatcaatttatatgcaccagtgaatatctagctagccagttcttaaaaaaaattaagtgccacaagatggcaattaatggtttatggttgtaggaaccaaaccaaacttaaaacctaaagctgcctgactggttgtggttgattggtccccaatgcacactatataactttagggtttttttttccagtgtatatgttgtgatgtccacttgggcaaccaaccattcccacggggctcaatgcaaatgcatgtctttttaattccctcacaatctgcaagccatcatttggatatgatggtgttttttgagtacactcctttttccatgactaattgcatgatgtgtctagatatatgcatatatattatagagtttgacccacatatatataacgatatgatgattggatgcactagtgataaaagacgaagtcatctcttgtttccactaatctagcttctctgttggcgcgcataattcagcttaattaggtcgacaattttagtgttaattcgtgtaaccggaggacataagaatgtggagtatgttgtatctcctggtaattaattaagtaggtaaaaaaatccttctcatagcatagcaataagaatatatatattgatagatgaacaatgcatgtggaattaataatgcttcttattaataggggtgaaaatggggcgggtatttcccgccctcctgcccggccacattatttcgggacaaattcgggtacccgagacttttcacggatatcaggtccgaatacatgtcttttttggcggatataagatcgggttcggaaatatagtatccgatggatacggattatccggtaaaaaattcgggttttacccggataattatacggatattacctatattatgtttttgtgaggcattttttggtactatgtattggttctgctatgatgtattataccctatttatttcctaagttcctaatggcctaatataattgtattatggatatatggaattgttaaatggttattgtctatgtgatatataaggttgttgcttcgacttgatatccgaataaatattcgtaaccaatagtgtgtgtatctattttggtacgtatttgttccatatttttgcccgacattatacgagtttgtatccgtatttgacactatccttgtccgacccgattccgattataaaatgtgggttaggatatgaaaaggttgagatctgaccgaactcgatccgttttcacccctgcttattaatggataaacctttgcaaattgggtgaagtatacctgctagaatcgagaattcaacaatatatgatttacttatctaacaatctttataagttatacaccctatggtaacaaatattgtttgatttttttaaaaaaacttaataaatgcaggaaaaactaatttaatattttcgaggatacgtatatatgcaccggcgctctgagggtgtgtttgaggagaaaaaaagagaatattaagaaaaaaatagtgagtcattagcgtatgattaattaattacgtattaattatttctaactgaaaaacagataaatatgacttttgaaacaatttttctatagatttttcttaataaaaacacaacagtttcttctctttgtttttaaaaaacatggtgagacttccttttttttaaaaaaaataaataaaagttttcctctccttgtgttgctgccgaacgcagcataataattgttaatatatatatatattaagcgtcatataggagtttttatgtttcattagtacacaaacatttaaggtcaaagctgattaattatgacttaaaaactatactagctagctagtaaaaaaagcttaattattactcccttcattttttttctttgacgttggttagctcaaaaatacatttgtacaaggaggtagtactaacaaatactttctccgtattttaatatatgacgccgttgactttttattaacgatacggagggagtaatataattcaaggtctctctcctcacctctgttacaaagcgaggcggcaggacaaggagaccggcgaggcttcgagctagctagcagttggcggtggccgctttcccccccggatagaatatcacccggtgcgcgcgctttctacgccgagacctagagagagaaaggagaaagagagagaaacaaagcacctaaagcaacaaagagaggtgtagagagagagagagatgagaacatatcatcaagaaaagaagctaagagagatcaagtgatgtggtcgtcgccgtagcagcagtacagcttctctaccaacaccgtagtcctttctctcctcctccccctcccctcctcgttccgcgtgccgcgagaggatcgaaccctattcctttgttcttgaatctcttccaaatctgtaacagagagagagagagagggaggagatctagtgagtctagagagagagagaggttcttaagaggaggaggaaagctagctaggagaatagaatgttcccttcttcttctccttctccttctccttcctcctccaagaagcagcagcagctcagtggcggcgtcggcgtcggcggcgccgcggcggcggcgagctcgaatgatcggccgccgttgtgcgtccagggtgactccggcctcgtcctcaccaccgaccccaagccacgcctccgctggaccgtcgagctccatgaccgcttcgtcgacgccgtcacccagctcggaggcccggacagtacgtagctacgctctatacatgactgatcttgatgctgagaatttgatttgattttatttggttcgagttcggttcttcttaattaattacttgtatgtttcatgatcaaactcttgatcaattgtaaattacttgtatgtttcatgatcaaactcttgatcaattgtagaggcgactccaaagacgatcatgagggttatgggagtcaagggactcacactttaccatctcaagagccatcttcaggtgtgtgtgcagtacatatatagatccatgtctatatatggttttctagttgcactagctagcatggttagaactagggttagcttatgctctctctctctctctctctcatgttttgtagattgttgtttttcagaaattcagacttctgtatctctggatctctcatgtgttgtagattgttgttttttcagaaattcagacttgggaagcagcacaaggatttcaacgaccactcggttaaggatggtaaacacacgatctacttgttaaaatagcatattacattcctaattgtgttcttataattagctggctagttagcttgttagtttgttcgcacatgcatgtttttccttcctttaattccgcttgttaaagtttaccgacttgatatatgttagcagtgaatttctgtttcgtttgtactagctagctatttaaacagcttaatttacttaccatgattctttcagaatagttaatttcacactttctctgaatataatcaaaaggtgaattatattcaaacttatattcgtccattttcccactgcagcaatggacatgcaacggaatgcagcgtcttcttcgggcatcatgggaagaagcatgaatgagtaagttgatttttttttcatagagtaccctagctagattaggttgttcattaattcaaaatgtggtttttaataactatcttattattcaaaatttctatgaattgttagccgcagcgtgcatgtgaatgaggcactaaggatgaagatggaagttcagagaagattccatgaacaattagaggtaattaagagcattgtcagaaacaaattaattttctgtaattcagcatggtgtcaaattaatcacatactgaacttaatagcccaagaaattacttattaatttgctttgctttattctgcatatgctccttcacatgttgcctttgaacttttgcatgcatgcatgaacgttcttgggaagtttacatgcttgtggacagcttatatgtcaatgtttgtccttcacatgttctgaaaatgagatgcatccatgcaagaacattcttgggaagtttacctagctagcacaactttatttttttcctatactcatctgtggcactcatgagtttggcatatatgcattttctttggacacaaaagaagtgaatataactaactttgcatgcaggtgcaaagcaccttcagatgagggttgaggcccaggggaaatacatgcagaccatcctggagaaagcataccaagccatctcgtcctcaggagattgcgccacgtggcacgcaggatacaaatctctaggcagccaagctgtccttgacattggcagctccatgagcttcccttctctgcaagatgatctgcagttatatggaggaagccatctagatcacctgcatcagcagcatgagcagatggagatcaggccatcaattgataccttcttggcattcaattacagctccagtactgggaagagcccaatggtgtggcccggcgccgacgacggcggcggcgagccggcgaagatctccggcgatcatcagctccagatggcggcgccggcgacgacgacgatgatgatggaggccatcaccatgtcaggaggagactccatgggcagtaaggggtttgagggtcagatgagctctaagcttgacatgagatcaccacctccacagcaaacagtgctacctgtaggaagtgagaggatgagtagtccaattgttggagccaaggctaggaacatctcctatgggtaaactaattgatgatgaattgaagaggtaattatattaactgcatgtttaattttgtggtgaaaccagcaagcaggctgaactgatcttgcaagatcactgaataagcatatgtaactgtcttgttattagttgggagagtatacaaaagtagtattgcattatgcatcgttcaattaattaggatgcatccatgcatgcaattaattaagttcttgagagaggagggtgatctagataattagtcgtgcctacattcttaattttggcttaaagtttgtaaattttaattttgtgttgtcttaattcatccatgcttgtctgaacattaacgaaagttttcttatatatatgtatttggagtcgtgtcacagtacggcatgcatgcatgtgataacatgtttttactcatgggtaaatattttaaggatataattaagtgcaagtgcttgatcgatcgtttcatgaaattctagaaaggtggatttacaagtggagaaaaaagaacgtacctaagataccgaaaatacagcagtgttcctagctgttagattttagttagttcccctatccatgtatctgatgtatctagctactacgtacagtcaacatatatatatcctggcactccaattaatggacgttactgccaattatcctggagactgactgcttacgggcaatccaactaatccagtcaaaggaggaggagcgctcggagttagctttccttgttagggagataagaaacctcatggctgggaatagggatattgttattctgaagattcatcgtaactagaatagtgttagccacgccctggctaataaagggcgtagcgaggctttaactgctttctgaccggccggatgatacttgtaattttatctctcacctgttgggtgctgagtatgagtaatatatccccgttcattgcaaaaaaaaaaacatatatatacttgcatgtcatctagattatattaacattatttctagaaattttcattattattactcggggcctgggggtaggcatttaaaaagattattaatgagcccaagcacttaaaaatgttatatattatgggcgttccttttatcgatcaactactagccaaaattactcgtttgttgctatggattattaaaaggaaaaagtataaattaccccccctgaaatattggatgagtacgaattatcccctaaacttgaaaaccagtcaattttcaccctcaactatcgatattggatgaatccccccagcagctttacaaacggtttggttacgtggcaatccagtcagcaatttttttctttttaaatcagcgggccccacatgtcagtctctcaccctctcttttacccctcacctctctacctctctccaaaatcctcactcttctcgcttcctcaccttgaggacggcggcgggcaagagcgacgaaaggggcggcggagctcgggacgatgtcgggcggagtgggcggcagcaaagggcgcccgcaaccaccggcgctcgggacggtggtgagctgagcttacggctgagggggtggcggagctcggggcagcagaggacagagttcggggcaacgggaggagggggcggcggagctcggagcggcgggtggaggggactggccctcgtcgccggtgctctgtcttcctctcaccgatagagaagcaaagaagggagagaaggggagagagaaagaccaacactgcataacagcacaattaagcactgttcccgaatcacgatgcaatggcttaattaaagtagctagctcaaatatatccacagttaattagcttggattaattttgctccaattatatcagtgactgagccctgtatagcatgatgcatgcagccttttcttgctgagagtggaagcttcgtttgttctgcgtcgcctcctttctgcaatgctgcatatgtatgtacagtctaatgtctatacacagtgcccctggaattgctgaacttcacactgcttgtgctagtgtacaattcagaattcagatcatatcatatggtcagggacacaagcaactgttctatttttttttcagcagctgttaagattaattattcgaggtataaatgaatgaagtattataaagttaggaaatagatttaaattaaatagtatttactataagaaattcatatatgtacaaatttttcaaaaatcacgtattgttaagagtttgagaaacgtgtatgttaattcatgttggggaatcccaacaagaatcgtgttcgacctttaaaatcccaataataataaatagaagaggcaacatgatagggtggggcagttgacgcgatattaaaaaaatataaaacagaaccaaaataacgattatgtttgatttttaaaagcccaataacaataaagaggaggggcggtgagcaggttgtacaatagtaaagataacggcgggtatgaatcagcccatttcatgcaccccaattatattggctgtataaaaaaactggctgttttcatatccccttgagtacatgggacttgcaattatatatggtcccgatttctttcctgaaatccactagaaaggtggaatatttctggtttcaggaaagaaatatttgttcctgaaatgcacccgccctcgtcccttgtattattacaagcggttttccttggtagtagcgtgatctgcgcatgcaaattaacatatatgtggctcctctgatcatgctaattaattacctgatgataattagggatgattttagaatattaccatagacaaaccctttaactgcgccactgtactcctatatatatctcttattacaccggtcagagtactgattatttcatcatcttcttcgtgcattcaatcgatccatcaccatttcaattcccagtacttcagcaatggacaatcaatggaatgcagcgccatcttcaggcacgaattcagagtaagttgatttaccatggctatattaatttgttgttcattaattcaaaatgcaccctctttttagccaaacaatcaaaattaattttcttttgtctatactttctgatcgatctagctccatgcatgttcatatgttttcaaaattaattttctgttctgtcgatcttcacagccgcaacgtgcatgtgaatggggcagataagaaggcccagagccaagaacaacaagaggtgagagagcatatgtatttttaaattcatcattgcatactgatgactagttcacataagaaattagtacccctttaagttcattatttgctcctcccatttatctcaaaataaattagtacccctttaagttcattatttgctcctcccatttataaaagtagcagatatatgtattaggatcggagcatataaaatgtagtataattttattaggatttgataaaaaagaggatatttgcggaaggaatagcatgttgcttctgaactttacatgcatgaacgttccccattaaattctcacatgttctatctgaaaattaaatgatatgtctcttgcaagaggaacattcttgggaagtttaccctgctagtgctagcacaacttttttttcaataatctttcaactcatcatgagtattatatttggcatatgcattttctttggacacccagaaagtgaatatatttctttgcatgcaggcagaaaagcacctccagatgagggttgaggcccaggagaaatacatgcggtccatgatggagaaagcacaccaagccctcgcatctggtgccacgtggcccgccgccaatgagcaggcgaagatctcacctccaggaaggaagtgagaggataaatctggatttttcacattttggttcttgtgaaaaacttatttcgcaaatagacccctaaaaaaacttatcccataaccgccgacgtggcggggcgatgctgaggtgactagggagagcgcgccagaatggctggcgccaccccccccccccgaattttttatttttcttttatgtttttgatatttttttcacgcttagggatacataagaaccaaacatagaaaaaataaactcaaatggacgtaatatgtaacccgtagaatttttttctctcctctcctctctctccgaactagtgcagaggagagagatgtgcaacttttttatttttatttttttttgatattttttcacacttaggaacttacaataaccaaccatataaaaaataaactcaaacggacgaaatatgtggcctgtggaatttttcaaagctctaccgaaaaacttctctcctcaaaaacacaatcttgcaagtggaatttggaggttttaatatcgccgaacctggcaaagcaagggagaatcgggtgtaactttttatgtagatgtccgtggatatattatttgcctgattccgagtccgtatgagaaagttacgcctatttcaataaatgacatattttgtccgtttcggtgagttttggaaaattctacaagtcacattttgtccgtttgagtttattttttatatggttggttcctatgttctcctaagtgtgaaaaaaatatcaaaaaatgaaataaaaataaaaaattgcatctctatactgtttaacttatggctatcattttatatggttatattttgaattagattaagtaagtaatttcatatagtctaatttactaaaggatctctcctatgtttaacatgctgatcaaaaggttttactaaagaagttatggtctaattttagtgaaggtgcaaagtagactaagtggtagacttagctaagtggtagttcgagttgaaattttttttggtggttggttgtatcgtgatcctaagtgtgaaaaaacatccgaaaaaataaaacaaaaataacatcgttgcaactccatacagagaaacatgaatggaggtgaggggtgggggggcgccagtcatgctggcgccctcattcctagggcggcgccagccactttggcgtgctccccctagccacatcagcatcgccccgccacgtcggcagggggacggcgcggcgccagccaccctggcaccccaaaaaggaccatttctgggataagttttttcaggggtctatttacgaaataagtttttcaaaaggaccaatatgtgaaaaatccagaggataatagccttacctccgcttcaaaatatagcaactatattttgggaggaaggtaggtattacttatttagaggaacatcttctatggctatggggtatcataatttatgattaagaggtgtaataaacctcttgcatgatcactcaataagcatatgtgtgtgtgtatatgtacactgtcttgtttgatggtgttccaaaatggcataattaataatatgatatccgaatttatttgtagaggcatatgactcagcacctgctaactgctcccagagtccaaaaatgtaataacctataaccaaacgattttgctaaaaattaggcgcaaccggagtttcttttgtttttctttctctgttttatttttatttttcatcctagagtctccaataggcattgtgccattatcaacttataatatcaatatttattcgagatggtggtgaaactcatcctttataaactgcaatccctcgtaaaaaatatataaaaattagctataatacgaatcaggctgaaacgacgtatccagcccatcagggcccatactagagcccactatcagcccaatacagcgcggcctgcagccggggcccaccaaagacttcccaacgtcaacgcaatattctcctacctgatggatggccggaaaatggcattggacggacaggatgcacaagagggcaactaattaatcgcattttattttgtcttccaagatgacattgtttgaccttgacatttgaattttcaaatttcaacgagacccaaacctaaacggcgatgataacgatgactgttaacttgaaattaagtgtcaatgttctataggtcatggtcatgtgagataacgtatacgatacatcatttatggtcgttgatttttctaccgtaagtacgaaaatgagtgaccaacattgattccatatataatgataaattatcagcaagagagtgatgaacaagtcaaactacaactgtagaagattaattaattaacgactaacggtgttcatcttctagaaaggctagagggtagaggcgcagcacaaaagcaccaatatcttattgccaggtgtcacatgcatgaccaaaaatgttccgtatattgagttcgtcataagggccagattagtctaaggtgaactttgagtacctttcatatttttgttgtgctgactaaaatcacatgtgcagatttgtttgaaatgatacttccgtatcactatttctgccatagtttgtaacacataatcttgctttgtcagagtacagactgtccttctatctcgttttctccataatacagggactatatgtgctattatggtaggtatagtctgttccaaaatataactatttctagcacttaaaatttgttttaaaatacaataacttctccaccaacattctcttctcaaccaataacaactcttccaccattcacttttttcacctaacttaacttcttaatcaatcacaatatctctctatttaattctacctaatttcttaacaatcgtgtcaaactctaaaacctcttttattctaagaggaggtattaacatattatcataaaactttttagcaactacgtaaatatgagtatagtagctacgaaaaatctcaaagattttttttaaaaaaaacccattagtactaaacatgggaagaaaagtgcttgaaaaggaacaaaatagatctaactgatagctgtgaaaaaatctctaaaaaaaagaaaaacaaactatatattagtattaggccttttattttctgattaagttgctctacaatatcaaatcaactcatcttctaaatttataataatcaaaactcaataatcatatgttattattttttttcgtttttgcgtatactttcttaatcctcatatttatcagttgcaaacagggcctaaacctttataagaaaagtccttaaaaaagaaaagaaaaaaatattctagaacaaagacagtgaaaataaaacctgttttgaccatatgaaaaaaaaattaatcccaactcccaattcccaagccaaccaccacagcaaagcctcccttcctttcctctcttcgtcttcctcctccctcccctctctccacaggtcaaatcctccccttccttgcttgcaatcctagcaagctccaagatcgcggcaagctagcctcgagggaggcccgcctgcccgggcctcgggctccgggggcccggttcttgaggtttcttggtcgtggggtcgaggaggtggtgggtggtggtggctgcggcttggcgcgatgaacaaccacgcggcgggcgggagcacgagcaacggcggatccggggtcgacggggatggcggcggcggtggcggcgcggccaggaggaacaccaagatgcccaagtgtgagcgcgcgagatctctctctctctttgctcttctttgcttgcttcttgtctcgtctagccttagtgcaagatcaggatgcgatgagcagagctgttgctgagagcgaagtccatgtagtagttagtagcttgggttcttttcgcaatttcaccccgcaaaggtggtggtaatctggctagcttagggggggtctcagctctcgagatggatgctagctcatgcatgttttctttttggattagtatggtaggtaatgatttatgttgggtgtacttacctctagtgattatatagctagtttcaatagtccaggagaaaccttgattaaattgagctgtgcgcaattctaatattgtttggtttgttctttgcatagacgaacattttaggtcgaaaacgccgatcaagtgttaggggaagcgaatctgactagcgtttccaggttgtgagctgattcttactccgtaaatttttcatgcgcagattccaagttcacgcagcaggagctgccggcttgtaaaccaattctaactccaaaatgggtaagtttaattacttgttgcatacttccaaggattaatagatttagggtgttactagttttaggggataaaagatgaatatatgtgcggagccgttcactgatgttttggctttgtgctacttaggttgtatcggtgtttttccttgtcggcgtcatcttcgtaccagttggtgttgtttcgctgctagctgcacaaaatgtatgctctgtatcttttacacaataggacatgttctggaagtttctgtatttatctgtttgaaactgttgcaggttgttgagatagttgatcggtatgatgatgcatgcgtgccagccaacatgactgataacaagcttgcttacatccaaaacccaaacatatccaaagagtgcacaaggactctgacagtaatgagcttaattttctggcagttacctcatattgaatgattagggtatatagttggagcaacactgcagctaaatatatctgggacatttttttaaaactttaattagcatgtggttgtaagtggacattgtatcaaaatttgttggctaaatgggaactgttttgtttttatctccagattacagaggatatgaatcagccaatttttgtatactatcaacttgataatttctaccagaatcataggaggtatgacatgattctattcaaggttttcaatcaagaatttgattacttagccttcctaaccaatctggcaacaatgaaacctatgacttttttgccttatgataacaataacatgcatttgatacctagtatgtataactctttccaaattcagatatgtgaagagccgaaatgatggacagctaagggacgctgcgaaggcaaaccagacatctgcctgtgaacctgagaaaaccacggcagatggaaaaccgattgttccttgtgggctgattgcttggagtttgttcaatgatacatatagcttcactcgtggcaatgagaacttgacagtagacaagaaggacatctcttggaaaagtgatagggagcacaaatttggcaaaaatgtctatccaagcaactttcagaatggtttgctcaaaggtggaggaacacttgatccggcaatcccagtatgtgaactcttgatctttgctatcacgctgttgcacatgcatgtagttggaggcaaactgttacgcattttattacatatgcttaacatcttgattttctgctaatatcaactatagttcatttgagttcttattcacgtagatatataaaaaagttgcctagccttggaatttctatgagtaactcatatcagttcgcattctatgtgacagttgagtgagcaagaggaccttatcgtttggatgcggactgcggcacttcctacattcagaaagttgtatgggagaatatatgttgacctcaagaagaatgataccataactgtgaagctgagtaacaactacaatacatataactttggtggcaagaaaaagctggtcctttctactgcaacctggcttggtgggaagaatgattttctaggatttgcgtatgttatagtcggaggggtctgctttttcttggcatttgctttcaccttgctatacctcataaaaccaaggttggtaacatatgttccctgcaattaaatggaaatgcatgtgctatatacttgatatgcttgtaggccatgcagttaaccttctcattatagttcactatgtagatgcatatgctgtggaatgctacattcatgacatgggtgttatgcaaaaagctcatttcctggattattatgttttctgagaacatgtctactgtcgatcattttttggtgcatatcattcttacgactattagtgccattaagagtgatgtggcattgctgtactgggttgtatcattgtatcaaaataaagaaacaaagctaaaatgttcatattgaacatgcatactttcgttcctttgctgactgagattttatagaagaatctctttagttgcaaattttgttagggtaaaatactaaggcagcacagggcacagctagttagtatcatactcatgttgcattgatatgcacctgtatttacacacaaccacatgctgtatttggtatatgaaagtcgttctactatatttatctgcggtatttttgcaggaaattgggtgatcacaactacttgtcctggaacagacatcctggaggccgttaagacgtccaaaacacttgtcgcataaaaatggctcatccggtgacatgtatcatgtacttaatgatgatatactgaaaattgtcagggagtgtaatcaggtctttggtttgacctagaccttcatgtacatcttagcataagaaccacgctgttttgtttcattgtttcttttgttatttcggaactgcatatagcagtgatgaatagaatcggtactgattgttttgtgatgaatagaatcctatcattctgaatgcctaaaccgttctgttattggcttaagtggttcattcatcatgctgatatgcatgcttcagtaataaaacaaacaaactgtcttctgataatgggaatatgggattgaataatttttaacagatttgcttgtctaccatgatcaaatgctgcaaacctctcacattatctcaaacacgagcggcagaatcaaatgcctttgcttttttttttgttcttttttttcagacaggtgtggaatagaatgacaaacagaactgaaattgccctgcttttattgcttcagacaggcgaagatgccaaacaaaactagttttcttcgctgaaacacagttcatgggagactacaacaatgctctgccacactgatttgcttgacatattcagcaatcagcatcaacagttcaacaccaaacagcttacataatccagcagccaagaaccatcacataacctattccatcagtacaatacaaatacatcaatggcacatttcttttgcctccctcgtttcataactaggaaacaagagggaattcagctcagtgacaggggaactgaattttctaaggtcagacattttgttcagctgctactggctcatccttgagattcttgctgagccactcctgagcagctaccaggtcagggagcacagttgctccagacttcctccagctctcagcatcggcggtcttgaatcggtccagaagcagcgcgtgcattccgatgctccgtgcaggggtgtagtccttgcgcatgctgtcgcctatgtgaagcgcctcttctggcgcgaccttgcccgccatttccagtgcaatcctgtagatacttggatctggcttctccacaccaactattccagagaacaccccaaagtcccactcggagccctggttaaaaaaaaatcaagagaagtcatgaaccacaacatttacttgtgaagatgataacattagaggagcatgaggtgtaatttgttatgcggagaatatcgaacctggttcagtcctagagcaggcaagatgacgtctttgtaacggtattctgcgttgctgacaattccaaccgtgagccccttcccgcgaagccacctcatgaagggctgcgcatcagggaataccgagtacggagcagacgagccaaaagaagagtaaatccgtttgaaaatcttctcaaatgtctcctcgtcatactcataaccagcctacaagacagcacatatcaagcaaccgaagcacttagcctctgaacacaaagacatcactagttcctgaaaagcttcagacctacaaaacagtggcatcaccttaacaaaagaatccttgacgcacatcctccaccagtcgatattcggcatcttcgctgcaaatccaaagcatgggtattgccttgccatctcggtgtatgcaagcttgaagccctcatgcattcgctggtagtcaggacatggcttcccagcagccttagctgccatacagtagtaatcaccaagctgccctttgtaggcaagcagagtaccggtgacatccacagtgatcaaccgcagcttcgaaatgagcgacatgttttgacgatgatcttcttctgagcagcaaaaaaataaaacgatgaaaattctacagtggcggatctaacatggggaaccatcaaactgttactactactagtattaaggttgagggcagatctctagaacagaagctagaggctaacgcaaatttggagaagaaagacagaaagtgcgtgggtagagaggtgtgccgtgtgcgtaacggatgcgggcagaaggagcagaacgagcgacggatggggatcggcgcaggcgggctgcggtggcgggaggatgtgctcactcaccaggatggatgcggtgggaggatgccgacgaagcggcggtcgcgtgatggatgggggtcgccggaggcggaggcggcgcctcgcgtgatggatggggatcgccgaagccggagccggagccggagtctgcggcggcgcctcgcgggatggatggagacggcagcggtggccggtgggcgagatagaagcgtcaaaatggcgagggcagtttagtaatttcgcctagcgcatcccattccttgcaaattgcacatcccatccccaccgtacccgaaatatgaaaaatagaaacaatgtatatatcacttccaatcccatttttcaaattaagcccttgggattaacctttaacacggcgggtttttattttaattttttatatggttgagatggtggataaaaaatagctacctttggggcactgtccgattaggcacggctgaccgaacagccatgctgtgtcggccctatgtgctgggtctagagcccaggtacggtccagtgagatgagatgtcgggtcatgttgagttggcatggcacgattagtttacgtggactgtgttgaggccggttagcccaaatttaacatatactaagaaaaaaaaatatgaatagagtctgttctatcatgttgcacaaacttcggcacatgttgcacaaatgagatcccccgctcattaatagcacattcctcatcctcatcgtcaagcaatgccatggcccttcacttcctactttcttcgccccgagctggtgagtccatagtgatcgctatgcttagtagttgtgctcacgaattgggttggccataccacgatgctaccgtgcagatctatgtcgacaagcatcctccgtcgcttcctcttccctgaacccttggcttcttcaatttttccgttttcctttactccgtcggtcccatcgtgtcgcacgggccaagctatgcgctattcctgggtcatgtcgtgctggctcacacatgcacttgttgtgttggcatgacaacccgggtagcaactgaagcacagcctggctagacaggtcgtgccagcacgaccctccgctaaacggatcgaccatgttgttcttgagctgtgagctgcacatgtgtgctcggacggacacagaagtaataatatagtactttctttattaaaagtaggaatttcttctatttttatgattaatgatgcttccgaattttaccgtttgcttagaattttttaagcccctgtctttttaataaattcagttactttctttccgtggaagatttgcaattttttaagcccataagtttcttatgatataacacactgttttttaatacgctgtttttttgtactactgcaaccggatcaatggtgacacagttaataatagtctagcacatctatttgtacatttttaatagaacaactagcctgtgaatgtggacgtcagagaatacaccatacaaagtggtatgcttttgactctgatactgtggactgtccgaccattcaaaaatgagatatttacttcggtaaatatacttgtgcaggagacccatggattcgattgcccaaaagccttgcaaaacatcttcatttcccgaagagatccgtaccacatcacatgtacacataccggcacccatcataacctacacaaattaatgaaacaaaacaatgtgacaataatcaaaacccattaaaattcatcaataaaattcatgcagaaaaggagaaaattttcagaactaccattccttccttttcatatttgaattttttttatcaactttttttttaaaaatttgaccaactttatagaaaaatatagcggcatttccaaccccaaacaaatttattatcaaaatatattcaatattatatttatgaaattatttgttgttataaacatggtcgaacctaaatatgtttgaataggaaaaatgttttataacatgaaatggagggggaagtaaataaacaagtaaaatgggaatgggccgtccttgggcctaatgagcagaagaaggccttggcccaataatgcaaacgatcgacatggctgcgtacttactgggatccttggtgatgagcatggcggcgccggcgaagtcgcacgtgccgccggcgaccttggtgcgctgccagtagctgttgaaggcgtaggaggcgtgcgccatgagcgtgtccggcaggaagcacggcgccccaggcgccgccaccatgtcgcagtccgcgcccgacgcgcacgcgtagtccatcgccgtctgcgccaccgcgctcgccaccgtcgggttcgccacgcaccacacccccgtctccctcgcccccggcgccggcggcgtcgtcgttgctggcggcgggcttcccgttcccggcgcgatcgatggcggcggcgcaccggcctgcaccagcgttagagtgtttacagctggcacgaaccatggcggctatgttacggagctcgacagcggttgcagtaacagggactgaaaagcccggcttggtaggaggaggagggtacacgcagtacggcggcggcggaacgtcgtcggcggcgaccggagttgatgggcccaccacgtctttgaacggtggcaacggtgagtactctcttgaggtgccatttgctccacctacaatgcacacaaaagataattaaacaaggtaattaactagattaattggaccaaattagacgaaatcatacatatatatgagcaagtacaaaatcaaatcatacatgtatatattagtatgcattttgtagctagattgaattcttgatgcataattaccacattgaatggagaggatgagagctaggaggatgtagcgcttgatgatgatcaccattagcggcacaatgaatttcatctagtcagatgatcctatatatgtatattaaatttactacggccgcgaggctaccaaactgatgcttgtaagacattggagtacggggagagtgagacattgatatagtgttgcaaaggaatataaggagaaggattctaatccttctatggactacaccctctgtcccaaaaaagacaaatcttagcatcccaatgcaaaattaaaggagaggataaatgaccaaataacccttattattagtaaattagtattggtgggtagatagataaggggtattgaaggaataaaattttttgatttgcgaaccgagagtagataagaaggtagatgttgatttattttgggacaaaaatttgaatttcagaagttgatttattttggaacggagagagtcctctattctaaaataaacgaatttatgttatggtatgacattaccataccttacattatcttgcacctatccagattcgttgtactagcaataaattgaattacacatttgcgcgcactaactaattatttgaagccttattatttaaggctggttacaccttatgtcaatgaacaaaggaaaaaaatatttataggtaaaaattttgtatctgtactagtcaaggctagggaaaaaactatgtgtgaatggaaaagaaagcgccaaattcagccactagcattaagtttcaaaatttaaattttggttgcacccaacaaacagatgatgaaagacacaatattatcatattgtttgaatatattttttaaaaaaatataacgaatttttcctatgtaactatatgggatcaatcactaatattttagatgttaggacagaggtaatatgtataatatttgagtaaaaagatacaagtttaaaagagcttgcaacaaatggttaacaagtctcaggtgagcaggcaaaggggaagcaggaagaattttccagctgcatgctagatgctagccagatttcgctatgcaggctaaggtgcataagaatattggttacttggttcttcagaaaattggttatgctgcaaatgtttatttcttttcactgttgttttcggcgcattttgttcggattcttgatcttttctccaggtgcagttttggcacatgtgcttgcttggtcaatgagaaattcaaaaaagaagaagaagaagaagaagaaataaataaataaaaagaaaagaggaaatttgattaaagttgcacgtatgggatgggtcctttttcgttgctttggttccactcaagcagagacaactggctgatacatcattgcaaacttgtttgcacataaatatggaatacttcatattttcacatggccatttcatcgtttaatttgttagagaaattaagaaaatacgggtgtgaagttttcacaatgtactcatccaaaaggtagttaatgcatgaatggtctgctaaatgtcaatgacacataaaaacaataatttgtcaactccctgatttatactatttgtagaggtatgtgttttcatcttaccaagctataccaagtact

SEQ ID NO: 37843 - DNA, 1173 bp, Oryza sativa
agatgcacctgatagtttagtagaagggggtgtgtgatctcaaccctaagatactcatgtttaatttccaacacgctcataatttcttattaaaaatattatatgttttctccaagtcacataattcaccatatgtagtataaatggcatgctaactgctacttggcgaccagaggtgatttaatttggagatctctgataggctgtttggtcaagttttaataactttgttctacagttaaagtgcaaagtaaaatttagaattgtaatagtaggatataagcagcattggacattttttctagacaaacattataactacatgttactaatagtaatattggtgtgagtacgacaagtcgaggtctagtttgttgaggatcgtgcatacctagaacatataaatactggatgttggatgggaaaggagtgcccataattaatatcctggtgatgtagaattcaatataacgtagttaacaaatagtataatgtcttcatgccatcataaaggcctggtttagttcccaaccttttcttcaaacttttaactttttcatcacatcaaaatttttctacacacacaaacttctaactttttcatcacatcgttccaatttcaatcaaatttttaattttgacgtgaactaaacacacccttatatccaaactattgacgtgtatatcgatgctttacaacaacattggttctagatcttaagagaattcccaaaatgtgtgtagtcaaatcttaaaatcttaaatcactagtagataaaaatattatgatttaaaatgtgtaaatgatattaattagtagattttctgtgcaaaactattcctagagttatatttttaatatgttttataaatactttaagaaagtaattataaagcatatgcattatattgaagcttacgtggatgtccaaatcaccgtccttttgagaattgaggtagtcagagtttaagcactgtactgtatatgcaaattaaggtttaatttggaatcaaggaattttacatgaaaccaactatttcttataaaaatcttgtaaactttctacgtcatttcaaaagagtcatgaaagtttataaacttaactgacaagattaaggatcaattggggagtattttacatcttagtctgcgttggtttgggatggttagaa

SEQ ID NO: 37844 - DNA, 366 bp, Oryza sativa
taatttttttattaaaagttttacaaaaataattttccattttgaaaattgacggaagtagtcgcctaccgccctctgggcgtgattcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgtcgtggactgtgcgcgctactggatctgacactaccgtgaagcgccgaaagtgtgttgtcgtgagcataagttgttctagcaccatatgaatgaaaagaactatctagaccagacaaacacaagtagtactgca

SEQ ID NO: 37845 - DNA, 256 bp, Oryza sativa
tgggggtgatggaagaagatgtatgtgaagttgttgcgacttataactaattacaaatggtgaatcgcaggtatcttgtgaaggcggctgatagcggggaaagcatacggctgcagtatcggtcgctgaagaaagtgtcggagctgcagcttcagtcagagatgaggttgcagccactcaccttcctgcacaacaaataccccagtagtggcagctgagttgattgactatcatcagtctcaaacaaaaaaaaaag

SEQ ID NO: 37846 - DNA, 575 bp, Oryza sativa
aataagttgtttaagcaattacttgttgccttcagtatggaaggcttctctggattgggtgaaacattcttaaacatagaacactaaagagtggcagggtgaaagatatgtgcgctgttgttggacattaaaagcattttttttcagggttcattcattaaaatgagcatttttttttcagggttcggtctgcttgttctacaaaccagtaaaggcgcttttcactggagatcacgttgcaaaatcagaagaatctgatgatttatatctctttcttatgtacagcaggcaaccaggtagaatcctccctagattttggctaactggacataactgtgcaattgtacaattagcttacaaatcggattaataatctatctattgcataaatttgcagtgagcttgcaactggacagcatgagaaaattgttgaagttagacttcgagtgggttttacctggtatgcgctcattcaagcattgcggatagagtatacctttttaagaaatgagaaagtccctgccttagcatttagtttctgttggtttctttaaaacggcatgattgagtcactg

SEQ ID NO: 37847 - DNA, 722 bp, Oryza sativa
ttcttaatttctcaccatacatactagtactatcagtgcaagcaccctaaaccggaacctagcctataaagttgacccgaagatactcatccctacagtgcaaatacctcttttgtgtgacttaattagatgagtgtagtgtgggaggaaaccgccctatagtgggcgtgatctcgggctgatatcgggctcgtggacacgggtagtggggcgaaataatttccccacctaccctggactcatcttctcctagccctcccccccatcgctttctcctcctcccggtcacccttcccgtcgctgcccgtcgcctcctccccgtccggcgccagtcccctttccgctcggtgggccgcactgctcctcctcgcctcaccgcgcctcttctggcgtcgtgtctcgcgcgccggcggctgctactgctccgacggtggcgagttgcggcaggcagcggcacaggcccctagattcgttggcggtcgtcaggaggcgaattgcctggagaccccggagcaagccaccgcggccgcgcctcctcgccaacagtgcacgcggcagctgcgaggaggagggggagtagatccgggttctttgcggcagcggcaggttctcggtggcgggaggcgtccccggttcccgccgcggcgtcggtcaccaccagtggcctcgccgccgcgcggatgattgtgcttcttgacttttcgtgatgatttttcttctct

SEQ ID NO: 37848 - DNA, 690 bp, Oryza sativa
  unsure (1)..(690): unsure at all n locations
gtgctcgccggcgcccatccatccccgcaacgtgccgccccagagctcgcgcggcggcgccctgagactcgtcggcttggagggaggaggagctggaaggtaggggatctcctgcaggggcggttgccgatggctanactccggttcccagcgggatgaggaccgtgccgcctattatctcttccggaagctccgggccaagcgacaacacgtcggcggtggcgtcgcactcgaagtccaggaagacagtgcgcttgcggttgctgaccccaacaatggtgttggaggcgacgacggcgaagttgaggtactcgagagcgagccgccgcaacgtgtccatctgcgccatggggcggggcaaggcgctcaacactgtccactcgtcgtcgtgggtgaacatgtccttgatgttaatgttgaacaagaggtaggtggtgatgcaatccatcctcttctcttcttccaccaccaaaactagagttttcctcctccccttccatcttgtgcttgtgcgctgctgctgctcatccgcctccatctttttttttctttccgaagaagatactccctgcccgcctagcctgtatcgaggaaatcttattatacacaagtggagtatgtagtccgattccgtttcgacctcgctggctgcatcacaagtcgtttcgatcctacaactgtgtcgctgtt

SEQ ID NO: 37849 - DNA, 36793 bp, Oryza sativa
  unsure (1)..(36793): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcatcagaaaaacctccgaaggcgttaaccatagatgagaactgtaagattttgatatccttatatggtttgaatatatccaaaagctgaaaaaaaaatagcaacttcagaatatgatttttccataagataccaaaagataaagcagaccttgcaataggcaatggctgctactaggagtataggaatcctactctatgttccacagggtatgccgtttcctcttatctgaggtgtgtatatgtctcgatatacctttatgtttagtgatttttaatgacgggtgtgttcggatgtgattgctgcagcggctttcaactactgcggctgcagcagctgcagcagcaattgcagctgatcaaggcatgatacctcttgtctggtgacttgttggcttgtcgcacacatatttcttaataaaattggagtcttgtctcaaataaaatgttcatgtttgcgaacttcaaaattacagcattaattctgagtttgcatgatatgccttttgctccagttctcactttagcttgagtttcctttttctaaaaatcctataatctgggtactagtatagttccctcatgttgtgacaaataagtatcctctaatctaaatgttgtatatttgtatgcatgaccacatgagagataaattaggcatgcataatgtgcaaacaatgccatttaccgtttgttctgtgctattccttggtaagagaacaggcgcgcctttattggttctattagttgttgagcatctggtgctatgctcattgcagagctcaacctcaagaaatgattctttgacctatgcaagatgcaaaacaataattattagaaggcaaacccacctttcttactaccaaatattcatagtgaattgttaaaacaagtacaataataacattacctgtttaggcaatgatggattctcaagaaacgagtattctctaaaatcaatgtgtgggccaaactcctccttaggtaagtcctttagcataacatgtacctgtagaattaaatcatcgtagtaggaatgttagcttcatactggatccacctgtggacttctctggcctgtttattatgtagtgcaaaatacaagacaactttatttgtgttgctgaccagttggtatgaaacgccatcattaacactattctatctgcttataaatatctagcatttcaccaaagctttgttcacatatttgtccttttcaacttccctatgcaaatttcccacagtatccatgctcattttacccacaaaaaaccataagttgaccacacatcatttgttattcctgtgatggtaatccggtggtacttttgctatatttatgaaaaatattaatggcccgatatgtcaatttttatctgcacattgccacattctgagggtggttgcaaaataatgaataacgcatatcagtacagtaaccagatcagcaataatatgttgaaaagaagttttcagtacatagcactgtggtctggtctaaactccaaaccaccaaagcttggacaataaaaagcatggcaagcttcagccacctgccacctggatacatctaaaaaaaatgacatctaaaattctaaaactacagagaatttccaaaaatctaaggtatgctgacacatataacatgaaatcccagttatataatttactttaacttcactaaccatatatacttttgaaaaaaaaaatgtgatgaatttcctacaaaatatgattcatacaactaaggaaactatttctctaaccaactaatagtatgtcatataatatgaaaaatagtaaataatgttatgataacagaaatgaaaaaaattcccagtgtaatcacctcaaaaacatgatccattggacagaggaaaggttgtctggtcattgttccttccaaaactccaggatgtccaaaccacatcctatcaagcctgcaccataatggaggcattacctaaaagtacaaacagtagtcagaaattgggtgtccacaagtttgagcacaatacatcgaacagcgtaattctgctctcaaacacctccagaagttatctaagataaaaacttatcctcaaaaaagcaagcatgaagcacctaccatacattactactcaacacctcaatactcactaattagctgcagcttactcatttaaggataaatgcacttttgcaagttgtaaattttgtatcaaattaagatggtgcacacatcatcagtaaagacaaaattaacatctaaaagataagaacatattaataatcatttcaaccttttaacatatagaaagtttatggaaagagatcacattcaagaaatcgaattgcaggttaaatcaatctcaactaaatgtttacacttaatgatctgcatgtccactacctcacaatcacgaatagtaagtgtgtagtattcacactaccatcatggagttcaaatcaaactagaaaaagaatagaaattccactgaccagggtcctctttaatagggaagcaatagcgagtgcagttcttatttgcttcaactgaaaattttcaagcacatgactaatcaggaaaaagaaaaggaataaccatcaataacagaagtgcagccacaaatttgcagaaatatatgtgtagctgcagatacctggtaattgaccaatgcaaaatgagatttaacagtatgagcgccatctaacagcaagcttttaggaatgttgggtctaaatgataggaaacctcctgcatcataataccaggtaaattatggacatgatgaaaaaaagtagtaagtaaagattgtaggattcaaatccgaataatgttatatgcatgaaaataatttcatgtgaccatcttttcattcttggatcatatatggctacagcctacatggtttgtttaacagtgctccattggtaattctgagataacccatacagacgaaacattttaacactagggtacatcatggtcttcaaacataaaatcagaaggcatttgtacactagaacacatcatgatctttaaacatgaagtcatgaacctctgtcccaaagaagttccgtcatgatagggtcagagaataaacatacctggtgagtcatagtatgatggctgatcaaagaaaagcattgcttcacgcaatctatgacgctttcccacagtacctgcatactggaaagtagtatgcacagcatatggttctagccgaagctgctgatacatgccctggcaactcaagaaaaaaatacatttcaggtataaacaacccaagaaaattacagagaattttagacgaaagggacagtataaacaagatgcacaaagtgtgtgaaacaaaagaacaagaaccaaacatatgcaggacaacaaagataaaaaatgcaattgctaactaactgaaaatttactcaccaaagaaaaattttgacatgcaagatatttaatttgccaatttcaaacaaataagagcaactacctgcacaaaatatgtatgaccactacagaatatacttgctggtaggactccaagcttcagtttcccatcataagaatatacaagttcatcttctccaacaaccgggtatccaaattttttgtgtataaggtcattaaaagcattctggtcccacaacgtatcatcagataagagtaagtctttccaatcttttgccagcctcttagctggttcagtgggtcgccaatggaaaataccgatattgtatgcaccagtaactgtgcataagaaagggggggggaaggcaatatgttaggttcaaatagtaactgcaattgatggtaaacagaacaaaaaatcttattatacaggtaaacagggaaaaaaaatattatacaggcaaacagaaaatattggagcagattttttaaaacatcagaaaaatacagtaacaagaacattagttcacatcaggttctaattctctaggatttgctattgctgatacatattggaagctatattctacagcaattgtcttcaccaacagaagtccaattccagagtcattccactgtaaatatttaaaaattagttctattctcataagttgaactaaaattaattccaaactttcagaatttagtatcaaaaggtcaagaaaattcatctcagtattgtgcagttctgatttcctgatcttacagcagggcaatgattattgtagatagattagcactgggaaatatcgaaaaatagagaatgcatcacaccatctatctcgtcacaacatatgacttagataaggtgcattattgcaaagtgtagataattcaccttccctccagttctccaggctgtcatcggtgaccgtgggaatgacctggtcgctggacgtgaggagatccgcgtcagggtagcgggcgaggtagggcagcgggttcttgagccacaccatgtccgtgtcgcacatgagcagctcgtagccgaagggcaggagcgcgttgatgagcagcaccttctccctgcccatcttgtggaaggtgggcgagccccagacggcgtcctcggtggccatcctgctgcccatgtcgaagacggggacgcccctgaggtagagctcccggagcagcttggtgtccatggcgccgacgaggaggctgtcgacgccgaggtccgtgaggtggcgcacccaggtgaggatgaagtcgaggaaggcgtggttgccgaaggtgacgacaatggcgccgccgcgggcgcgggcgcccaccatctcgcgggtgaggcggaacgcgcgcggcgcgggcatccgctccctccgcggcgggggcttccagatgggccgattgtacatggtctccggctgcgccacaccggagactgcgcccgagaggttggcggcggcggcggacgcgggagggatggggagcgggggcgcggcgagcgaggagaaggaggagaggaggaagaagagcgcggagacggcgaacccgccgatgacggcgccgtagatcccgacgaagaccggcttggtcgagtcggcggggcaccacggcgccatctcgccggccggcggcggcggatcgtggtcgccggagaggcaaggtcagcggctcaccgctgccattgtcgggaaaggggactaggggaggtggggtttgagacgagacgggagtgggcggcgccggcgggtcggggggcccacctggcggtggctgcacggtaagaccttactaccgatgatcccgttacggtgaaggaatcacgatggaaaaagcacgctcccgtttcgctcgccactgtcgtgcggggcccacttgacagtgaaagcaagtagggagtggatttgtgtcttcatttccacatgttcatccgttgtagtagagtatgactgtcaactcaatcaagtacactgtacgagtggtgtgtttatgtagggcaaatggcaatgtccaagcgtacgaaaagggaaagataaatggatattcatctatgggtgtgtttggaagagatttttttggcagcagctgcggctgcagtagtttaaaacggctgtaatctgtagcagcaaaaatggctgtcaaacgaggtctatttctctgtgcagctatgcttcaaacgtcaaatagggtaattttaagcttgtctaatcatcacggtttgcgcattgaacgattgagaaattcttttctttttagaaatataatacaaacgcagacatccacaatgcgcgtacactcacccctatgagcacgcgcgtataacctacctctaagcacttctggaagattggattagcatatcttgagattaacaaagtcaccacgaaccggcgcctcattgtcgcctattactgaaagaacaattagccataaatacgagcacccgtgttaaatctaaattttaactctggtgagctagtttcaccacaagaaacctaaccagttaagatacgctcacttcgtgaaaacctagataaatttggtgcgtcgtggaatatagttttcacctaaaatattgttttctttgagcggaattttgttcatatttcagtactagtatcttctgtgggccaattattagagcttattaatatctttacgttaaaaatactcttgaaaataagttctagtttttaaagtccttttgaagtaaataactatatttataataattaaaaaaacagccctacaaaaattccccatgtcatctaaaactaatctaaattcaagccaaagttgaaaaatgcacgatattgaaacttaaaagttgaatattgtctggtttagagttaattttagtgttattacatttttttaaaacaaatatttaggattgtaaatgaacttaattttgtcatttatgtcttacctggtatacattgagatatacaccaaaatattcgtgttattagagggaggggaaatttgccaagattgatatggactcacttcattcacaaattatcatcatataaatttttcagtgttattcagaaatgatcagtatatttggtacttcctacatgtgactttttgttttcctgtgcagtataaaataatcagttgcatgtattgttcaatgtactaactaattgtaattgtggtgcatgactgcatgcatgcaagcaatatcattggcgcatattgcccttgaagcatatatataggacacaagaaatggtgttgcatgttaatcgatgtcaatttaagtgacatgtgtaagtgtgatggtatcgatacacaaaccatatatgctgatcatttgtgaatagtggaagtacaatttatcaaggatttgtccttttgccaccacattaaaaaaaaacagaaagttctaactagctaggtactacatctcttttctaactagataccaagggagctgccagagatttctgtcgggataaggtagtagcactttgtaaatgaccaccatcgagccattcagacacgcatagatgaagaagattttagcaatatcgtacaaacagattggaacagtctattccttagacagctctagttttttgtctcccatttctcattctgtttgatgtggaaaatttgcaacaagtcttgtggctttgttcatccgcagatgatgcaaaccggaattttaattaaattatctgaaaagctacaaatttttttttgaattttatttgtgcaatttaagaaattctaaacaaacatggatggaccgtgtcattgtagattactagttatcgtgcacatgtaaggcatgttttggtattatgtacaataaaaaaaatagaataataaatgtaccttttttatatagagcactccatacaaattctaaaggtaaaaaaagagtatcatagaccctagtaaaaagcatgtgttatgtgtactcctggagtgccaagctgtgcaccatgtaaattactacgggagaagcaaagcagcaaaccttgtgtccaagattgtggatctaattctagacaattcattcaacataggaataaatgttttttcaagaaggtcctcagacctaccccgtagcttatattgaaagccacaacgacaggttcgctgggattacaaggtttacatgagctcagagcaaaagggaagtctcacatggtcacacatcccgaccagctagggtcacttaaaggatagacaaactaaacaaaaaggggtaagaactcccatagcagaaattgacaactcttactttaacacggacttcaaactttttttggtaggaaaaacatcatccaactcttgatcttggtcgcagccttgctattgccccttcagacgtgccaccagagcctccatctgcttctccttggggaaggagaggtttccactacatcagttgagaaataatttgaaaaagttaaattagaagggagtaagcaatgttatctctaaacaccatatcattcctcgttagccaccaggttcacacaattgcagctaatcagcaaagacacaacaaattttgtacaaatttaagggaaagaaaattgttcaccagtttgttttattcgttattgtcccccaaaaaaattgtaatagatctctgatagaagaaatagaggcttatatcattttattttggtcttaacccaattgttaaaaaaattacagttagcatgattgaaaacgacattcttgtatgttttttcagaaatgaatcttagcaggatacccaattaaagctcactaatcccatgccttgaactgcatatggtaacatgcatgctccatgtcccatgcaacacgctgcatctggctgactatacaaaaggacaatatgaaatttgttaaaaaagtgttttttaaatagcacaaatagaagaggcacaatcatctgttgttactctgcagttgctgctaaatagcccttctgattcctgtacatagcttcagatccattaagcttcattttttattcagtacaaaaacgattttgaaagaacactttagatagaaacattggtttatcccatgcggcctctcgccaaagctgagtcgtgtagccaaaaagattgaccgtacagaaaaacatggtcacaaaggtgatgttttgcggcaaagggaaatttaaaatgtttaaagaagatagtgtcaccagagatatgttgcatcataaagtaaatcagagaaaaaaaacttacagcaattcacacaaaatgaatacaatttcctcttttagactccaaaaattcttaatgctttttctgcacttcacgtttgctcaatctttcaacacacaagctctttgaacatggctctgaagctgaagcactcacttcgctgtgcaaaacaggagaaagtgctttagcaaatcactgggcaacagtacatccacataggaggccattagagcaactttgcacataagggatcaatagatgtgtatattcctaagcattgttgttggcacccagcttgaaccaactattgtgctaatttagccaaaaaaggattgatccttgggaatcaaaaagtctatcaggcttgataggtttgtctgaattagtcgagggtgcagactgcaagttacatgatgttatgatgttgaggtgagatcgatttaaattaataatgagacacaacctgtcctgagtcaactgcttctgaaattcatcctccgtcactgcagagaagggcagtaccacctgaatagttggagttggcaaatcacctgcatatacacttatttttttattagccaaataaaatcttaattgacaacaagcacagtaccattagaatcagaaatgccataatcatgccttggctgctccttcgatgtgaataaatcaaactttgagaacaacatgaatataatatggttacctaccttttttcgaggccaagttatactggccgccgcagctgccgttctccttcttaggaaggttgaacccagtatcacactgcaaaccactcaattcccctaatcaaacaccatacgccaccaacatcagataaaaatctttagagaaggggaggaacatcacctgaactcctgaacatgacaaggtcatccatcgtgtagatgcgctagatccggcaacatcgccatatactgcaagtaccaagtagagagggcggggccatggcggtgtccaagcaatgtgccatcaccaccgaccttgcattcacacgcaagcaccacctcctctacctgacgtggcggcgtgcactgtgggagtcgaactcatgaggtgcctgaggtgttgagggatggccttggttcctcctccacctgacgtgacgtggtaccgtaggcggtgggacagctgtagcagtgcatatacactggatctcctcttctccactgcccgacgacggcagtgaggcgaagactttgatccaaggacgacggctctcgatccaaatccaacagcgcctgcgtgcagggaaggggagctggcgacggacgccgctgcgggatacgggtggtggaaggcgacaacggcgggggaagggcgagggcatgaggggctgaggggatgatatacttgccttggcagttattgcgacgatgcggggattgcgccatcaaggaggcgagattgacgatggcgatggggatgagaatggggatggggctttgggtggatgatgcagcgatggatttctggccgatgatttcaccgagccgattgacggatggagaagtggtggatcgaggcggagcgagtagaagcggcgcgtgttggcggcggcggcggcgacgccggaaggggacgaccctccgaaggcggcgaacggggaatgcgaggaggaagagggcggaggaggaggagcgccggcgggagcagcggtggggcgaggagaatcggcgcgtgatggcagcggcagcaaaagcgctggggaggagcgcgagtcccgcgtgttcagcgcacgctcatcgcgcgaggaggaggaagcggacggataggagagatggcggacggacgatctggatcaggagagacgcagatgaacggtagtgattgattcggatgatttcaccagtaggattggagggggcaactcctcttttttatattagtatagatatagaagtatagatgtgcaatactgtgatcacttagctaccgtggagagaaatggatattttgttaaaaagtaagagaagttctacacatgattaagcattaatcattataaacttgaaaaaagagattaatttgatttgttcaaacatcttctatataaaactttttttactagaaaaaacacaccatttagtagtttaaaagtgtgctaatgaaaaacaagtaagttaaagtttggattcgaaggaaaaaattcgaaattaatcttttttttaagtttataacgattaatgattaattaataatatgttaatgagttttatccttttatgcgtacgatgaatctttcttcaaactcgctagaagaaagcagtcttactacaacatactctatatatcgaacatattattttcaaaattttctaaagcacacaaaatataatctgaaaggggttgtaaaaccagctctctcattgtgagatatttgtacgcaaaaggccagatattttagcggcgaaggagatctttcccgctacagggcaaaagctaaagcgcctaacaatgtacttgagcctcgcgttctcttgtcccatagcgaagaaaacagaggcggctggcaagaaaaatgaaaaaataacaaaaaaaaagagggaaaaaaatcaaggcagaagaatactcatccaatccaaccacacgccccggccagctcgtcgtcgccacctcaccaccacacacgcgcagccaagcccctcacctcacctcacctctccatccacgataatatcatgatccatccttatatatgcctccttcgcaaactcacttcggattctcttctctttctttcatcagctatcacaattcacaagtgtagactgtaggatggccacgctctcttcctgcagccgcctgagcaccggcggcggcgccgtccagcgccgtccccggcggccggcaagcgctgcgaccatcacctgccaccggagctcctcctcctcctcgtcggccagggtagtccgcacaggcgccgccgcggcgcctgccgcggccacggcgcccgccgtgccgcagaccaacgagtgagtaactcacaaactgagctctcccctttaatttgtggctgatgaaaaagttgtgttgatttaaaaaaaaaaattggttgttgcaggtgctcgcttccgacatgggcggagttcgagctgggcaaggcgccggtctactggaagaccatgaacggtcttcctccatcggctgtaagtttaatttcttcacaaaaagaaatactttcactcatcatacatgtaacaactactccttctgatttatattataaatcattttgatttttttttcctaatcatttttttaaaaaaatttgactatgtttttttaaaataattaccaacatgtacaccgaattagtttcattaaaattaacatttgatatattttgataatatgtttgttttgggttaagaattttgttatattttcaaactttaaaaaataataagaaaaagaaagtcaaaagcaacttataatatggaacagcggtagtactagcaacctggcagattcatcatggaaatagtagctaattaagctgccgctgtgttcttaccagggagagggcctgatccttttctacaacccggcagcgaccaagatgacccccaacgctcagtttggcatcgcgtttaatggtaattgagcaccctcttaattctccttttcacccacccagtgtccgggaaaaattcaggctacaaattggtttgatctgaatctgattcaggagttgataactgagactttatttgctgcaggtggttttaaccagccgatcatgtgcggtggtgagccgaggcagatgacgctgcaagagaggggatcagctgatcctcccatatacaccatcaggatacgtgtgccgcagcatggtcagcagctgattgttttgtttcgttgaagatatgaatgattcgcctgcaatttctcattaacttaaattaagcttttgcatcatgctgacaccatatgttcaagtgatcgttactagtactgtatgtatgtaatagcatgttgtcatctgagtggccatggattcgttactagtactgtatgtatgtaatagcatgttgtcatcggagtgagattttgtctggttggttttgcactcgcagccatgaccctcgtcttctccttcacaaacggggtggattgggatggaccgtacaccctcaagttcagggtccccaagccatggctcaacaagcccttgagcttcttcaacgaggtaaaattttgctccgagttcgtgttgttttcaatcaaacaagcttgatttgtaccttgaatccaattttattgttaattaccatttcttgatagcttatgcactggaaaagttgaaactcctctttggatcagtgttaacttttagaatgcaccttttgtgctaataaagagagttattttaaaaattatctgtgacgacgatgcagggtctagcagacgaactgaacagagaaggggcatgcgacagagccatcttcccagacgaaaacgttgtcatcacaagctgcgagatgggcagctactacgaagagggggtaaaacttttaacctttatctcaaattcatgattaatcctagccagttctgaaccgttgctgcatcccctggcactggcagggagatcgctgcaagctggacattgtgtcagggtgcatggatccaaactcgcacatgtttgatccactcgccaccgtggatgacggatcatgcccaatggattccgattccgaggaatgaactgaactacagtctcagcgagttttattagcaaggagaagctgtaattagtggccactgttgttcaatgtaaaaagaaagaagcgacacggtatgatgtacaagaaagcacagatgtgtgatagaatggtattagggaatgatgtgtgctgcatttggtgaaaagaatacacaactgtaggcctcatacaaatgtggttgttaatttgtgacagaactactctgaatttaatagagatcaacctatacaaataccatcaaagaaagtgtcggcacgtgaccaaaagttccaaaaacacgggataactcctgattaaacaaggagaaaaaaaaattattttctgatttatctatatagccttcagttcagagtttgatacttatactggaaaagtggaaatggacccagaacacgaatcaaccggaatttaagttcagttccagcacaattccaggcatccgcccgtttgtctgatgtctacgtactgcaaaaatgtcgctcatgtctgctagacgactaccaaattaggccaagaaaaaaaaaaccaagcattaagccttgaacattcacaggacaaagtctgcaaatggtccaagcaaactgatgcaaccatgcaaatttcagtcacagttacactgcggaaagaaggcatacatgtcaaggcaacatggcatgccatcatcacgccagttcactgatacagcatccagtcataatggagttgcacagaccatattactacaagggcaaagtcaacttgcagcacattgctgttcgttttgagtagcctcagtcacagcttagccgcctccaacctggcgtttccaggagtcctccacaataagctcgtcaacgccccagtcctcatagctatatttgaacacacagtaaactattataatgaggttacaaaatcaggaaacacataaatgtcttttattcaaatctcaccttccgtcaggtaagtaccgcctaattgtgaatgggatcttgcgtgctctcagctctttcatggcaatctaatttgcacaaagacaatagtttagcatagcaagtaatttgaaagatagaataaaatcaactgacaatttctgacagaaagagagaagaaatctaagtagtatttataatgagttgttgataagtgcagtcaacattcatctcatcttggttttgtgggagtactctaccaaaatatttcagttaccatgcctaaaacataccaaaataattttttatccgggaaaagcaatctaagacccttgtggaattctaaaaacatgtgaaaatttttcatgacatggaggaagagggacacgtgtaaacatacaaaattttaagattgagaacaatatgggagtcaacaaaaattgtattcatattccggaagaattgatttcttctatctcttccttttctctgtccatcatgataacaaagtttggcatgaacaaagaaaacccggcacctgccttttccttttcctagaatttttaaaacctccggttaactcttccgatttagatataataaaccttctagaagttggaataaggatggaactaatgcgtatgaaagtcccacttcagggatagcagtggcatatttaccagccagcagccatataatatatcaagtgttacaacaaaaccaatctttggtattggactatcaaacactaaaacataatacagaattaatcaattgccacttgttctccacataaactagatcaatttcatgatatttgaaatgccatgaaaaacaatgtataagagccctgactaataacttctgtctgggtagaagaactaattcaaatagacaagtcagggtgcttgtcaacatttgtcctatctgtttttatattgtggaaacaaatcacagaatcacaaggctaccaaataatagtatctagagccttgatgaaagaaatatgtgtacaaatacaaccttgtgcatactagtataattgcagacgaaaacttattgtcagtcacatatttagatttcaagctgactcggcgtggcagccctccatgacgaaaaaaagacattctattgattgaattgctggcctatgtctatacacaattacatacagctatcaaacatgtgtactttgttgaattatatattcaaacgttaattttattaattagttggcagtcaggtgttgtatgcctaaacaagaaaattccattgttcattttcattcttcatgatggaaacagatgtttattgtaaaaggttatttaagttgtacaatataagcttggtatatggaactggcaaaaatcaaaataatgaatatgtagaggttatcgcttgtttgaacaaatacctattgcatgtatagtttggaaaaatagaatttacctcaagaggatcagtttctccctcaagctcaaccataactggagcattcatgctataaaacaacagcaagggttattaatactgtatggtaaactattagccatcaaattggcaatactgtgcaatatgatatatagaaacataccttatctgtaatgcacgtgtacccaggatgcgggcacgctcatactttgtcatatactttgacgttttgcgtgggcgctgagttttttcttgttccttatcttcagcctctgcccctacaacctcatcagggccatcctcgttattctcaggttcctcttcagccccttcctattattgaacagaactccatcagttcttttccattaacagataacatcactgcatgaggatagcaatgtgtgtacctcaatctcaggttctggtggctcatcctcatacctgcagaggaaaatacaatgccattccaaaatcaatatccaacaaaacaatcctttaaaatgacatataacaatcagtgcttcagcaatcatatagttgtgcaaggataatggtagatatctcactaggatgaaatgtaaaagaaattcaaaattttcacttctaccaacactaatgaacataactttggtctgtgtaatttagtaattacactaaaattgaatattcctgagaaaatggacatataactaactaattcatatgttttaaccgccaagccaccacagtaaattaagcagaaaagaatgaaaccacacattcttgttccaattagaagcaagatgttagagatcctctaagtttttagctagcgtgacaaagttaggattccatattagtacaatgaccatctatcttaatatgtaatagattttttccatttttatctttcatttttctccttgttttccttatatgcatatatatttttcccctttctttatactgctgcataaatgatttgcaccaagcctcctattacatcaattgcatagctcccctgacctatatcggtctagccaatcccttcatgtccatgtcaccatagaaaggagcaagcaggaggtacgcatgagaaccccccatccccgactgcgttcaatgttcttttctctcaaacaaagcggtatagaatcatcaatgaaaattcccataattggtgagcgggattgtcgcattaacccaattgattcatccaagcaaacctaaatttcaaagaacctgctaaacctaaccataaccaaacaagcagggaaacagaatatcactctttacagtatccccttctgttgctgacaaactaatctcagacaacttctaagagccattactcgactcaacgaacgaaacatgccctaagaataatactcgactcaacgatcaaaacatgccccaagaataaactccaaagacaccttttacccgtgaagaccagtacgcatccaacattaacacctctcgttttccaaaaaccaatcgagtgaatcgcggcaatcgccataactagcttcgactcgaatcaacgaacccaccaccccaaatgctccccatggcgatgaggagcgccaacgaatcacccagcacagactcctaccggcgcaacatgttacacagagagctggttcgaccggtctgggattagaaatttattagaacaggcgatgcctatcgaaaccctagattggattcccatgatcatacggaaaaaggactagagagagtgagatagtagagagtaaggcaaaccccatgtccatgtcgttgtagtcgtcgtccgccatggcttccgccgcctctgattccggccgctacaatcgctagggtttcgccgcacggcggccaagcggtgctcgacagggagaaagggggcaaatgggactctgggagagcgcaacggacggcccaccagcccgggaaaaagaacggggacaatccccggagaatcgtagaaggatctggaccgtatgatccgtatctgcagaaatttcaaaatatggcattcaatgcgccctgcagaatttatcagtctatccgttgttttcagactatgacattaggaatttaggatacgaatttttttcgttctacgccactttgtccgccagcgtcggttgcgtcgtcctagtccaccaaccgcgctcgcgtaagccacaagtcattgttcgtctgttcaccactcgtatcagtcgagtcaccctctgtccgctggcgtcatcgttgtcgacatccatcatctgcatcgccatccatctgtggcaccgtcatcgtctgtttgccaccatcactgtgtcgctatagtccatccatctgtggcaccgtcatcgtctgtttgccaccatcactgtgtcgctatagtcctctgcaacgccagttgtgccaggacaccatcgtcctcttcctgctacattgcgggcctacctcgaaccaaaacctacgtgcgcttttgccgtcgtttgcctatgatggattttggcatccatccggacctggattggttgattcatcaactgatgacgtcatcttacatgcttagtttgcttggattgcttctctttcttatctcgcccctttatatttccctctttaactttttccttgctaatcaaatttggacaacgccggcagcaccgacggatgaacgacggcaacaccgggcggattaacaaggatggggcaacctatgctggtagatggagtggcacataatgaagaaaattcgcagcctagtgttgtattctaaaagaaaagtaaattgggtggcaaattctaaaagaagtgtgtattggtgatgaattctaaaactttgtttgttggatttaagctcagttctagtgagcagtactcccctttctccgaaatatagatatttctagataattttggagggattaaggagtgaaggcgaaaaaatcatagcacccttcagagttgttcggagaatcaacatgctgcagcgctgcacctacaactacagccaggggcggatctatagtactaggaccggtgtcaggcgacaccgacgattttcggcaaaacctatagcaaaactgcttattcatatgttataacactgtgatctaaatataattagtatactatgacaccgatagacacgttatgacaccaatgaatcgattttctggatccgctactaactacagcggctacaggaggatgggctgttccctgctgcaacaaaatagttgggctttgcaacacagcccaaaccgctacatcatgggatactaaacaaccccttcattgatgcacgtaggacttatagtctacagaaaatagggtggttgatgggttaaaagagagctataaatagttatatatggggtaaatttgaatcctaaaaattagttatatattaagatggagggagtagcagttacctttaatttccacttgcatgtaaaatgaggtaagccattagcttatgattaattgaatattgattactacaaacttaaaaattgtgtttatttgaatttttttaaaaaaactattatatagaaaagatttatttgaaaatgtgcttaaaaaagagaaagttacaactgctaaacaagaaaacaaacaacgcgttagggtttttagttaatttgtagtgatttagaattttatattttcacaaacaaaataattcattcaaattaatattatgaatgtaaacacaaatctagatatagatttataaatctaagaatatccaacttcaataatattggctagagctgtttcaaatagggacaatgtgggtagaattttgttcgtcaattcgttccattaaaaaaataaaaaaaattctttgttaatttcctctaggtttgctaaatgattccttaccgttgtctatttaattagtgttttttactggctctgttattttagcattttaatctctattttatttcctgaacgtatttatatccgaatctaatgtgcaaacatactcgaacacattcaaatcgggctcggctttaatttttagtgtaaaacgatttacgtatgaaaacttggtatatattaacttttcctaaaaagacgattctagaccacgcttgcacaaacagcccatttcaatttggttctaacatttacatgaaaatttaaacaaatgtgggttaaaaaatacggtttgctgagatgaaaaacgcgcctagctaggttggtacatgggttgatttgagtttcaaaattattatggcacgtgacgcatgggttgattttgagtccaactccatatctatacatagttacaagcctacaacgtgttcacaggcctattcagaagtcttcctggataacagtacgtgagctggttgcgtatttgtagacagctaacgagcatgtattagacgtaccttttttttttttcttgaatacccaaaagatccgtttatcattatattaaaataagagagggtataaccccgagtacaaaacaagatacacccttattaaattataacaaccatatgtgccacaagctcgacaatgaacacaactaaaaaacggccacaaccacaaacccgactataaaactaaccacccggctctcgagcaagctataagaatagctccaaggcccagccaaacaacacagccattcttttgccttggcaacaaagaccacctgctaagttagcagcaaccccctaaatgacacattaatttcaccaaaatgactacaaattgagcccgtattgcactgggtcattagttgcctcattggtcttgtttcataactcctccctttttcaccatcaggccattagaatgactatagacgtaccacatttacacattttctcctcttttagtatgacaggcattttccttgacaataggtgctattctcaaacatcgtaaagatatggctcctagttagggtggacaatggatgaaactaaatattatttgagggcacaaataaataaattaaatattaaaaagttgaaaaatgtcccataataaacgtcgatgaaaaaattttttgtgaaaactgtaaagctaggaacttgggaagtgtggcggtatgccaaccatctgttagctcacaagaacggggcctctgttgccggatttggattttaccatagctactagtcctgcttagaatgattctaaacttgaatttaatatttgaaattcaaatttgtatttaaactcacatccttcttccccgttaactaggagtactgatttttggaaactgaatattgtaccagtataagcagtagtgcattattacagtttttggcaggatttcttatatatttatttaacaaagttcgataaaaaaaattaaatgaaagcacacctctaacaaatttgccaagagtggtacggtttgaaatgacattgatcttaacaaccccgtatttcttactaggtgattctccgtattttgctgtggaaattactaagtaatttttagagtgaagtgcatggatagtcactaaacttgagcaggtatgtcacttaggtccctatttttgagtccctcaacttgtcttaggtgccatataggtccaaacgagctctaacccacttcgtgagatgacgtggcatgccatggtgacacttacgtgtcagtgcgatccacatgtcagtcacatagaaaaaataaaatttaaaaagagaggagagagagtgagagagagagagagagaggagaaaataatgtttttaattttgaaaaataaatgaaaaaggagaggagaaaaaatatgttcttaatttttttctatatgtgattgatatatggtttctactgacacgtaggcaccaccatagcatatgccacgtcaccaccatggcatgccacgtcagtacacggagcgggttggagcccgtttggacctatatgacacatgagataagttgagggacacaaaaatgtattttgagagttctaggacctagatgacacacccacagaagtttatggacctccaatgcactttactcaataatcgagctaagagtgaaacggatattagtttgccaaactgaaagtgcatctaggacccctcatttgttttggtgttaatgacaacacaattagaggataactaatgctttttgttgagatgtatgcaaggatgaaaaaggagtggaacttaagcatagaaagctttgtggcaatttgtgtggtaatcacctctctaaaccttgtgtatcatgtgttcttgagtattgggatgccatactattaagagggataccacatgcatataattggtagaacactagtgctcaaaatcctttctttgaagtgttcctgttttattcctgtcggactatccgatcttgatcagactatccgatgctcagactatccgaaatttcacagaactttgccctctgtctttggtcttagtgttggtcataaaatatcggactatccgatataaggtcggactatccgatacatcggactatctgaaatttctcagaacttcactctcggttttgaattgctttttattcctcttgagtgaatttcaaatcagactatccgatgtgatcggagtatccgatgacccagagactccaaaactcaatggaacttgagtctatgtgagaggatgaaattcatgactcaaaaataacggaatatccgatatgacatcggactatccgatcgatcggattgtccgaaattctccagaatttcgttctctgtctttggcttgctggggggggtcaaaaacatcggattatccgatgtcacctcggactttccgaggtgggatgaaaagattcccttcccaacggccacattttgggggatctataaataccccccacctaacccttttctagggttacccaactcattcattcacattcactttagggttgagcttggtgctaaggtgctttggatctttgaactcttcctccctcactcaaatccctccttgttctttgtgtggtggatcttggtggttgtggatttggtgtttgagggcctagtgtgtgtttcactcgatcttgagcactagggtttgaccaagagttgtgtggtgtttgttattcttggaggttgaggactcctagacggctaggtgtcactcccgagccaccgatctacgtgtggttggccgggagaagtttgtgaaggttggatctcacctccacaaggaaagagataccccttagtggaagaaggagtgcttagtgcaacctcttgaggaaagggttagcaaagacccggctcttagtgagctcctcaacggagagtaatatcccctcaaagatttgaactccgggaacaactccgtgaacttcattgttggtgatatctcttcatcttctctttagctttgcttaattgtgctgctatagatctattcgctgtttgcgctatactcttgtttgtgtgctagatctgcttgttgtgactctttagtggatcagacagtctgatccaacatcagactatctgatattttcggatagtctgactgtggatcagactttccgaccctaactcagttttagcttccgtataaagttttaaattagcctattcaccccctctctaggcctaattgaccctttcacaaactatgttcaaagagaaataaatttaagaccgataggagattacagatgaaatatgatatctcgcgctttgattatatggataaatatatgttaagtattataaaaatcattcatatttatgttgaaaatattgtgaaaataatatgaaaaggtgattatttgatatgcttaaatattgatttgtagaattcgatgaattgtagatgatgttgcatgcatgagctttgtttataattattgctagtagatgatgaagtagaattattgcttgtagatgatgaagtagcatatttacatcttaaattttagacctattaagttacaactatatagaaaatagaaagtatagatttgctcgtgcaaaagaaaaatctaggaatatatcacgcttagttatctggatgtatattattccaatttttaaatttatgctagtgtgcggatgacggttcacccatataggagtatattcttttcgaaacttttcctatatatattttttacaatgtactgtacacttgcataatacagctcgtattacaatatccgtatgtggcaacagttttgagttactgataaagaagcagacagaacaaggatatgcatatatataaacaaattacataacatttattgcaaaataaacggagaaaaacaaaactagtaacctcagctatgttcctctacaatttaacctcggaattatatatacatccttgctggtgccaattggcgccaacaagtctggtaaaatgtcctacgaactactcctttctgccggttcttatgtttcctccttcctaagaaattatttcagccctatcttcctcaagtccacgaactagcaagctgttcaatgatccaatggagagataactcatatatctatttatccagttttagattatcgcagagatggccaagttcaggcctggcctccatccatgatgcaaatgttggctcacgcaaagatgaacagtagaggtaggatcggaaggtgatcaggaagaagtaccgcctgcagttaaacagttgaaatcataatattaataatttggaaacatattgggaagagattgaccatctggaactggaaacatatactcctaggacacagcctataggatactgtaaacatgtaggaccgaccgtctaggatactgctacacccaaacacaatgctatacatatagcttgtatttattcagctcagaaaaacccaacatatttcttcaaagaaaatgtctcttagattttttgttacattccacaggacaagtgctttccccttaattttgtgcagtgtcattctttttgatcaagcaactgtttagcatttaactaaaccgagcaacctcctgaagtgactatatcttgggtgcccaaaaactaacactattttgatctaaatatgaatacttgtgcaatttgttttctagtttttaaattttagaaactatgctatatttgtagacatccactgcacgcatgcagagtgcttagtgttgaagaaatacacttaaagaaagtggtggtttttgatcagccaagtcgagattcctttttcaatccctgaatatgagttctctaatgcattcaaactgcatatgaataaagtatcgtgatcaattttttatgcgtgattgttcatataactgttatgctatctacatacgaactatgaaaattgcagtaaatacagtaagtactttgcatgatgcatagaagattctcatgaaatggagtgtgcactccgaataaattgccgaagcaggacaaactctatccattaacaaatttgcatagtcaattactcaatacaaatgtaaatgcaaggggcgtgcacatttaaactactgtggcttttctaagcatgaagagaaagcagtgtaatcgagaaaatcctatatgaaaattacctcaaagctttagtgcccatatccattagatatgaccatgtctcatcatcatcaagtgaacaatcttgcagtgcctttctgtaatgcataatatcctcccgcaaatgcccagcaccaacacaccttcatgagagattggttttcagaatatgcatagcaataatcacacgagtaacatctatgactaaactaatataagttccccgttagttcataactatgattcattgattaatttacataaatgcctgaatgaagtaaaaacctgcacaatacctgtcaataacagtgtcaacctcttctttgcattttgggccatgtaccagtacccttgtaaggtttaatatgtcacggtagtcaccttgcttgagagctatatcagctgatgttttgatagacacactttttgtaagagaagttgatatgaagtgtgtttctgctgtttgttccatgatgaacttttcatctgctcccagtcccaggcatgtaatggccattgcataagcaacaccaccatatcctgtgtgtgaaataaagaggtagtacctagcattcctgtagagaagcaaatcattcttatagcctgcaactgagtaacacaatttgtcaagctatatcaagttgtggattagggcacatactcatcaaccgacgattgtattgcatctacatcagaagctaatgcttctctttccctggtgagaggtattcttttgtagtcgatacagtacccctgatttctcagtacactatatacttcagccggtgtcatcacatcctccgtacctatatgttcccaaaaacctacaacactactttggcctgttgacgagttaaattcttcttggtgcagaagtagccgaccaccttgttgtttaacttcggagagtatatcctcctttagtcttgcctctatgttttcaacctgcatagaagatcatttaaggtttgccatgaaaataatatttacattattggaggaaactcaccattggcccacttatgccaacatgcttaagagtatcaacaggctgatctagttctctcaaaacaaaaggtgttcccttgatgtaaacaaccacttcctccctaagatccgtgacaaccaccttttgaggaatgcttctcccagtatctttagagcccaaatatgacagaacttcttttgctccatcaacagttggtgtcgccatgctatacacagggtatccatcaacctgaaaggaatattaaaaaatataataaggtacatgactaagtaatcctttattataaaatcagttttctaaaagtgaaacttccatttagtacatgcactacctctgttgccagaagaaatgcaactactaattttctttacaactagtataagtagcacacagaagtgagaaatagtataggttttcacacccactgcacgtaaatgaaatgaatgtttaatccagaatttcatgatgtggctctgacatcaaacatcttgaaatgcaaacattaccaatcttttggctaacatcatcgctctttattgagataatgtaatagccatctgttcacaagtatttctttgaaactggataataaaaacaaatctcagtgggattaggttggaattggtagcatttattttattagaagtgattttcttacttcatcacaagaaccattgaaatgagccatgacagttatagcagttcaactgtggtgttgcatgatgttaactaggatcagcctcacattctagtgggagcattgcataggcactagcttgatgcaagttcatttagcaaacagtagccaatagggatggacatagaagaatgcaagcaaatcgcatgatcctggcctgacccatgctgtggctttggaattggatggtgcaaaggcaaggtggtgcaggagggacaaattacgacgagcatgatgctgtaaaaaccaccagggcaaaattcatcccgttccttttcgcaaacaaaagtttgcactttggctctagactctagagtcatctagaaatggaattgtacaactcatacatcacccatgattgggatggtaagctgacctttacagctgggaggattcggtgaaaagtaatggaacaagaacgatattgtccataaattaacacttaaacactggaagcatgaagagcgaaaattcccagaatttggactttgaagtgcaggtgctaccaaactaatcttttgtctacatcactaagacatgaaagctctactaaagtcatgtgtcatataagatataacatgagtaaattacgctggcgatatctgaatttgtgaggtgggggtaagtacacaaacttataaagtgttcattttggtgtaagaagtgtagtgcatgcaaaccaactaaccaaggccaaaacggcataccgtagctaatcttgatgaaatgggtgatgattagggcgccatgtcatggcccacgtgcacatgtaaggaccgtgtgttacatgttatatcaaataactccttgtttttggcttttttgtccttcatctattcctatccatacattcttcaattatttctatacaatgtactattttattgtacaaccatcatgcattatcatacggttgattgaacatgtatgttcctatgactcttcctcatttatacatctgcatggcatcctaatcactgtccaactccacaaaattaaccatggtgtgcagcttggctttattcgcatggactacataagttcatgtactagaatgggcattttgcaagtctgtaaactaaattgcaaatcaaatggtcgaatgatagaagatcataaagaaggccaaacaaacaaataaactattgcaatagcatgcttccaccaaagctgatgctccatcaaaacatactaaaaatatctttgccactgttagtgttaagcaggaggcacaacatcaaagctccaaaatttggaaatcctgtttgttactgaggcagaaatattgatgactcaattatgtttttgcagaaataactgcaccatggagtgtagacagaaatatttgttcgctactaccaattacctatgatgggtcagaaagttcgaatggcagagtttaattggcagaattgatcaataacatgaataactagattaaaaaatgcatatgcattgaataggcaactattaaatgcaaatttttgttacaaataaaaataccttgaaaacttgtggtgcaccacagaagttaatagtgcttgaccttttctgtccaggaaagaagtacattttgagtattgatccctttcccaaaacagaaccattacgagctttgacaatggcttccatcattacgtcaccttgtgaaggctgaaaagatgctttggattcatcctacaaatagtaaattataactaatggtgccatttcctcaaaggtgcaaaaatgatatttttggttagaagagatgaggatatttacattaacagtgaaaaaacgcccaggtcgtaaccgtatgctccatttcatgctttggatctctggcctctggtgtatccatgctttaaatgacatctttgcctctccttgcccgcagaaaccatcaaatgcttcactccaaagatatgctgagaatgcaactaatttcaagtacctctccaaatattcagcaccacgatttaatgcaaccctcttaactctttgctccacatgctgttggttaattacttttgtgtactgcaaaacagcctggcgaatattctgtaaagccgagcatttgtcaataacattatccaaagtttgtctacactcgattccgttgtcaaataatcttgtaatcttccgcaaaacaagtatgtcatcaattccaaatctaggatgttgttctgtcacagtatgaggtcttggtgaacttgaattaaggtgaccattgtgatccgttgtttcttctccacttgagtaacccaattcatttggatcttcatggttatattcacaagctggcaatctaataggtctgccatgatcaattcgcaatctcagcagacaagcaatcacagtacctgtagttgttcttcccctgcccatctacaaaaatcagtaagttaaactcaacctttgtagcctttcatataattcaagagttgcctaacatagaattctggactaataaaacaaatgaagtgcagtacctggcaattaaaaacaaatgcagtatccttgtgagcagctgccacatttaaggttattgtgtcaaaatctgaacttttgggggctttgccatcagtgattggcactcgagcatacttgattggaagaccttcagactccagaagtttgtacacctccaatggagtcaggacagcttcattatttacattttcccatgcatcaaatatctcaccattgtcagtttcatgaataaccattatggccccactatagcgttccgcttcccgtaaaatatcctccttcaaacgagcttccattcgttccaccctatcacgatcaattccctggtgttggtgcattgtgtatcatttagaccaacagaacagttttgggaataagctcaacagagcacatgcttcaagtattagtttattaagcacaacgaaacacaatagtagacaagtatacaaattccaaaaactgaacaaagaactaaagttttcataaaaccagaattagaacaagtcctttggacagttacttcagattaaaagttaagtagttaaaagaaacaaatatagttagcttagctatggatattaatattcaaaataacttatgagagttttcccattggtgcactctgatacatcaggaaggaaaaaaattacaagtctatgttagatcaggtgcaaaattaacctagggttagagcaaataatcttgagcatccactatgttacaaatctgtcaaagcaaccagacatgatgcataccgtgtactccagcatattcttgtatggtctttccacttcacgtagtacaaatggcttcccatttatataaataactggttcttctctcatattatgccacagaattggtcgccctcccttgcttgtactaatacgctgaataacagctcgaatgccatcaacagtagggtttgcaacaccataaaccggaaattcaggaatttccctaaaattaggtgcaccctccactctttcgggtaaatgaaggttgtgacaacctgggcagtggtcactttttaacacagtttggcgtccaagaacttctccatttctcatggcagcaacaatatccatctcatgagggcgtccatcagcatattcaacaatttttgcaagagagggtttcgaacttgaataaccaagagcgcccattggatctctcctcaacagcctgaaattatcaaaatgtaaaaatatgagtttactggttatgccaaaagacaaaaagttactgatgctcttactaaaatggataattttatacggtgtccttgaatatgcatcatcatacacactttccagtgttttaaaagcatgcagagtgtatggtggaaatagagtaatataacctttctgctctttaccctttgacattgtatgattataacatgaaatttgcatcaggactccacatgcaatgcatggctcatatggaatcatgaaatgcctttgtactcatgtgctgctacacgctatagtggctaaagcaggtttccgtgaagcaacaaccatatgaaacaaagctatagaagccagtacatgtagccacaccaccttgtcctctatgaaaacaatgaccttttaaactttaagtaagatttcagtttacagttaaataggtgcatatgcactatgtgcataaaatccatttcccaatatttatatggtatattcatgcctagaagatccttgtgatgaatggtaaaatgcaaaatgcctaagttggagaagggatctgttttatccttcatttcctcccttatttttgaaggacagatatgggaacacatcaaagaacgaagatgagagcacttctctagtgtcatgtatacaaaaaaccgttttaatattagggttcgcacagtaaattgactgattacatttaattaaaacaaacgcggtaattcttcaaatacacacagtaaatacgctgtaatattgagctataaatccataccacttattgatctccaatataaatttcacaaattactcctggattttgttttcttttaatgtggtaatcctgtgcatgctatagactaactcctgaaccacaaacttcaccaatgttgtgatttctcatgtggtgcaaggaatgggttgtcaaattaaggttgaggccttgtgacagctcttgctgttatgaagagctcaataaatacaaagtgtgagaagcaaagataaacatggtctctggttactgtagtgattttcatatatcaatcatatcatatcatataacttggatgagatacggcagaagttatgatgatgactcagaaagagagcatagtacactcatcaagacaactgttaaaatcgaaagtgtgcaaagtatgacctttttatccatgcttaaattatctcttcataaagttgaatttgtaatgaattaaccaattttcaaaaagttagtcatgtcaatattcatattttcaatgccatatagactcgataataaaactaccattgttgtttaagtaaaattgtttgttccaacttgcatgttgatcaagagctaaaagattagctcatcttttactatttacttccagttctccaagccataaagaggtgagttcaaattaatttggataaaaccatgatggtaatgcttatcgaagattacaaaaacacacacaatactttgagaaagatattagagaagggaaaaggaataggcaatgagcctagctccatgaaatagccaacgactactttttcaatccatggttttgacaccaggatgacctgattcaagaaatgtcagtgactaatatttcttggacacaaaggctgcctagtattaatgcctgtgtaccctagtaattagtccaaacaaaatattgaagaagcattgagatcttatctaaaacaagatctaaaatgaaagtccagaatgtgttacaaggaaagtaagtacatattggtacactgaatataagaattccaccttacttgtgaatagtatagtgatataaaacaaaatggacatgttaatttttaagagctcatctcatgtataaaaaacagaaccatgtttagcctgcatacactcttacaagctgtacatggtactatttttatagtaaggtgccacggctcacgttcgaagaatgctgtacagttcaggccttgctctcatccaatcagaaaaaactaacttcttctgaaaagtttgattgttgagcagagcacactgaatgaacatagacagcaaagcatatgaggaagtaataacgttccaagtactcaacaaagaaggaaagtgatgcctcccgtttcatctcatcaggttgtcgaagaatactattgcggtatgtagcaatagcctctcttaagttctgccatagtcacaacaagtcataacaacaaatatattaatatagctgtattaagttagtatcatgaagagcataaaatggtatacctgcatcgtgtcacatttatcaataactttgtcaacttgcctttttccttcaacaccaccctgaacaaatgaaatcaaaaaatgaccacactaagtgtctaatgtaaaagggatatgaattaacagatccaggatattacctccagaactcgtaccaagctcctaatgacagaatattctcctctgaggatagcttcttctgagctaggcatatagtcatctacatcatttccagaatggaagactttcccgattgaacttgtcctagggatacctgcagccaatagcacccggcacaactcaatataagaaaattcaaacacgaacctacaggcacaaaatgtaagaatataatgcaaaagatatctatgatgtgcatttagtagatttgtactcagtaaatacaaaatcaccacatgatggttcaaaataggcaacagtctgtatggagaattctgtttatcaatcaattgtacatataggtagaagaagcaacaatatcaccaatcaaattacagtctgtacttacctgatgatcctatccggttcagataaatcaatgttgctataaccataccagtggttgtccttcccctccccatttgacaattaaatatgatttcagtttctatatcaacttgggagattcggcgtacctgttagaaacagtggagttcaatgttatgcaactatcatatgaaccaaatttcagtataccatattaatcacaaggagtctatagatgattgaaccctggtaaatgtggatcctatcaactgtgcaaattagtttaaaccttttccaactaaacataaaagctcgcacatagggaaacaacagtaacatgcagaactaacagttcaaaaaaagcatacagaactaaccagattgtcaaaatctccttcttttggggccttttcatcagtaataggaacacgctcataatctacaaggtatccttgatgctgcaactcctcatatacctatacaaaggaaacaaattctcaaagggactaaaaataataaaacaatataaccaaaccttgaatctattcttacctcaagaggggtcttgactgtatcagttaccactgactcccactggtccaccatctgaccatttggcagctcatcagtgacgaggatcttattaccatatctgctccatcaaatattcaggtaaaacaaacaaacaaacctcttaagagtaaatacgggtagaaaacaatattggcagccgacgtaccgtgaagcttcctgaagaatatcttctttcaggcgaaactccatctgttccactctttcccggttaattccctacagtagtagtacatataccaaaaaaaaaagttaaaatggaaaaataaaatgataatagaacaatagtaacttcatgtggaatcaaagttgttttgaagggataggccttctcaatatggttcatgtttctatagccttgaaaacatatctagaattacccaaatcaaaatgagatttaacaggaaaagcattccaagtctgcaatagcactaatgcatcatcattcctttaagaaacagagctatatattttcctgggtctcaggacatctgtatcataacttctgctgtggatgtttagcaagaaaaaatatttttggtttaacaccttcatggacttctcatacaaaaacaagaaacatagagacatactgcatacacactctaggcatgactagaaaaattcaagacaaacatcaaagaataccgtatattcaaggtttgagaagggcctttcaacatctcgcagaacaaaagggcgaccattgatgtagataacctgtacaacattggtggaaattacaacttactaagttccttttttgtcaaacataaaataaaaaagatataaggtactactctatcctattatagggagaagtagtatttgttgtaacaaggaaagggtgtaacctgttcaaaggacacttactgcaagctaagcaaactggtccagaactcacttgaaatttgaaatttacatactgttaaggcatgcatgtcaagttatgtaatttccataagtacatattacttagaaaccttttcatatatttttttaagaaaaatacacaccctcttctctatgtttttttatttatttatgcctacctactgagaattggaaacggatgttctagacagttcaaaatccattgttcattccaagtttccaaccttttgtagttttgaagtggtgagcataatttaatgttcttatgctagagatgcttaattttctatcagtgaccagtgttcttaccggctcctcgcgaagactatgccatagaacctgggtttgttttcctttcttttgtgctccaatgtgatttaacacatttacaattcccttcattgtcggcattgcaacaccatgaactcgtaaagaacccgcctgaaaaacagttggcaacagtgagtaaatgacagaaaattatagatgattgagaacccaggctgttgctgaatctttactggataaaaaggacacaagaaaattacaaattggagaacacattttgtaggactattcattcaagagtttataataaacacgtcagatggattgtttagttcatacaaagttccatgcggccttcacattgtttttctttaaatgttatatcttctatcatcgaagactatgatgccttagcagaaacagcccagatagatatgcattggaagtgttaatgctcatgttcatcagtgtgatcaacaaaaatcatcaagaaatccaaatgcaatttgcatagcattaagtgttaacattcttgtactaatttattttgagatttacatttactattctgaaaacaagtaaaggcacttccggaaagaacaccaaaattatcataggatgcgcacataagaatcggtcatgctgcacaaggttaccgataaagcagacaatcagcgcacaaaacatgtaagagacataaacaggcaaggcaggtttcttccgtggtcgtgaagattggagccaaaaattgctgcagattcccgtcgcgaacgcatggaatgggggggccagggaaaccaaggaattcgcggcgcgcggcggactgatccggaaaccatccagattattactagattaggaacgaggagcaacgcacctggcgataattgggcgcgccgtcgatttgcggcgagaggcgcttgttctggcagccggggaagtggtcgctcttgaggatggtcttcttcccgagcaccgagcctcccctcgtgctgatgacctgctccggcgccacctgctcctccaccgcctccatccgccactcctctcaattccacgcgcacccctctccgtcagcccctgcgccgcggcgcatgcaaccagcacaacaagataagcgtaggcggcggcggcggcggcgagaagcgtaggcggcggcggaggaggaggcggaaggcgataacgcggcgagatgggaggatgcggggagcgggcggccaataggcgaggcgagacgaggcgaggagatgaaacgcggaggcgaaaggggacggttggggtagcgaggccttgccttataggagtactacgagttggccgcaggccgcagctgcaggagaggcatgtggcgatggggatggatagataggctaggcagcagtgcagtgcagtacaggctctctctgtccctatctctatcttcttcttctctctccctggctgcttgccatgtgttgcagtacaagtttagtactgctactgctgatgctgctactccagtttccggatttgcgatt

SEQ ID NO: 37850 - DNA, 32556 bp, Oryza sativa
tcattgattagtagtgattataacaaggtaggacgactagttgggtgtatgtgaaaccgagagccgttttcgacgagattgcaaaagggatctcgagttcgagatcgcgtactaaaaagcagcggtcggtggcagaaagtccaaaccaaacccccgccttttctccatcctcgtttatcgatagccaccaccgccgtgggcatattcccgggccttttcgggttggctgccgcgctcccgcgtgatctgctcgcgggcgacagaggggaaaacggcatatccgggcggtgccgcggccgtgcgcgcggcatatccgcccaccgtggccgtggcgtgcggggccaggtcaggtcaggtcacggcgcgtgatctgggcccgggccccgcggatgggggaactgatccggtggtggcgcccccgcgcgcggctggtgctaattccggggggcgcgtcacgacacggcgccgcgtcagcgtgcgggcgcgcgtgcatggcttgcttggttggttgttcggtttcgcttgctcacgttttcctccttgcgcttttcggattgtgacgggcgacttccccggaccggccgtccggccccatcatccttcttctcgggcctgttgtttaatggacagacgatttgcgtcctactgtacaatcccgtttactaatatataaaaagtgctccatttcaactagtatggtggtgtttgaatcttacgaagataaagacgaagataaaaattaagtgtttcacgtaaaacgaggtggtaataacatataattaattgagttttaattattataaacttgaaaaatggattaatctgatattatagaacaactttcatatagaaaattttcgcacgaaacacactgtttatcagtttgaaaagcgtaccacgaaaatccaaaactttatccactgcttgtagtggaaacgaacttataagagcaggtacaatagcatactattagccatattttaatgagataaaagatgagagagaaggcagtgggctatagatttgtagccagctgcagcacggactccaagacgcagtgtgtgtatgacaggtgggaccatatattaatagtatagtaagtaactattgtattaattggctattacattggctatagatgaattggagctaatagtgggctatactattaaacttactctaaggctgtgttcagaatactcttctactccctcgttttgtgtgcgtgttttcccaattgctaagaggtggaataatatgtttttttaaaaaaggtctatagaaaagatgctttgaaaaatcatattgattcatttttatttttaacttatacgtaactagttaccctctccgtttaaaaaaaaaacaaaccttgaacaggatgtgacacatcctaccactagaatactccctgcattctataatataagacacaactacttttaaaaattgttttcataatataagacatgcatgcatgcatgtcattaactagcacacattttccactaaaatattattatttaaatcctccaccatcaagatctctaattttattaggtgcatgcgttctatttattaggtaatctaaacgatgaggtgataataattatttcttgatctttaggttaagggtggttatgtcttatattttgaaatagaggaagtatgtcacaacatgttctagttttagttttgtttttcatgagacggaggaagtatatgctgattatttttttaaaaaaatacataattttttaaaataagatggatggccaaacgttagataaaaacccaaaaaataaaatctttatgggaagaaaggagtaattaggctgcgttcaggaggaggggctgggaacccctcctctttggcacgcaaaacgatgttcacattaacacgtgattaattaagtattagctatttttttttaaaaaaagatcaatataattttttaagcaactttcgtatagaaacttttttgtaaaataaaatttgaaaagcgtgcatgcagaaaacgatggtggggagttgggagttcccagcaaagaacgcagccaaaagttatcttgttctctatgcgggatgaatgtgttaggttcacatgcatgcaactagcaagacccgtacgatcgaccggcaatccggcatggacaacaacaagcttgatggacagtgaggcatcaaagcttgatggaccgtgatgcgagctgcatgatcgatcaataataggaccaaaaaacacacgctgaataatgtttttccacgaggagatgagacagccttcgtaaccgtgaaggaaagagccaaccgcgaatccgcaatgtgctgcgtgtcagagaggccactgggatcgaattatggacaagaacgctttttctatggccctagctacggatggagcttgcaccacaagttctgcaccgacaaatgagatctccacttctccggccactacacttggcagttggcacctttctcctgtccccacgcccagaaaagcaagtgcaagtccttccctgtattaacaattatagactttggggtaatcaatgtgcacgaataatttgttatgattaataacctatcctaagagcacccgcaatggtaaagtaagttgctatctataaaacatgtacatctcagcaatagactagattaatagtaaaccacttcaatggtatgtctacaacggtatctatagctctctaatccattgtctcgtttttctctatagactatctccaggttagtagatagttttgctctctctcttcatttaatctcttccaagtagaaaaatatgctgacatggatctcttgtagagagcctatagataatcattgcgggtgccctaaacagttaacactttttatggctaaaccaaatgtgttagtaaaataattggttggtttgagggccttttatagggtggtcacttaactcaaaaaggcctagtattaattaattagaacactctgattaagactgatcctgatttgcatatatactagaatattgtaatagtggagatcagtatatcatcactgacataaattacaacaaccatgtataggtgctattacaaaagattgctagttggacatacgaagattagcatttgttctctgccgatgaagcatctatgttccactcaacaaaaggtagaacatttagattaagaatattggaattggacatctttaattggaaaggatatagagcttaattgcaattgtacatagaagtgaattccacctcaacaagggtgaggatgtgcgcatccatatgaactaccaactattcctctctttttttcccctccctgtccacgtacccaagcactcatctatctctccaacatcccatcaggcgttcacaatttcatgagatctcactcaaattttacatatttcgagcatctcaagcaagtttggaatgagatcttgaggttcatttcaaatgtttttgttcagaattttgtggggttctttttcgaaattagcaaaaacaaattaatgtcttgttgaggctccatattctcaagtttcgaataaaaatctggatggtttgaggagatgtagattcttgaagaagctatagctgatagaaactctctcaaacagggctatatacctaactttattcttcttaacagatcttttatacatagtacatttgtggtattcacatctcttaaaggtgcaactgctacaagctcccacagtgttatatactaacttcattctctttaatagaacctcttcaattagcattttatacatggtatgtgagtggtttaagccactgctatgtcccttgaccatctactactcaaatgccaactttacactttattatttttgaatgtctacttttgatatttccattcttcaattctgtttgtaagcatatatttgcaaagttgtttatcaccaccataaaatcctgtaacaatgcgtggggtatcaatctagtttatcttacagtaatgaacccaacgactcatggatacatctatattgaataaatacacgaatcttttaaaaaggggtcttttatccaatatgatttctcattctccttaataaggtggtgtttacatccagggacttaactttagtccctatctttagacactaatttagagtattaaatatagactacttacaaaactaattacataaataaaagctaattcacgagacaaattttttaagcataattaatctataattagagaatgtttactgtagcatcacataggctaatcatggattaattaggctcattagattcgtctcgcaaattagtccaagattatggatgggttttattaatagtctacgtttaatatttataattaattttcaaacatccgatatgatagggacttaaaagttttagtcccatctaaacagggcctaagccttttattggcgcgtgatatgttgtagtgtactacgtgagaagctggcaagatcaacagccccaaacgttccacttatttgggaaataagctaaacaacatatttgtaattatatgtgttcgtaatgtctaaaagcaaaggcttaaaaaataaacttcgataaaaacaacctcaaaatcaactccaaatttaagattaaaaatttaaattttagctgataagcataagaaaaagatgagaggctgcaatactacaggtcgctgctatcagcatcacatcgattaatttgcacattccctgaccggagcagacgttcgacattcttcagtcggccaaccaatgttctccaaccaaatcaattggttttgcagaaataaacattaatttactgaacagggaattgtgcgtcaaaattccaacaacgtagcatcatctttccagctccacccattccaaaatcaatcaaaattcaagaccgcaaataacgcgctatcattttcaagtaaggccacagaaattgcacaaacttaagtcatcttataagttacgcttgatatctttgcagcgagattaactgtttgcttaactgaccaccaatgttctccaaaaataaagtacaataggacatggaaacctcacatgcacaattaaaacaaaattataagtttccttcaaatcctccatctcgagggccaattgaaatcctctcagtcagcattcagtctgctttaatctgcagcatagaagtacagttagcacaatggcatttgacaaagggcgggcaaaattctacagttgagggatattccagtcttttccttccaaaatctacagatgcatgacaaaaaaactttacagcacttgttcttttggaacgagatactgtgaaatgtttcacataccattcaatagacaaacttgcatcctaaatcatggccaatgcaaatatagtttctcccaaccaaacattgacataatggtatgttgaaatagtgaggcacatttcattcatttatgaccatagttcgacacaacccccaaccaaacattgacataatggtatgttgaaaatagtgaggcacatttcattcatttatgaccatagttcgacacaattgaatcagtgctgattgaataagcgcatgaaaccctgagctttacaaagttctgttatacgcataatgctacattgctactagccctaaaaaagtgcatggtttttattattgtcctggatatttaacattttagagaacatgtacaatatgaaaattcataaatgcttaaaagggcaaaaaacataaagaattactttgtgatatagaagtatatggacgtacccttctgacaggttcctgctttgtggacatatctaatcttgaggcttcatagccgggaatagaagaacttcctgaatttgcatcaaaagagcattttaaatacctcaactgaataaagaccaaataaaaaatgccaggaacaaaagtacaaatgaagaaataattagaccttgatattctgagaatcagtcagcaacattgtaaggcgatcaattcccaatccccaaccaccagtcggtggtaggccatactcaagggctgtgcagaatgtttcatccaatgccatagcttcatcatcaccagattgacgatcctggcacataatatacgtaagaacatgtacagtttttcagcaagccacataggaagctagggaaacaccatgcaacaataaatctgccactggtgtaagggtccatactctgtttgtctgtttgacacttcatatcccacccttccaatgacttaccactacttttaacaatgcaaacacaagtgtgtgtatatatatgatggatccaaaactcccaagcataatgagtacgctggttaaaatgatggaccaaaatataccacatatgggagtaggttggtttccaacaattatatactatgcaaagctatttagatgttccaaaataccaaaaataactcgaagcttgggagcaggctggtaccaaagaaaaatatacaatttgcaaatgttcacaaaatctaacaagtacctttagttgttcctcaaaccgttgcctctgaacaacaggatcatttaactctgtatatgcattgcacacctaaaaaatggatttcataacactgtaaggaaacagaaaggaggacaagtatgaaagtatcaatgaagacttagtatatacctcatgcttgttaacaaagagctcaaacctctcagtcaatccaggtcgagacctatgccactttgccaatggactcattatctctggatggttgataataaacgtgggattcacacatgtctcctccaagaaatggccaactagctgttagagcagagcatataccttattaatttggctaaggaataccaaaagggaaacaaaagcaaaaggtatattaaaatttaagcaaatagcttcaggttggattttgcaatataccccagatcttttatttgtttgtgagctaatgtgaaaatgttcagaaatgtactgtacattatggaagcaacaaaaaggattacaccggacattcttcttcatatcaaagtggctagcttatcatatatgtaaataagatattataagatagcaaaatcacctaacgaaaatcatatcaaaatacagtgtaaaaagaatgtgtagtgggtaaagaaacaaccttatcaagcaaccgtgttgtagtctggggaggtgggcatttgacatcatatttggcacaggcatctatcaaatacttgtttgcttcatcacttgagagatctttaggtatattgagtttagccatagcctctaattcttcaatcatgtctatctttctgcagcaaggtaaaggcaaagtaacattgtagcaactgaacattaccagttaaaagtgcatatagagcaatacatgtaatccaaatacatcccaatgtctctacctgaagggaggtgtgaaatcaatctctattggtggtttctcaactccgttagcatgatatttaatcttgtagccacctgtcaactccttaaccatacctgtcaaccataaaatcagatcattagataaaatgaacaggctgcttcatgttgatttcagtaaaaacaagataggacggcaaaaaaatgatatgacagaacaatagcaaatcatgaattgcctacggaacaaggaaaatgcatttaggtcattttgcagttgcatacaaaattgacatgaagatactattacttcctaaaataaaaagaaaaaaaagatgtttcagagacatcaagagataatcaccagataacatggtttcagtaagctctatcaagtcattgtaatctgcatatgccatataaaattcacatgttgtgaattcaggattgtgcgtcaggtcaattccttcattcctgaactgcttcccaatttcataaacacgatccagccccccaacaaccaattccttcagatagagctcaggagcaatacgcatataaagcctcatgtttaactcattatgatgtgtgacaaaaggccttgcagctgctccacctgcaatcatgttcatcattggagtctccacctagaaaagacatagaatattcagatttgaaggactggaagaatatacaaaagaagaataacagaatagattgcacaggcccacctctaaaaagtcaagaccatcaagaaatttccgaataaaagagacaacttttgatcttgtcttgaaaatatgcctcacttcatggtttaccatgagatcaagatatcgttgacgatatcgggtttcctgatatcacaagacaaacaattgataatcaaatcgctactaagcaccaaaggcaacaagacagatatataattgataatcactgagtgatcaagctacttaaagcaacctgcaccaaatttatgatttgctcatgtaaattagaaatgcagatttttaaatagaatgaatgcatgagatagtcaataaaattggacagatttctattagcatgccaaatatggcattcatgtcagcaaatgagttcactaattttaagaacattgcaaatctctcttaatggactagacatgcgccacctatccacttgttcagatagaatctgatcccatgattagttcatccacctgaatctaactttgcactaaattgcatagctgcctcaatctaaatttaaatgattttgttgtgcatacaacaaagcggatcacatatgcacatccagaaccttaaaatccgcctagatatttgttaattatgattaatcacactaccgacaatgtatttacttgctgacaaagaactcacagtaattagcatttacatagacaagagaggtcaatcaataattatacggagaatgaacaaacctggtccctcaaaacatacttttcgatgttcctacccattcctggagcccatggagtgggaacagcacttccctcactcttctgtaaagatgtatacaatacatgtaaatgatcatgtagactacatttcaacaaatataattagcataagaacttggaaggaaagcaaagggtcaatggttgggtgtacacgaaatattttgatatctcagaagcttggcatgctggactcagcagttgggtgttttgcagttcaatcgtgcatgcaaaatgccaacgttcaatcctagcatcaagtcaagcaagcatggctcactatatactacacacatgcaagtgcaggacacgcccatactccatgaggtgatggacaaattatgcatttatctatgcctctactagtcctagaatgcgtagcacgtaacaaatgcataaacaggtgtgagtgagtgtctgtattgcattgcacttgagaaaagaagctaggcaaatatgaggtgcatttgtgggtttaatcaaatgacctgtctggggtctgcaaaccagaataatggctgttgtgctttcttgtgctgctaatgtgtatgtgacacccagaaaaagagaaggcatcgctacgcaaaatgtctttagtttcagtcataattatttgggtcaagtccgatttaccccctcaactatcacagaagtacgacttaccccccttaactacgaaaccagatattggacacccctaaactattcaatccggatacttaacccccctggggctcttttttaggtggtttcgatctaaagctatcacacatgacagtccaatatgagggaggaggtgcatcatcagcaacatgcttctccctctccatgggacccagcaatcagtggcatgcacttcttcctctatcctttctgttccaatctctacccaagcctgtgtaagcactagctcacctgcagccctcaagatccacaagacggttgttgtcatacgtacatgtaatcaagctagatagttctgaaaaatcactctttgaaaaaaaaaaactccaagaaatcaaagctgctctctcattcgcacatgtaatgaagcggaggtggtctgtgacgaccatgagacagccggggaggacaagctgccgtccccggcgtccccgctccacggccttcggagccagagtgtctccgtccttgctggtgcttcagctccctggcagtggcggctagctgcacctgctgctgtgcagctgccatggtggcatactccggcaggggcaaacatatgctccccacaaccaccacgaactgttgcacgggcacactgatggaggcgaggcggtgccagcgctgctatgtcccgtcgagcactcaagctcggccgtctcaagcaggccggagcactgctttgaggcgcttgtccatggacttcctccgaagcaaggagcactgagactaacgaggcaaaggatctggcagtttgcagcccatgcctaatgtgagaaatgggagaatgggcggaagaagacaactaggtggatgacaatgtgggctaacatattttttcctaaaaacaattgattgtttttctgactgggttgccacatggtcagattattgccacctgtctgccacataggacaaaaccacctagattatgtttaggaaggtaattcgtacggttccaaaattttaggggtgtcaaatgtccggttctatagttagagagagagaggggggatgggggtaaatcagacttaactctagttattttatggtctctatgttagtatgtacagatttaaatataaaagttcagattaatatgaagtaaattgctctgagatattaggtatatcatctggaaacatctcttcctaaaaaaatctgattctcacctgtcgaggcatcatatgaaggcatggggagagcacaacaattttctttgggaatatactgagctcccctctcttgctctttcctggtattcatcaaaattgagaagtcgtcattatcagacacagtaaaacaatataagaatttccagtaaccatcaaactatttatactcctaattgttttaaaacaaacaaactgtacaatcaagtatgggcataagctacaaataaagtttaagttatttattaaataaaattacaaactcaatcagataaggatccatgtactcaaaatgtcctattggcattccaactgaaagaatataagtacctacttaattttgatgttggaacatctgactatgtaataatttcaaaatgaacttgaatagatgcttacaaacctggataaccacatacaccaacaatatcacctcgtttcagagtagagtgaaacttaatgaattcattatcttccaactctgaggtcctatatcaggtaaaatcagttaaatcattagtttactttttatgagaccgacaacagtaggcagtaaccggcgtagtacttaaacatgagcgaaatgatagccactagataacaacgatagccacagaaccgttagtcaaaataacaaaaaagaatgcacctttttgtttgtttaaacattataactaatagaaaattgcaagtcagcaagcccccagactttatgagatatggattgtatgcaacctcgtgtattttacacttttactatgtacaagcatacatactgttatgtgcataatcatgaagcatattacccaagttgggaaagcatgcaaaaataacaagaagaaaaattctaagcattaacatgtacaaaacaagaagaaaacccaactatgtaaaagaaggggggttttgtgcataatgtgattattgccaatacggaccacacataagtagccagctatgccaagcatgagtagcacccggcgtactattgacacatttgcaggaagataataagctacagaaaccttgctctaaatctatgacattcatcacaatccatggcctagcatatgtttataaagttgcagtgagaattctttggcaataaactttatgaaattcaccaatgttgaaaaatatatttaactgatacaaactttatgaaattcaccaacattaaaaaatagatttaactgatatgaaaattaaccaaaggatgcattttagtcaggcatatctgcacatagtgagattttagtgaaatgctgaaagtgtctgggaacaaaccagctaaatggcataaaaggtaagcaatacagttgaacagacaaagttttacctggcatcagcaaaaacttgaactttctcaccaccaccataaagatcataaaataagagcttggaagattgcgctctcttggtcatgatcctccctttaataaaaaataataataaatacaaatcccacccaaatgtatctctaatcaactacactatcatatctagtcaaagagaacgaaaaatacctgctaggcactcggtgacgtcaacaagcttatccccaacattcatgctcttgtatttctcaatataatcggctacggtaatattagccaggaacttatggggataggggtttacacccgtggccttgagtgaatcaagtgccttgaggcgattctcataatattgctgcagcaagaaacacatgtctgaattttcctaaacaaaagaattcaatacaacaaatagcacagcagcaccaaaggggcatcaatatcacatacagtgggatccatttcctcatcgtcggcggcagattccttcgggggctctccactagcagctgctgttgcagcggcctacaaaattttttttaaaaaagggtgtatatatatttagagcttagcaatcatgatatggaaaactctttctcacaccctagctgcagaggtatatccgtatctaacaagagcaaagagtgttgcttgtcacattggcatcatctacaaatgaacgcatccaaaactcgctccataaaaacaacactggaaaaaaatcggcaaaggttaagaagttcaaactgcttcaccttcttcttcttctcttcctccttcaaccggcgctcctcctcctgcttcttccttttctcctccctcttcttggcactgcacccgccacaaaactcatattaaacaaaagccacactacggaggaaaaaaaaacaataagaagaaatgccggctgcgtgcgcgatgagaaagcgcacttcttcgagagctgctgcggctcctcgccgcagcccgcggagagacccgccagcttctcctccaggcccgacgagcccgactccgccatgccgcgccggtctcctaggttttccactgaatcgaaagagatcgaggagatgaggctcgcgaagcggaggcgcaagggagaaggggggtttagctagggttaggcgacgctgccgccgccgccgccgcgacgtcacggaataaaaagccctggattctcactttctcacatggactaggcccacgaaacctgctttaaatgggcctggattagactacgcgggcctggcccatgaaatgcgctttgcttgggcgaatcgcaaggcgattacgccgtggacgagacgagtgagaggaggagagcggccatggcggggcggagtggcggcggcggcggcgggagctccgggaagagcgggacggggaggatggtgtcgctgcaggagttcgtctcgtccatggcgcctctcatagacctggagaaggttccgtactccgatcccccatcgcttttctttcgctgtttggttcggaaggtggaacggatggtagtggtggtgggtggtgacgcgtctgtggtgtggttgcgcaggcggcggagatatcggcggagtcggcgacgagctcgaagaccctcgagaggaggggttgcgtcatggccaacctcaagtgcaccgacgcccaggttgatttgcttccattttgctgcttgcttgcttgcccatcggtgccaatgtgtcatcgaggcgtggtgctaatcttgttctggccttgttggacctgcttggtgcgtagagtagacggggctgatggggaagacgctcctggagttccaacccaacaagggcgacgtgcttccacctcacaaggtgaggttacctttgccctcctgtcgtattgttgttattgctcgctgtgataaaattctggttaggaatttatttgtggtatgtgagagcggtttgtttcagaacaattgtcgcttcaggtattgccgtcgaaactcacacttgcagtatttctgccatttgtttagtaattgtgaacaagtaatgttgttgttaactgatagtttcagtgaaatattagattcgtttgtaaagttcattatgaattgcatcacgtgtattattgattttgttgagattggcaggagttgatacatgaaaagctcatgcatgtttcttaatttaccggacactgattcaaagaaatttgtattttacttcaccattgctaatgcccacttatgtttttcttctctagtttggaacacacgatgtggttgctctgaagccaaataaggcagatgctggatctgctgctcttgggcaaggtgtagtttatcgcttgaaggtacctaactatcatctaagggctgttgactatttaaagtctttgcttctgaattaggagaaatgactgtaatttgaacaaacaggattcttccattactgttgcctttgatgacattcctgaagatggattaaatagccctctccgccttgaaaagcttgcaaatgaggtatattttccatgctgttttcattactatttgcaaatgacattccattactgttttcttctctactatattttccatgctctctcttacaactttctgattagaaattttatagcctccaagtaaccataatagtataattgtatcataattcctctttgctttttttttatctccatgtatgtatttctatatatcttcattattgccccttgtcctccagcattgccttacaattcattggaccctaaattttgcatcttaatgctcttctaggtgacataccgcaggatgaaggatgcactagttcaacttagtaagggcattcaaacaggcccttcagcaaaccttattcctgttttgtttggagaaaacccacctatgagttccaaggatgttgcgaagttcagtccatttaacaagaatttggatgagtcacaggttacaatttgatttatttttttcaactgcttttttttggcttgttgcataattatgtttcagttaagttcttatctaaataaggagaagagaagccataagtacttggggcctggagaaatttatcagaacagtatgatctacaatagaattttccagtgcaatcactttgttctgctgatactatttcaagtatcagtagaatttgtatttttaacttattaagtaccagaggaagatctgaaatttattgaatggcagacactcatgattttaagaaaataaaagaacatatggaactaggcaaataacgctaacaccagcacctgcagtttcagactgtggacattccatcacttttggcattacaacttacaaccaaatgtgtcaacaccgtcatcgattacatataattcttgcacctgctaatactggctttggaagacctcatcctgagtagtagcatatatttgcaatacttctgttaatggtgttgcttttgcttcggtgaactccacagctaattatgctggcactggtgtttggcctccacattttttattttctttgctagaaattgattgtttaataaaaataaaaaaattacaattgatgccttttgtctttaccatgtatatctacttgttatgttcttttttgtatcgccttcaaataccagtttcaatatgtattcaaatgaaataaatttcctttttgtggggcccatatctttgttctgcagaaagatgctatctcgaaggccctcaggtcaagggatgttttcttgcttcatggacctcctggcactgggaagacaacaactatcattgagataatattgcaggaggtgaaacgtggatcaaagattcttgcttgtgctgcttctaacatcgccgtggataacattgttgagcgactctcccgatataggttgctaacaaaattttgaaatacctttttaactcgaactttctattcccccatctatcttggtaatgttgaccatttacctcattcaaccaataataactgagaaaattctccctatcctgtcaaaataaaagatgtgatattggttaatgtgacatgttgttattgacatttttctagaaccaaattggtgaggttaggccatcctgctcgattactaccccaagtgttggacagtgctcttgacgcacaggtatagcttactctgagtgcttccttttctcctctactgaggattattaggataaatattcatgaaggttatgttccataattatttcatcagagttgctttgtctctttcaattttcaactgttatatttattcaaataccttgttaaagtgtacccgcctacgccttatgtgacatctgtaacatctgcatgacattctctttatgcccaagttaaaatgggatagattttcttatgaattacagttccacctgtattatctatgatccattcatgcattcacataacttaactgtacttaatctgcttactatttctaatgaaccaggtattgcgagcagataacagcagcttagcaggagatattcgcaaagaaatgaaggtaatcatttactacataattcttaggttcctattattaaatggcaagaccctgctttacatggcatattattttggcatttcaggaaccatctaattagaagctgtcatgtttagatgatagtaatgaaactgcaatttcaataatgttttccattgtagttaaatgtttcttgatttgttctcttttcatcttttaggtgcttaatagcaaattgctgaaagctaaggataagaatacaaaaagggacatcaggaaagagctcagaacccttgccaaagaagagagaaaacgacaacagcttgctgttgctgatgtgataaaaaatgcagatgttgtactgtcgactttgactggtgcatcttccaaaaagctagatggtattacatttgatttggtcattattgatgaagctgctcaggcacttgagatggcatgttggatagccttattgaaggttaatactaacttatgactagttttttttttcatgttgctgcacgttttgagaatgatgattgctgtaaacagtcatcaaaggttctcgtattatttatgcttttttgagtagcacaataaagatagcatgtactgtttcacaaactcccacctttaactttaagcttaaaatatgtcttaaccaagccagcagttgagcatgatcacacgggttcaattttaaaagtgcatggtataatgagaacgagatgctgcattaggtgtccattttagagcaaaaggaaggattatgagagaagttgggaaaactaaatgatttccttggaagatagctaaacttaatttcaataggtggttacacgtacttgaattcattctatcaatcttgtatggatgtatgtaaactctaacaagttctcatgacccctgtggggctccttcacactccacaagttggcttctctgattatgccagtgaacaatttcatcacctatttgattgcttgtgtttgtcatgattcagcatgcacagcgcgtaggttaaatggtcatcatactgtacttattgagatctgtcatagggctcctcagttcttttgtttttgtatgcagggtccaagatgtgtgcttgctggagaccatcttcaacttcctccgactatccaaagtgctgaggctgagaagaaggggatgggaaagacactctttgaacgccttactgaagcttatggagatcaaattacatccatgctcactatccagtacagaatgcatgagctcataatgaattggtcatctaaagaactttataataacaaggtgcacttcccattggtgtttttacactagccacctattagtaacttgttttcactagccacctattagtaacttgttttcagcctctctctttagtccataactttcctcatgttgttatttctttgtttcttgtacttagatcaaagctcataacttttctcatgttgttatttctttgtttcttgtacttagatcaaagctcattctagtgttgctgatcatatgctctatgacattgaagaagtgaaaagatcttcttccacagagccgactatcatactaattgacactactgggttagtattctccaatgcttggcctattcaatgtgttcattcttttagtcatttatgggttgaacttgaaccttggcaattttgcttccctcgttgctttctttccctcactcaatagtgttggcttcctctataaaagagtgtcggcttcctctatatttccctcactcaatagtgttggcttcctctataaaagagtgttggcttcctctataaaagataggactaccgaattcacttcaaagggttatctcatacttgaagacaataattgggcagaagtaatacttcaaatttgtagccatcatttgactgatgaataaaagatatctgtttttttaaaagaaatgatgtgatgaccaacatcaatgtttgttagatacacttctaacagtctcaagtaatcatttaggtgtgacatggaagaagtaaaagatgaggaggagagcactatgaatgagggtgaggctgcagtatccattgctcatgccaagctgcttgttgagagtggtgtccgtgcatctgatattggaataattacaccttatgctgcacaggtttgctcctatatgctctgaatattatcaaatcaatatacagtgatgagcttaataaaacaaaacaaaataaacgtttataggacttatgggttggctccttcatgatgttgaagtttataggactgactcattgaatggtgtaatcccgtaggtaacctgtctgaagatgatgagaaacaaagatactaaactgaaggacttggagatatcgacagttgatgggttccagggtagggagaaagaagccatcatcatttcaatggtcagatccaactcaaagaaagaggtaagctcccttccatgatcctccttggtgagtggatatcctatgtaaaatattcagctttacaaacatgaatattatacatggatgaggatttgattgctgctgcacagttgatccatcaaattagcatctggggagacttcaacttattttagaaaaatgtttaatagaatagagcgaatcagtatcgatatgatgtgaacgatctgtagatatatgtgcatgccatgcaaaatatctcattattgacataaggacgaaatatcatttttaaaataaaaggactgtctgattgaactactgaaataagaattcacaattatattacctggatactaaggaaaccttatctatttgcaaatttcaggtcggattcttaagtgatcatagacgaatgaatgttgctgtaacacgagccagaaggcagtgctgcctagtgtgcgatgtagagaccgtaagcaacgacaaattcttgaaacgcttggttgagtactttgaggagaacggggagtacttgagtgcatcagaataccagagctgatgacttggggtgttaacccttaaccgtgatagcccgtgcttatcgcaaagatagtgaagagatatatccaaacgatgcttgtgataggaacatcgtgcacttcaaactggtgcaatatggccaatggagatactgtcattcgacttttatagattggaaacagatcgctgtgagactgaacagataattagctcaggagtggatcaatttcgtcttgactggccctgttctggtctcttcttctgtggcttatggaaatgaaacctcagttatgtgtttttatatgtccgttctttcagctgatgtacaatgatagaagactaattttattcatccatgtgcaaatctaccatagttttttgcatggagttttgaaacttgggtccacaaaaatagtaataataggataggaggttgactgtactgaacttcgcatgataattaatctgtatctcatccatcttgcttattttcacaatgtcgcccaaaataccaaatggcatctcttcagcatagatttagtttgtgccatatccataccattgtggatgtcttgagaaaagcgatgatttatcgatggagcaagtagaagagaaccgcatgcgatgcccattctaaagttaaactggtaaagtaacatcatggaatggagggagtactgaaggaacaagagaatatgcctagtgtcaggtgtgtagaaggattcctgctttgagggaagattcgcaagaagatacctatgcaaagcacaatccgtgaaataaagcgcagcgccaaaccttttctccttttcttttttctttctttttggcagttttagtttccagaaatgttttagatggtgaactccaggaattaccggtttggtaccaaaataaaaactttttttggtgtaccaaaaatctctaacttaagataaaatttaagataaacgatgatggtgagtctcgagcctacacatgactaaaattacccatatatgctatcgtagtctacacatcactaatgttgtgttcgtttcgtatagttgggaacacatgtcctccgcacggaaaacggagcagtccattaacgcgtaattaatataagtattagctttttttaaaaaaaaatggatcaatatgattttctttaagcaactttcatatagaaattttttttcaaaaaaaacgcatcatttagcagtttgaaaagcatgcgtgcggaaaatgagggagatgggttgggaacactgataaacgaactcagcataaattgaccactcttattctcgacattgtcatcatcaccagctctatcaccgatatttcgaatgtaaaagaatttatgtttttaactcgagacaccacatagttcacatcaatcatgggcgtataacttgtttttatcatgcgactgctattttctattatttaatgaaaatccagaaaggaatagaggccattatatccttcatcgtctgttgccactgcctgcagtagagctttcttaattgcgactctttcaaccttggcttcatgccctatatgggcaagcaatgagactacgctaaaccgacgatgcagcaagaatggattagtgcacacatcaatacaatcaaggaacttctaagttatcggtgtaggcacggaatagagactcattgaaaaaggtgtgggccaccattggttggcatatgctgttgcatatcagcacaaccaggctgatgcttatcagcataagcttttctatcatctcatgctacagtccaaggagccaaccgatgaggtcagtcgtgacaatgggaaggtggcgagagagagaggaagcggggaacaatatttataattttgatgaaattcggtctggattacactggattgaaaacataaaccgtttggtttataaaccgtttggtttatcggtcaaataaaaaaatcaaactaaaattttagataagattttgttcaaattttatcggtttttgttggaactatgatgagggcataatcgtctattcctttccagattttgattccaagagaactgaaaaataggctggaaagagctttctcttccagaaataccccaagctcaattttcttctctacacaaccgaaaggtggagcgttggcgaaggacccaaccaatttcctctctctaaatcgccgcggcgggggatagattgggagtgagcgcgtatggcggaggagcagttcctcgccgtcgcggtggacgccgccaagaacgccggcgaggtatgccctctcctgaaccacatcgattcctcccttgccccctcctccctgtgcacgattcctcgtgtttttctttttccttgtccgttcttgatttcctggtgcttctccgcagatcatccgcaagggcttctaccagaccaagaacgtggagcacaagggccaggtctctcttccttcttccacggttccaccgatctcatcgcattccttttccccatagctgatggagtttggtttgccctggattggaatttggggtttcttggtgaccgtggctgcattgcaactgcaggtggatttggtgacggagacggacaaggcctgcgaggacctcatcttcaaccacctccggaagcactacccggaccacaagttcatcggcgaggagacgtccgcggcgctcggcgccaccgcggacctcaccgacgacccgacctggatcgtcgaccccctcgatggcaccaccaatttcgtccatgggtaattattagcttctgtttctatccccattataccaccttctttcttttttttaatgaacattgggtatgtcaatcacattgcagcttcccttttgtttgcgtctcgatcggtctcaccgtcgggaaaattcctactgttggagttgtgtacaaccccatcatgaatgaggtaaaagtgacatgtgaagcatttacatcgcaattggattgaaggacataggctatttccttctatgtaccaatatgtaaaaatcacagcttatttgtctctataggatttatattcttattgttcatatgccgacttagttttgtagtctaatttcatgttaccttttcatttagcttttcacagctgttcgtggaaaaggtgccttcctcaatggttctccaatcaaaagtaagtgctatattttggttaattgggtcctgatgtgttgacattcaatagaagcaacatattgaacttagacagtttccttctctgctgagcagcttcatctcaaaacgagctggtgaaggctcttctggtaacagaggtaagtgataccatcaagagtcaattttattacatgtaaagaaatttaatttgtattgatgatgcatatgcgtagaaaaatcaataggatttcatctcaaccatgttgttctaaattattttgttgcttcatttcactaatcagtataagccgtcttctgaatagcttaagatttggccgctactgtctttcctagaaaacatcatcgaacaatgtttgatcgtgttaacgtgcactttgcttgttgaatggtgatatttcacaactacttttctagcagatgtatagcttatgctttactgatgcaaatactgacagcatgtacatgaccatgcatacactcttttgaactagcatggagatttcatctagatatttggaacccccacacctgcatacagacccgaaagaaattcttgaaaatattattattttctgaactttaaagagtttggacacaatctaaccaaaagttaactccatgtgactcaatgtttttgggatttgtgatccattccaacttgatttaattcaatattccacactcaagtaattatgttggttgagatgaccataaccttatcgattaaatactaatctaatcatgtcaactggattttgtggaataccacattatctcttaaaacaatagttgaaatatttatggtaacatattaattgattcttaaacattggctaagttgcccatttcgggcttcctgttggagtgtgatattcttttttttcctggggctgtccaattcatattgatatatcaatatgaatgtataacacatgctacactggatgcaattagtttcttgtgagcctctttcgtacttgatcaatcatcagtgacaaacttcattgattctgaaacttgatttacttacaatggaaatgagagttctagtttctatttcttgaatcattttcatataaaagttttacatcataatattagtgaaaatatttgatcaataaccttgtgccaattgagcaggttggaaccaaaagagataaggccactctggatgatacaacaaacagaatcaacaagttactattcaaggtaagccttataagttatacaccaatattttcatgacatacaattatagttcaacagatcggtgcactaaaatggtatatttcattatttcagattagatctatacggatgtgtggctcgttggccttgaacatgtgtggagttgcctgtggtaggcttgatttgtgttatgagattggatttggtggcccctggtatgattaatttaattactacaaatgcagtgtcttatgaaaaatataaactatctaaacatattttattgtcaattcttcactctagggatgtggccgctggagctctgattcttcgggaagctggtggttttgtttttgatccgtaagttacactgtttagtcaatgtcatagtagaatcaggcagcgtgagtatctattattaattgtttgttccattctggcttgtaggagtggtggggagtttgatctgatggcacgaagaatggcaggatcaaacagctatctgaaggatcaattcatcaaagaattgggagatacaagttgaacaacatattcctcaacatgaagtagaataagaatataagatcgccctgccaattttattggggcaaattttctttctagtggttctgcataaacagcatgcctgttgcggaaaagttttggacgcagtatggcattgtattgtttgaaacttttttttttttggcactactatccggtgttacttcggaaactagtgcatcgaagattcgaagtagcttaatcagaattttgaaccgaatgttcagatggattgtgcaatgtgcatttcccccatgatttcgtctcctatgcacattatgtggaagatgttccaaaataatattatcagttataaccaggggcatgtgtataaacaaatgtgtttcaaaaaaatcctggctataacaaggtagcatgtccaaattcgtagtattaaattcgtagtattaggaaatgttttattttgttcagttttttatattttgggatgtaggaagtagcacagtagtatgatcctaccgatcctagtcttgatgggaattgggaaataatggaatttggttgcaacttgtaagaacgaaggatgctaactaagtactcttgatgggaaatattggaattcggttgcaactaggaagaatgaaggatcgtatacctctgtggcagtggatccagttgacggttgcaagaggaagatgcttagctgtgtggcaaactggcaatggatgctagtagctctgtagcattggttacaattgctcacttttcactagatgttggcagtaccaacagccaagcaaagggaggcaaagttgccagcgttggggatcaggcgtacggtttcttcaaggggccatggcggctgcggcgccgagttcggtggtagccggactcgtgtccgggctagggctggcgcgctcctcgttaacgcccagcgacggccgctctccttccctctcgcccctgcatccgccatggcccgcggccccgcggctcgtctgtaggagcagcggagcccggccccccagggagagagccgtggccgccgccgccgccgccgcaaattctccgcggcagcagcagcagctaggagagcatgagcatgaggaggctgtggcagcggcggccatggagccggagaggagcagtccccatgaggtcaccgtcctttctttctccttggtttggcgattgattgattggttggtcccgtgcaggtgagggaggagatagcgaggtgcttcgatctcgtgcgccgcctcggccgtggcgccgtctacctcggctcctccagggtgccgcccacccatccccattacctccatgccgccgagctctcaagggaggcaagcactttgctagctgttcctcttcctttactgtctcttgcaagttacaccaccctaatcttttcagctcacacattaagcttgtgttacatcttatcttattcatgcatattttcacggccttttcgccagaaacacactaatgtaaattggtcaacaaactggtagataaacatcacgctgcactagatttcgtgcgattgctatgaccatctgtatgtctaagtgatgctgaactttcatcacattacaacagatagctaggctgctggactgcaccacatggtccggagctggtccaggtttcatggatgctgccacccaaggcgctcttgaggcgggcaaaccggtcggtggcttcaagattggcaaggaggcgggtgaatggacaacctccaattttcatccttacctgccatcagagtcatatctcacctgcaggtagctggatcgcggtcgcttaacttcagattgatttgagtgtgtgtcatcgatgcatcatgcatgggaatcaatttgggctattctcctggatttcaggttcttctctgcaaggaagcatgggttagttgatgccgcggtgcggaactgccctaccgatagaactgccatcattgcattacctggtgggatagggacgctggatgagcttttcgagatgatggcgctaattcaactggagcggatcggttccacgcttccagtcccattcttgctcctcaattatgattcttactactccaaactattggactttctgaatgactgcgaggagtggggaaccgttgctccgggagaagtagcatctctttggaaggtttgcaatgggaatcatgaagctttggagtacctggcacagttctacaatgtacctcttgctgaaagaaattactgcatatcaccacagttgaagcagcaggcaacttcataggccacaagttgacgattcaggtttttctcaagaaatcttggagcaaacttattccgtttagttgatcattgtagtaccccctaccattttaaattgaattagcaaacgtcaaatacaaaaaacagagggagtacaaccttttcaccccagttcttgaaataaacttgtacagttgaatttcagtctgaatatctgatgaacatcaaggatgatgcaatcaaagtttcagttactcagtgaattcaaatctcatattggttctcaagaagttttatttcttctcttgctcagcactttctacaatataatccttaacctgctacacaagtgtttgttatctcacagggcacaacacacaacgtatgcaaccataagagaatcaacaagtatgcaaactcaatgagatacaaatgacaaaaaaagtacaattctcatacaacagttattggttcaaatattacccaaccagaagggcatttgaataacaatcatatattcgtattggtgtacctgaacaaacataagaaatagaccaaagaaaagcgcgtttcctaattgtcaaccaggctcaattgacagatcctcgagcgaagcaatcattcagactcattcatatgcagatgtaaacgcagcacgccaagattgatcatcgtcgcatgtagaagtggcatggttgttgtactccggtacatcctcgctctcctgccggtagaatccccccagtgctgactccggcagccggctgtccgcaaggaagtgcttcatcgtctccatctccatctcgtgcttcttcttcatcttctccagctgcttcttgagcttgtcgttctcctgctgcatcgctgcactcctctcctgcaaatccaaagcgagcaaatcaaattgttatctgtgtacttgtagtgttcagcagaacatagtttaagcaagcaaattgaattgttatctgtgtctttgaacaaaccttttcttgtgtggatgcctcctctgcctctctcaatcttacaagaagttctccagcagcatggacagcttcagctgtgtcgcgaagctgaatgcggagccttctgttctgctctttcagctgcgctctttccttttcacggtcaatcctcactgtggacagctctgctgcaagggcagcagcgaaagccgtcccgcagcccttcctgcctgccttggcagctgccctcttcacctctgagataccttccatcacacggcggtgcctctcaagaagatcattgtacatctcctggagctcggcgtaatgttcaattatcctggcgtggccgtagatggctcgttggagggcatcatccagttctgcagtgcacttcttttcattgctaagctccatctctgttttctctgcaagcatccgatttgattcaagatcaactctcagctcttcagttaggcatatccatttgctttcagactccatccatttctccctttctctgtctagctcatattcttggtctgtgctgccattcctcaaatgttccagaaggctgacatttgtggattcacctgcttgttgtttcagttgatccttcaacctctgaatttcactaagaagttcttccctgtcattcacattcagctcaccatgttgttcaccaaccttggcttcatccactagttcttttgtaggttccgtaccatctgaattttgagcatcttctgaacacttcttatattggtcaacctgcaatgtaacattgaaaatgtcaggaaatggtatcatgcctgaagcatactattccttagttcaccatgcttcgtaccaaattgctcagctccttgatcttatcggcctgttcttcacataaagcttcaagttcagtctgtctctttgaagcaattgttgatgcggtgatgtcgtcctggatgaagaaaatgttttagtacatggaaaaacaagaatatgggtagaagtttgccatcacgtaatataccttaacttctggtaccacactggtggctattacaatctgcttttctgcatttatattatctttttggttcccatcagtgtcgatcgcttttttgcaggatgaacaaagagcagaagatgttgctcctttcctctctggtgatgccagaactcctgaactgacttttgcaactgattgacgggggttcagtgcaaaatgatcaaatgaaaggccaacaaatgattttcttgggccttggttctgttcatggtactccataatgtgcaagccccgttggagacttgcagccagtgaatcagttgggctaagcttgcttgactgtaaagaagaacgaactgcactttttctggacacttcatcaccgggacaatcagatacactaagtttgcttggtgacagccctggtgaggtaatgctttttctagccttgttgtgaatctttggagaagaacataacgtagggtcttgcattggtgacaggtgcggggaggcactaactgatagaaaagatttcctgtcagacacaaggtcttgatcaacttttgtactggacaacacttcatgctcttcctgaatcgggtcttcacaatcatctattacaggctgatcatcttcctcacttgtttttggattccccttagagcaaggagtgtcatcaccactctctgcatccatgaagtcatcgaaagtgtcttcagatgaggaatgaagctttcttatttggtcacgcagttcttgtacatcctcttcatccacatccatctcttcctctgaatcaacttctatgtgaggcaagattagagagcgattgagactgactcgcaaattatgcaggctttcacgggcattctgtgcactgaaatacccattcttgcagggttcagtgtctccagattttgttcgtatgagctcgtcctgcaagtgatagaacaattagcaagtgtctgtaaattgttgccacttttatctgctgctgaggaaataccttcaactgacgtatttgatcgctcaaaccattaacatcatcttctgatatctcatttactacagccttgtttgacatgagcttcgctctctcaccgaaccgtagcgtgcttaaagttgtagttctgcacctgcatttgccagtcacaggactctatgtcaacttaagagaatgtaaatggcatagtgaagtacataaggtaatgaacagaaaatacctgtgttctgaagaaatggaacacaagaatgtaacccttgaatttccacctagtgtatccttcagcacatgcgtcaaacaggattgcttgtggggagagtcatctttctgggtctctggtgcttctgatagaatattgacgagtttcctgaagtaacaatgtaagtcagtcttctgctttactacatgtttttattcttatcactatatgtttataatatatttctccaaagaaagcaattatcactatatgcaaacagattatgagggagaaatcggtgaacatgaaaaagaaacattgaagaaattttactgatgaattttcatgagacatcaaaattcctgccaaacaagccatcttataaatttacatacccaagctttgacaaggacttcttaacatatctttcttctcttgtacagtgcttgttgccaccatcaagttcatcattatcaggaccagcaagatcaacgaaggtaattctgctggtccgtgagctgctgaagccatttgagaaaccctgtaatttggttgaacaaagtaaattcccaatataatgacaacatgtatatttgctgatcaattagtgaacttaaaaaacagaatagaatagaccaaagagcagactgattttctaaatgctataatactgacattattattgcaataatagaagttaaatatagctggctatgaggtctccaaataacagaagaaataagagaggtttaatttaccttgctccatgcttcaatgacacaactgaatatcacatgagaacgtgaactcttcaagttcatactcgtagtaccaacttttctgtttgaaaggccctgtaaagaaaagcaagctcagacaagcaatcaataattctggaggagaaggtagtggggttcagttgttagaagtacaacatgaaacaaatagttttgagtgagcatgatacaagtactaatatatgcgatctaaacaagctcaagcagaagtcctggttgtgatactcatctatgcagaggtgaaatgaaaagcaaagaaaccctaattttaaaagcaaaatagaatggacaatttctttctgctgctgatgtgaagcaacatagatcaaaattgtcccactgatttgaagtatagtagaagcaatttcttgggttggttttattggataactccgtgccataaaagaataaagatgattttcggaacaacttgaccagtgcccataagttagcaccagctaagcaaaatgttttggatcttaacgaaacaatcatgtaaatagctgtaaataacttccaacattttttcacataatgctgacttcaagctacaaatccctagctatgttttctgacagaaatctgcaaattagtgcagcaacttcctgaacaaatctgtaaagcatcacagtctacaagtagacagataatgcagtgaggtggaagtcattttgatcataccttcatcaagatctgattgacgtcctcaaccgttgacacatactcatcggtcaagttctcaacatggataccattgccagcattctctcttatctaaaataacggagttggataagtttactgcaatccataagcatacgccaaatgcagagttagtttcttgctcaagattagaatatacctgaaggttacgctgagatggatccaacaggtcattaatctgctcattatgtacctggaaagcatagagcaaaatttgcaccatgtcagatctggaaacatagtttaaaagctgaacttcagggaaaacaaaaacacgcatctatagatgcatttttcagttcaattgagaacgagcagatgagtcactactcacctcaagaaatgagcaccggcattggtagcttgtctgcttctccggtgagctctcttgcctctgcaccaggaaagaacagcattgagaccacaaggaaatcacaggtttaatcaaatttctacaaaaccagacggcagaaaatgccttacgccttggatttgagcgaagaggttctggaagacgcgaggaacgacgcccctgtcggcgtggtctgagctgctgtcaaccatggccgcgagggcaccgaacatggtgtacgtcttccctgtgccgctctaaccacaattccaacacacaaaagcaaagtttcagaagcagtaacgcagaaagaagaaaaaaaaaacataactccaaactgaacaggaaggatgaatcagaggaggtacctgcccgtagcacacgagggaggagttgaatccagcgagggcgctctcgatcatgggcacgccaatcagatcgaaagcatccgcctgccagggaacaccaagattcatcacaggattcgttcaagagcacctggaattggaggaatgggaataatgcaaacctgagaggctctgtcgtcgaggaagccatcgacggcgaacgaccgatcgccgacggcgacggagcagggggaggtcttgcggacgaagaacagatccttgccgtccaccggccggctcaccgtcggccgcacccggaccaccacctgcacacgacctctcgcgcatcaggagaggctcacaacttggtaggaaagggatttccggcgagccggcgaacttgaccttcacggcgggtgcctcgttggcgggcgcagaagcctgctccccctcggcggcggccttcgagggaggagcagcgctggtcgggacgggcctcgacgaccgcggcgacgcgcccggcaccgccgaggagttcttggcggcgggggacatcggcggcgaggcggcgg

SEQ ID NO: 37851 - DNA, 19607 bp, Oryza sativa
gggtaaaaaaaaaaaaaggccaaaccggctatgcgtccgaggtaaggaaagataggcgcccaatcataggcgattatttggtttagaaattacggttaattgtgtcatcataatcataaatttacaggtttgaaaaaaatcaatactatttacaaaattatacaatgccattataatttaacaggtcttcgagatataccatcgatttccccttcaccgtaatttctaaatttttcaaatcaaattgacatcgtcttcttcctcccctcttttcttcctcctacccatttctcttttcatctcacccctcctctctcttccactggaatggttgcactatcctctccaccgacgagcaccattgggggacggagatggaaacatttctctcgctcgagttccccatcgatgagccccatagattcggtgtaacatccttaaattttaaactaaaatttgacagcatcatgctggcttttgactagattagtaaaatttaaaagtttatttgaatttcttttgatctttattttggttcaagtattacttctttagaaccctattaacttaccctaattaattccccttatcctagaccttggtgaatttgagcaaattttctcaaatttcaaactttagattatttctttagtttacccttgtattagtgagagtttgctatactctaaaaccctagtgaaacccttccaaacttatgattaaattcattctcttctaggagaaatattcaaaatttcttaaaaacactgttcacaaatcctttgcaaagtctagatttggtccttggggaccacaacccactcaaaaaccatggttcactttgccttctcctctcctttgattgcgctaccctggcatccgacttcgccgcatgccgagccgccgcgcgtcggcttcggggccgttcgcgcgtgcctgaccgccttggcgcgccgctagccgttcgacgccctcagaccaccgccgccgcaccaatcgtgatgaagacgaagttaggacgacctccgccgcaagttaccgccgctcgacgccgtgcacgcccgtccaaagccgccgccgagtccgagtttgcttctacccggggtgaatcgcgccaagtcttgccgcacggttagattgaagataaacgacggcttcccctatcacaattcaaaccaaccatcgccgtgccgaccattttaaccctcgccgccgccgcgcgtcgagctcggattggcgccaacacgtcgccagccgttttcacccgcggtcaagtcaatccttcgccagtaagaattcgaacatggcctcccgccactcaaattaatcttgccctccctctcacagccctctgccacccctgccatgcctaatttctgagctcattaatggcgttgatggcgcccgagctcatccgcttcccctggccctataaataggaccccaatccctttcttgtccatcatcgatcatcatcaaccataaccccacaaccccgaagctctactttgccaatccataccatcaaccacttccgctcgtcggtgaacaccttgtgcgcgatcgacttcatgcccctccatccaccctccaccctaactaattcatagaacacctatattcaatcatgttctagcatactaaaccctaaccgaagctttgcatcgagtttcacctcgtcgcactgagccgagcaccgccgcccctgctctgctctattcttcgccgccaagaagttttttcgaccgtaatccgttgtttcaaccgatctcggtgagttcttccgttttaaccatctacatactccctagagtccatttttgcaatcggtttgcactgccatacttccctcttggctgccaacgtgagctcgaccgccgccaatggaggcgctcgtcggcagatgccttccacaccttgccgaaggtcggcaagctacctaaacccttctaagtacctcttagatgctctaggaaccctccttgagctatgcctaactcttaccaccccgatcaccttcacggcctatctatgtcaccgccgccctagccgctagcccacccacacatcaaaataacccctccaccgctactcgccgtcgccggagaaccctagctacctcccctcctcggccgcaacccctttccccctctatcaccgccgaaatccctaaccctagcgcaaccggctgtatttggggaacggctggaggttgaagaagagaagagagagagagactgacatgtgggacccgctcacagtgccatttcatatttagtttgattttcaaactttagaagtccatatcttttaaaatatagatccaattccaatgaaacttggaccaaaattcttctaaaatcattctttatcttttgagacacttttgttatttttctattttattttatttttcctatttttggattttatttgaatccattttgaatttgaattttatatgtctaaccataggtgatgaggattcttatatcacactagataatcccagtcaatctcaagacatcaagcaagtcaagttactatttaccttttgatcatttaagcctgtattttacaaattatttatttatagctcttctattcaacactctattttatatgcataatttaattatagaaacccagataatttagtattgcttattttgcttacaatctagttaaaatatcttacacttagattgggacaatacgttagaattggatgatttccaggtggatagtactatctcgatcgatatagttactaccaggtacttatgtcaaacgaacgggtacgaccgcagtttctagaatgggaacagacctagttattatgttatttagcaatgcggtacctctatatagtggttcttatttttatttttaagtcctcgagcaggaggcaactatagccgcgaagggaaaatttcaccattaccatgtacatgtaaatggtttgtgatactcgagtataattataagtataatgttaattctaaaccctgatcgagatgacgtggtgtcatatgatcagttccccttaaataccccgggaacgccagaactcctctcgctgctgttaacgtcacattcagagcgtatgaggatataagttcatggaacaggtaccacaattgttaataacctaatactgggccatgactaagctaatgaatattggcaagtcgtggactgcgggtaaagcgtacatctgctgcagtagaatatttatgaaactattcgaatagctgtactcgcggaattgagtaccgggactcatatggtaccctggttagaaacctaaagtctacatatttacaaacttttgctttaatacttccagattgtttattattgccttttgcaaagaactctactctataccaatgcataacatgtttccatggtaacttgctgggtattgtgaatactcacccttctcttataacccctttttcagatttgggtcaagaggaggacccctatgattattactatgatgaccctgataacttagaaaatcccgagaggttatacctccctagttagaatgtataaaaacttccgctgtgtaatagtcttacttatgtttaattatgtgagtacctattattgtaaaacccttagtattgtaaactttaacgtatgcaatgaagaaccagctatattgtatgtatcaatatttactgatccagggattgatacattaatctcagtcggatccaagtcattagttttgggacccgatattcggtcttcgaggtagcctgggattcgagtgatgaggaccgatggagggcaacgggatccgtggagaggcagaggtggatgacaacggggaaggaaccgtgggagatggtgccctagcgacggtgacatcaaagatgagtcatcccatgggaggagcaaccatggagggcgacgacaacattgactagcacggagccgatggaatgtcatcgagagaccaggggacggagtcatcgtggactcgtggtgcacatccccttcgaagaccagccccgttgctggtgccctggagttcagctcgagccgaggaacctcaactcactccagtcattgcttctctttcacgttctccccgcgcgtctctcttttggatcctagcctgccgccctccacccaacaccctccggtgaggaggttgagttcgccgtggccaacgacggtgcgatgcacattgcctgcactgccgtcacacgccctgatgccgtgcgagacaacgtggtgataggagagagagagaaaggagaagaagatgatgtaggaagaagatgagggcaatttagtcagaaaatggaaatttcaacgaaggggtaagcaatggtacatctcaaaggtatgttaaattgtaatgacatgcattcaattttatgaatagtaatggtatttttccaaacctgcaattttataatgccatagatccaattaacctttgaaaataatagaagaaaaatcaagagtaaattgcactaacggtccttaaacttgtaagcatgtttcacctaggtccatgaacttaaaaatcgcgcattgagatcctctaacttggttcattgtatgtatcattccggtctaaaacctcgtttgaccgtggtcttgcccatgcgtgtcatgccacgtggacgatgacttggcaaaatatcccctttccccattcttttctcttcttccaccactcctccaccactggatatatcagcggcgatggcaggcaagcagcagcgagagagatggcgctagccaccaccggtggcggggttggcccgacagcggagtgaaggctcgaggctggagctgacgatgacaaccgcgagctccctgctctctcccatcgttgttgacgagaccgtgtcggcggtcaaggaggctgccgtcgccgttgcttcttcaaatccgacggcccccacttcaaatctactcaagtggcatcagcgctcgttcgaggtgtggggctagcgatgaggacgagatggagccgtggcgggctagcctcttgaggtggagcggcagcgtggcctcgagatcctcaccgccggcttcctctcccctcttcccgcaccatggaggccatcgaggaggccgtgggcatcccaagctgctgacactggccgagattggtgatgtgagcgaataggaatgcagccgtgttcctctgcggagatagcggatcgatggggacggccgcgccatggcctcgtcggctgcggtcccccacgacgatgacaagcggaagggtggggcttgggaggaggctgagctcaggaggctcctcaagcagctggggatcctctcttcccctcctctccggtaggccggtgagctcctcccgccactggctcccgatgagcaaggccgctgtcacgagcggtctcagtggcggacccggctgcggcaacaggaggtggtgtgccctcttgtgcagacactggctaacgggtgacggtggttgtgtgctggaggcaaatggtcgccgtcgccatcggtagagcagataagaaaggaaggggaacgaaggaggaagaagataaaaggaggggaaggaaaaaaaaaggtgaaaagggaaaattttgctatgttattgtccacgtggcataccacgtgggtaagaccatggtcaaataagtctttggacctgaatgatacaataaactaagttaaaggatctcaatgcgtgatttgtaagttcatggaactaggtaaaacccacttacaagtttaaagaccgttggtgcaatttactcaaaaatcaactatgctaggttagagttcccgattggtagccgtagacaactgaacaaatcatggatacaactttaattcatggagtagtagtctaaaagctaatgttacaaatagactatgctagcttaaccggttaggtttcttgtgatgaaaaccatttcacctgatatgggtgcttatatttacgggtaattatttttctagtagtagctagtaggtgatacacgtgtagttagggaggcacctatagtgatttcgtcaatcttaaaatattctagcacaatttgtcggaggtgctcaccgatggtgacttccttaatcgtcttttatatgtgttcataggggtaggatgtgcatgtgtataggtaaatgtggtcaaaattcatttgcaaaatatcaagaatttagcaaattaaatattccacgggccaggtccaaccgagctaatccaaagggaaaaagtatatcgaaggtcctttatgttgtcatcggattataaaatcgtcctccaaatacaaaactaatatatggcatccctaatcttacaaaaccgaatcactttaggcagttttaactccggttccgacgtggcagctgagtaaacatcagacccacgtggaccccacatgtcagcctcttctcttcccccctttttcttttctttcttctcttttttttttctcttttctcctttgttgcttgcgtgttttgaccgagggagagaggaccaccggggattgaagggaaaacgacgtgcaacagggagcggcgcggctggcggccggcagggtagggcagcggcatagcatgtccacgatcttgcgcctcccgcccaccaccatgcttcggattgtctctgatacgaggccgacgaaggaaaagccatcgtagaggataaagagggccgagggcggggaaggcgatggaggcggccctggggcaaaagtcagcgaagtggggcagcccttgaggaggatgtggcacgcggccgggaagtggagcacgctggggacgcagcaaagaggtttcggatggctccgcgaagtttcccatcgccgccgtaagttgctcataggtgaacacccccttgaccggaaatggtggggctgcgctgctgctatggggattcgactgcgtcggtcgaggcatctcctccggcggcgacaccgacctcgatctggcggtgacatcgactcgacgccggcggctaaggtgtggagggcgtctcgacctcaatcaagccgacgccaatctccgccgctccttcctcgtcggccgcgctgacatcttccccaccacatcgatgatgccaccgccgccgcatcggccctcatctctgccgcgctcctcccccgccaatcgttggccgcaccggccctcccctccgccgtgctgcccgcaccaccgtgcgtcgccgcctcaccccgatgacgacacgtgatcacggcaatggtgccgcacggcacacggaggaggagggaaggtagacgaccgccgcggccatccgcgcgacggcagctatcggcaacgccgtttgtcgcatgtacctcctcttcgccgcgctcctcccccgccagccgccggccacgccgaccctcctccccaccgcatcaaagacgctgtcgccatgacgaaatgtgatgtactttttccaatccaaaatccgggctgaaatgtagcctgccagaccaatcgtgggaagcggcccagaaaggcctaggcccagtcaaggcagctgatccttcaaatcaaatctaatccaccacaaacgactccaattctaatcgtgatgaattgtgccctaatcctgatcctatccgcctcggactgttcgcggccgcgtgcgtatatataaaccgcgtcggcttcccaccggccgcagcaagaatcgatcgcgatggagattatgcaacagctcgccgccgccgccaccgccaccgccaccgccacggcaacgcccctgtgccttcctgaaccccctccgacggcgatgacgacggcgcaggtggaggccgccatcgcgacgctgcacggcaagaagcagggcctccgcgaggcctacgacagcctcgtcctccactcgcccatccccctccccttccgctggtccgacctcgactcccacctctcctccctccagtcctccatccacgcccgcttcagccagctgcaggccctccaggcttcccgccccgcgccccccgccgccgccgccgcgagccacgacgaggacgtcgagatggaggacgtccaggaacagggagaggacgaggtgatggcgcctccgtctacggtgcaggtcaaggaggagcctgtggaggcggcggcatgcgcgtcgaataccgccggcgagcgtgccggtgtcgggcaagatgggttcgttcgacccggcgggatggcggcggcgaagatggcgtctccgtcaaaggtgcaggtcaaggaggaacccgtggaggtgagtccatctcctccggccggcgccacgggtcttacggcggcggcatgcgcgagcatggacgccccgagactaaccgacgtctgcaagcgcgccggcggtggcggcggccaaggtttgtgcgcgcgaaacggtagtggtacagcgcagtcacccccgatccctagttgccctgtgctccagcagcagcacacggccggcgccccgaacggcagccaccctgtgctacggcaacacgccgctaacgccatgaacgccggccactcggccgcgttccggccgcagcagcacatgggtaaaccccgggacacgtgtgacttgcggaaggccgccgcaccgaacaccggagatcgcctgccgctgcaatggcggcagcagcgcgtgcacgctaatctcacgtgccccttgccgccaccggtggtcgcgggctcctcctcctcgccgccacagcagcgcgtgggcgtgttcccctcgccaacgccgcagatcgtgggctcctcgccgccgccgccatcacaggcgcgcgtgggagaggctaatgtaacgaacccatcgcggcagcagttcacagctagcgcgccacacgcgggcgatggccagctccagaagcggccgccgtggcagcggctgcagcgcgtgggcgtggctaatcccatgaacgccggtgacctgccgccccagaagccgcacttcacggccaacgcaagaaacgccggagaacacccgttccaggagcagcagcagccgccgcccgtggccaaacccacggacgccgccgccggtgacctgcttcctcagcagaagcagttgatggccaacgcaccaaacgccggagaacacttgctcccggagcaacagaagcagcagcccgtgacagctgcaaaacccgcgaacgcgccgcctctgcagcacgcggcgaacgccaccaacccagccgttctccggcggcagcggcagcggcagtgggttcgacttcgaccaccgaccgccactaacctgccgcaaacgaagcaggagcagcatcatctgttcatggctgacgacggcgccaacgcccgcaatcccctgtcgccgccgccgccgtgcggcatggccaaaccccccaactccggtgacccgctgacggatcagaacaatcagcagctcatggcgaacacccactctgcccctacaccggtttccacaccattggttgcatcgaaccagagtgaatcatcagccatgacgacgacgacgacgacgaacagcaaccaaaactccggcggcggtcgcaccggcccgcaacccgtagcggccggcgctgctccaaatccggccggcaaccagcagcaagggcagcggaaaggtggtgcaaacaggcgaggcggacgaggccaaggcaacaagaacaacaacgttgctaataccaatattagcaacatgagcaaggtgattggcaagggcaacaaggggcagggcaatggaaacccccagctcaacaagaatgggaacccccagttcaacaagaacgtgccgggtgatcatcaccagaagaacaagaatgcagggcagctttgctacaggtgcgggtgcagggggcactggtcgcgcatctgccgcactcctgagcatctggtgaagctttatcagcaggacagaaaggccaaactgcaagcaggagcgaatacgaatacggtttatgtgggagccatgacggattaggggttataagatgggtacattgattatatatctttgtgcgtgtagcatacccattttcgagttatcttaatgttatcgtactagacatgcttttcgtgtttcctacagcatttccccccctcaaattcttagttacagttatgttatcggtttttatgttagatctatattctagtatcattttattctggtaaaatttgatataagacatcatagtgttgtgtcatttgccataacacacttaaaaaaaatgtttgtttgtttgtttttgtgtgtgtcccctggccacatgacactttgttttggtggtaatgtgctaaaacactacaactactccatccagttcaaattacttgtgattctacatatgtccaaagttgaatatatctatctttcacaatcaattttgaaattcatacattcttatgacatgcaaattacatattactcctatgaaagtatttttcatgatgcatctaaaagcataaattttatgatgtttgaccatataaacttctagactccatggctccgaatctccttccggtgccctacgtctcaggggattacacacggtggcctccacccttgccgacaactactgggtaagggacatccgtggcgccctcattgtccttgtcatctcccaattcttgatggtctaggatgtgggtgcttcctacctagctctctccgggaactggagactgtcttgtatggtgttggacgggcaaccagtgctactcagcccgctcgccctatcatgctttattgctgggcaactcccctttccttgcaccgaactgctgtggcaggctgagggccctgccaagtgcaagttgttactttggcttgcattccagcaacgctgctggatggcagaccttctgcagaagcgtggcattgacggccactcggcctgccccttttgcgcgaagaaacttgaaacgccgaatcacatccttctcgattgtgtgttcgctcaccaagtctagctggcctgggctcgctccttcccgtggcgacactcttcagggctggtggtcatatgctagggtctacttgcctgagcaccttcacaagggcttcgactttctgttcctatcctgacagctttggaaggagtggaacgtcagggtttttgattcttccctttcgctggtctaggtggtgttggggtccatcctccaagaggaccatctctggtctttagctagtgccgctttgtttggggatttgttgggaggatagggggttccttttcgcatctttccctctgtctaggagcaacagctttagttttatcttttcctttttgtttgcccctgcagtcccttccttgtaacttggcaagagccggtccggcccattgcgttgtaatgtcaaattctagaaattaatggtcaaaagtacaaatatttgacttaggacaagattaaaacaacaactaatttgaaacgaaggtcagtattatttttaacatgtttcggctcaactagagaaataaatttttggaaaggacgcttttatcaccatggcgtgtagcagcgaagcagcctcatggaggtcgagatcaacattgacattacaatttaaagaaagtcatttgctgatattttgctgatacttacaatagactttgcaggagaagaatgcaaaaagaaatatgcccaacaatactgatggtgcccagagtttcatttcataaaaagattgtgccataatttacttccataccgagccagctcttctgaatcctttggccacagctttgtattcagactgtatttgatcgagagactgttggttctttttatagcagcaggaaatcaagttggttccaaggcataggcgcactacatgtccattgattaatctgcgtttcgtaaaaaaaaaaaaagccaaagagttaatctgtgatcagaaataccagcccagtcagcgtttgaacaggctgccttctctgaatagtaagcctagcacaagctataatctttagagatcagcaagatcagttatgtagccgaccagtacagtaacttgtaaacactgaaatacttttattaactgagtaattctgagtattttaatatctcagatcctgaatgtctgaaaccacaaagtccacaatacttagctaataacttgtctgaacatgacatatgatgataggagctgcaatgcaatcagtttggcaaattgcataccaatcctctgtagcagatcattcataatttggtataggagtatatacttcttttgggtcaagttcacagttcacaccacctccaggtttgcgtatttgtttcaaagcccagaatatatgacagcttccctgtagccttgagggcaaacagccaaacatggctgtaatttgctgaattagtgcagtgtcagattctgcatattttttttcagaaactgggcatattctgtagatgaagtaacaataacaatatgattcacatagacaaggtcacaaggatataagtggtgacagcatattgatggaagataaagagagaagtttcagttttggtttgtgtaaagcccaactcctgcaactcagtatccagtttatttccatacaactcatctagtttccataggtgtgttgagtgagcaggaccaatgaaaccaggtggttattgcatatatacatcttcacaaaggtcacacagcagaaaagaagaaactatagcataaattttggctaaagatcagccatgcaaaactactgctggcgataatattagtcactgtagcaggtctgacaaccggactaaaggtgtcgtcaacaggaagaggattttgatgcctctaggggatatcctctcgttgtttacatgtcactcaaatggttataaaaaaattggaaaaaaaaattaagaagatgtattaatatgtgatatatcactccacaaacatgcaagtaaaaattcaacttctacatctcgcaacgaaaaaaacaaatttgactctgaatatacattaactagctgcggttcaatttgtttttttcgttacgagatgtagaagttgaatttgaacttgtatatttgtgaagtgttatatcacatgttaatacacctttctaatttttttcaaattttttataaccatttaagtgacatacaaagaacgaggggatatcccctcgagggattaaaacagtttccctcgtcaacacatcatagtccacactgtatccatggcttcttagcggataacgcacattattctgcagtctttgtctgctcctcacacaatacaggtttacgtgcaggttggttgtctgaagatgaagtcgttgctgataaggtaagttgcagttagcaaggcctcatccgaaaagcgaacaggaagagatgtgctagaagagttagcctagtctatgcaatgtgtatgtgggcaacacacactgacacacgatgtgaatctgtgcaagtttcagaaagaatttgtgcaatcttcaggtcaacatcgaaccatcagtctgaattgagcagattttactatttagaaatctctgaacatatgtttgaaactgaaattgaatgaacgtacactcaatgctcaacatcagacctattcttgaagagatatctggatccatgtgaatctgctaaaatcatcaatatcagtatgtctggtcccttctattttattagagagaatccattatatgccactgactttgtcagacgtctataatttatcactgactttgtcacattctacaatatgccatcgacctttgcttaacttttacgatttatcatcgttgtccggttagcctccgttcgcactgttcatttttgtccaaatgaccaaaatacccctagaacaaaaatttccaaaatttggataaaattatcaaaatatcatattattaacataagcttgtaagcatccaaaatttggccaaaaacttaaaatctgacatttcagaatttttatccaaaatttgaaagtttttgtcctaggggtatttttggtcattttgacaaatttatacagtactaacgaagactatccggatggcgatggtaaatcgtagaagttaagcaaaagtcgatggcatattgtagaacgtgataaagtcagtggcaaatcgtagacgtgtgataaagtcagtggcatataatagattatctcattttattactgtcctctgaagtaaacaaaacaattgtgtcccggtagcacaacagggtcctgtttgaaaatactgtaagcaactctaatagtgtcctgtttagtaatcatggatacaatccttcaaagattcaggaattggcatgcatcagagaggcaccttcagtatggacaaaatgctcttaacatcttctccataacatagcgaccctctatcaatatctcaaggcatgcagtcagctttgcaaaacttcagtgagtgaaagcatttgcaagttgaagatcagtttcttttcttttccacaatttctgcatatttacctccctgattaatttcttcagtcccaatcagcattgatacagcagctgtcattggtcagagactgcaattcaagatattggcacttgttgataaataaatttactctataagtaacatccgaattaaaaaaaaaaaaggacattgccccttcagtttgattgtcttcaaacttaacagcacttgcccatcaattttcttcttttacaaataattccttcaaaaataagaaggcgtatgaccagcaccagtttaaatcaaattcctaacaagtatccccaaaagtatccccaaaaaagaagcccgctgctcgcgcggcagcgcgcgtgagacagacgctgtctcacgctgacgtcagcgcccccaataaattcaaatcccaccttactggaaacatcccacgcgcgcatcctcctctcctctcctctcgaccaagatttcccccaaaaccctagaaatccccaggcggcggcgcggcgcggcgcgcgatcgggagttccaggcgacgatggcgggcgcggatgggctccctcccggcctcaggttcgaccccagcgacgacgagctcgtctcccgctacctcctccgtcgcatccagcagaagcccctcccgctcgacggcgtcatcgtggatgccgatcccctgagcgtgccgccatggacgcctcttgcggatcacacccgaggcgacgaggccttcttcttcgcgggggcacgcgccaagaatggcaagggaaagcgacagaagcgaaccgtggagggcggagggttctggcaggggcagcggatggccgtggatggcgagcggctggtcgtcccaggcgacggtggaggcggcgtcgacggcagcggcggcggcggcctggagatcacgtggcgcaagtatgtgctgagcttcttcgccgagggtgaacagggcagctcgggctgggttatgcacgagtacgccgtcacgtcgtcggctgacctcgcctcgtcgccgctccggctgtaccgcgtcaggttcagaagcgcaagagggagccgcagtgtctggactcccacgatgatgaagacggcggcgatcaagaacgcgcggctccccggcgcggcgtggctcttcctgcagccgacggcaccgaccagggctcctatggcgtgatcgacggggaaccttcgctggtgtcacattgtcttcccgatcagatcgttcccccagcagaagaagctgatgccactgctggtgcagtcgacgaggagcgctggtcgccaccacagcccgcttcccctactgctgctctggtgaagcagaactcctacgacctgatggtcatttcgtcactgctgttttctgatcttcccgacagaatcgatgacgatgacctgtctgtgtcgcaaacagagggcaccgagctgtccgagcagggctcctccggcgtgatcgacgacgattattggcgggtgttccatggactttccgacctgatcgcgctgccagcataggaagccgatgccaccggtggtgcagagagagaagagatcgctctgctcgacgaggagcgctgcccgcaaccacagcccgctcctcctactgatgctctagtgccaccactgcagggccagaactcctacgacgtgatggccgattcgtcactgctatttgctgatcttcccgggagaatcgatgacgatgagctacagcgatctctgcgtgtgtcggacatgcctgacctgttcttgtcgcagacagaggaagccggtgccggtggtggtggtggcgcagctccagtgctgaacaagcagagtaactcctcacctttgggcgtcatggacagcgaggtgccgattgtgttgtctgatctagagttcccagagagcattgatgaagtgcttagctacattgacttcgccacggatgactgcctcgatttcgacatggacgagctgttttccgatatgccagcagactagcgccctgcagagagcaagtgatcaacgctgacattgtcctcttagcaagagatcagttcttattcctctgtagtgcagtactgcagtctgtgcagcggctagaagtttaggagttttgtgaatctgtcctggaattacctgtatttattagttcattagttgaattaaatgtaacatgtgatttattagttgagattgctgttgattggtatgaattcaatgtaagtaacatccatgtacaatgagtggtgcacattcaataaagctctgtcattcaaattcagaacagagtacattagtttatactgaaagtctgaaactcaggttttgttctcctacactgtatggatataagcgaccaacatgatgtgatcccttcaggacacagcatggatgtaatccttcacaaattgacaacatgctccaaaagagcatttttcagattcaccatgagcaatgcttataaaacatgcaccgttgctactgaattattgactgcagtgatacatgcaacaaaaagacccatcatcactcatcacaggcatttcgacctcaatggatgacatatgaatatatgatacgatttcagataatatagaacaaacattcagaccatatccttttatttgcactagcgatgtcacctataacatgagtgccaccggcaccctggcatttttcttgcatcgaattacagaaccaacatgctagctgcagaacagagctgcagttcccttaaattatgtcagataccaggatgtatattgacaatgcaagttcatcttacattatatttacatttactaaagactgcacaaaaggaaaacatgtagcatattcaagaatctacaacaactttgttggccccaatgcaagagataatgattccttcaaaactgaactgcaaactgaggtcctgtggaagtgctggttcttgaaacagaatgagaaaaattctggtggatcctatcctcttaccacatctagtaccagcagtggttttacattgtacagggatatgctccacttggtctcatgtatcttaccagcagcacttgtgctgagttttttttatatgaagaaggttcaatatgttgagatttgcgtgtcgaaaagccatattattgtgcaccttccacagattgtgggagcaggcggcaaagcatacagacaagccaggttgaaggtgatcctgagatgtttctgccaggttgaaggtgtcaacatattgtcggatatttttgctgattgttgcttgcttgtatagatctgcaggttcagttgcccaggcagaaactgcagtgagggtccgatgaccgttgtttgtggactctgtttccattagtgtttagtctgtcactaaagactagccacatgaaaattatgcaagtatttgggattggtttgtcccaagtttggctgggggacgggaatcagaagactggaggactgaagatcataccagacgctggttgcttttgtttcaatctgggcacaaaaatgtaatctgtcaacttgggtagttttgttttggctggctcagggttcatagaatagattttgagggtgtggtctgtttcagtaattgcctgttcactctgtctgtcccagaccctctatgcctagccctctctcttgctgtctctttttttttttaacctcttcttccttttatttgtaagaactctgattgtcatttctggtaatggaaatgggggccatgcagcccttgataaaaaaaaagaaagataaagactgccagtttctatagtgtgccgtgatactgatatgtgtgcagattataagccgcggctgttgtggttcctgcggaggtaaggatgaaggccctctcatctggtctctcatgttgaagttggtgatcagctaaggtgtccataaggaattgaagttcaagctgagcttgtctggatactgaattggactgtgcgtaaatcaatggcccacatattgtttatgaactgggaagatactgggcaattgatgtttgtgggaaaggtggcgagcattcggaaagatgtatgaaagcaacctgcttcagtccagtgatctctccagaattgaactgactggccattacccactgagacctttgttgaagcactcactgattccaccaccccacagattgtcttccaaactggtgtatcatctgatcttgtttttaacagcatctgaccctacaaatattgagattgtagccactgtaaacaaggattggatgaaccggagagcagttcatgcagctcagcaaggttcattgatttacaagtatcttcccagttcattgaccaaaatatgaactgaagtattgtctacaattaaacaaacataaagccatattaagggtaagacagtagacaaaaaaatagttgttagaatttgaataaattgaacatctaaggcagaagaagccacacccccactaattcaattcactgataaaactgaagcattaccatcatgggatggccagtagttcatcttgctcgctttgtggtatcatggaggatgagactatgatccatttagccaaagcgtgtcaattcttcatcaatagacggcaaatcgtattctcataatttggcctggatagaaagatccaattggcacaatctgtccaacaaagattggtggtatgcaccggtaagggagcaatccaaagaagatagaagattaatccatggataactaattaggacctgacagaatgtatagaaagaaagggctcgaataatgtttcaacaacatattattattagggaggagattagctagggggaataaaactaggaacgaatatttctagctgttatttttcttagttgttgcatctatttcttccaaattgtaactaagaacctctatgactgtgtatgtttctttctgttcttcttaattgaataggcagagctcctgctgttttttatttttagaagggaaaatcatatgatggtttccaacatgataacaaaatgcagtaccaattaactagtgcacgatctagcaaggccaggttttcccaaggtaacagtaggctggaaacgaaggggaggctacctttcggagagcgctggggttgggtgcattgcttgacaacccaccatggttgttcaagctccaattgttcaccgccagagaccttgccccttccagtccgtagagttggagaaggacagggcggcactggcggtccggcgctgtggttggagcaaagagggttggactcgatgg

SEQ ID NO: 37852 - DNA, 13728 bp, Oryza sativa
  unsure (1)..(13728): unsure at all n locations
gtcgcaccaccccgcgctgccatgagctcagagtggtgtatccacccctcagaagttagaatccaggatggtcacgctgtctctcgtcacggtggcgctctcccttctatcggttcggtgcagaatgcgaagaacggcgtgccggcacggtggctcactggcaggggggttatcgacgagtggcttcttgtccgtggagtcatgtttctatgggcttttcatggaccgggcncagctaaataaaaaatgaaggaataagttcactatgggttcctcaaattatcgttgagtctgaaatttgtccctggaccgcaaaaccgcatacaatgtatcccccaactttacaaaaccaatgcaaacgaggtccctcaacaatattgtctccagatttgattgacatgacacatacgtggctcttttgattaggtttttgtctcacgtgacattgacatgacgcatacacgacagtttggtccaatctgaacatgttctttgggcatccacaatgtgcatgtaaaaatgaccttaggattaaagtaatatttatgttctcactttatgcattgggagaaaataaaaggagaaaaagttgctatggacaaccttaagcttaaggctacgccataaggaataaaaaaaaatcattttatacctttgtaacatccatattggtttttgaatcctgcatattaaaggttaaaaatatttttttatgtgggtcctaccttaaggttgagaaaagatcataaacattgtagcatatgttataagtgaaagaccatatgattgtgggtcccaccttatggtctatatctctactattataaaaattgaagatgtttttttatactttggtacgttattcgtgtatgagtcggtttctaagttcgttcgtttttggaaatacatatccgtatttgagtcggtttttaaattcattctcttttggaattacaaaaggagttgtataagaaatctcttaaaaaaactcgcatgctaacctgatatgatcagacttctaactgcagctcataattttctaaaagcatatatatgcgaattcccacagagaatttcactttaactaaaacgtataatgataatagattaaaatagcttgcaacgcacgggtatttgttctactgcacttaaacattgaggatgtccttaaggcaccaagatagtgctttttttttcattaatggaccgtgtaactgcggtaaataagtaattctgtcccgcgcggaggtggtgtggcgggagatgctggtggcgagttgagcccgtggcatagcagcctcacgacggaggctacgaggttggccttcatggccctcaccggcgctcgtgccgcagtgcacgggaacacaactttggcgatcaagcacctttgcggtggttcttcctggcaccggcgtggcgggatcttgttgcccattgactccatggaaaggttgcagttccgttactggttcaagtatatactgcctctttatttttattttaatgtatgatgccattgatttttttttcaactttgaccattcgtaattttcaaaagaatatgtaattatcatttattttattgtgacttgattcatcatcaaatgttatttaagcgtggtataaatattttcatatttacacaaaatttttaaataaaacgtatggtcaaacgataataaaaaagtcaacggtgtcatacattaaaatcggagggagtaacatgcatgtagggggagaaatcgtaaggtagaacccacatagcaaatcgagttaattagatcatgttattataaatttatctattttgaaaaatatcatcatcattcatttatttgaaaagatgccaccacaaacctcccaaaatcatatccatgccatgccatatgtctgagtgttttgaagcgttttttgtccatctttatttcatattttgaccaaattgcccccatgttcctccatccatttgcattcatgtcgaaacatgaattcggcaataataaaagggatagcgcacgagatctaaaagtggatggatgcggagacaaaggatttagacaggttcaggccctctcaatgagaggtaataccctactcctgattggggatttgaatccgccgggtgtattagatctgacgatcatatgtgctcatgccccctagagggcctcctgcccaccttatataggatgtggggcaagattacaagatacaaaccttaaccaatacggtatcggtttcctaaatctagtttacaatattatcaaaccaggactttaggccgttccataatatacaaggaaacgtaatacccaagtcatgatctgttacatattctatagatataagttatcccctatatctagtcggataaccatgccgtgtgggtatggggtacccataatctccacagtagcccctgagaccttcacagtcaaaaagataatcttctcttgaactagattattccaaagccaagtgctttaaccatctttgccataatctcccgaatacttttaccaaatccaaagattgtgaagggctgaaaaataattgaatgtaaatttatgtgcatcgagtagatgcacctaataggtgtagcccccgaccatgtggttagttgaacaaaccaagcatatagtcaaggaataaataatccaaccaaccgagtggtttttaataattatagtcaaccaagtgacttgatatcaatatatagcatatgcggtgcgaatccccaaataacatagcccagatgatataccgactgctttgtaaaaattgatgcgagcaacctaaagttgactacatcattgaaaattcacatagcaaaacagctataaaaaagcttgaatgctgtgaataaagaaatttccaaagtattgggcataagccatgcgcacactgcttcaacagatgtgcttaagtccctaaaagacacatggttttaccacgcctggaaatatacggcatatgtggtgtaaaatccgagtaaataaactcataaaggatttaccaaccgcctagaaaatgaccataatatataatcagcctaagccataatattggtcaataaaaatgcacacttacgtggcaaaaagcaatgatattgtatccaatcaattgcttaaaaacccaaacatcaccttgacttatataaaaaagtcagcggggcaactatataaagctttgctgtttgataccttttaagatgcattgtaccaactcctaaaaagttgagtaactgcggtataaaaggattttaaggtattgggcacttgatcacgcgcactttggcctaagcaaaaagtgcctaagtccttaaaagaacgtgataggccacacctgaaaatatgggctgcagacatattaggcctagaccaaaaaatatgccttcgacaccctttaaaggatgacgcatgtaacatgctcccgagtaataaatcttccgggtgatatagaccaagtgtagctcatatgaatagcttctgatctaagtgattatcccttatgggatactccaaaatagatataacaattgaatcccgactggcgcaagtattcggttgataacccttacagggaataataaatagtccagtctttgagcatagaaaatagacccatgattatgaattcatgttgcatgtatccggaacaagtccaaattggaggtatgatacttgtgtttgagctagtaagcccctgagcatatagcttgtccttctgtcgtagtcacaattgtccattgatggtagctggcgcagttggcatagagacaagacgaccaatatagagataatattgtctaccagaggtggcaaaaatattgatggtagtgaagatagtgataccaatctaaagtgatgaagttgcacagccgtggaggcgaagaaaccagtcggcagcagtcaggtcagccagcaatgaatatgaaggtgcccagtgataaagttgtgtagccatggcaacgaaataatcagtcggtgacagacgagacagctggtgaagaagataaagatgcccattagtggcgacataataagccatccgtgaaggcgaggataccagtcggtggtgacgaaagcaagccgacagtgaagatgtagacacgcatcaaaggcgatgacgaaatccaccaatcatgaagatgaagaaaatagtcggcgacgacaaacacaaccgacagtaatgatgataagcagcaacagagatgatcgactatgaggacgaagttgcccatcaaacagcagtagaataggctatgttgaagaggcttggcaggatattgataaagatgacgatgtcggtgatccagtcaatagcagtgtagcaaccaatgataatgacgaatacgctcaccagcgtttgcatagtaggtcaaccgtgaaggtgaaataacaagccggcaataacggaagcaaccggaggcgaagacgtagtcatccattagcaacggcagagatgtcagagccgatgaagtagaggtgttggtgatgaagtcagtgacaataatccatcaaactgttgagaagatatcaaagctcaagtaattttcttgatgtgtgtataacgaagattgatgtaacaccccttgatttgtaaagatggtagtagaacttggagttgtagctgttgcagatgcttcacttgaaggaaagtaaatgttgttgtccaactcatcgaaactgagctgattggttgataactctaaactcccggacatgtagatagaatctcaaacttgatacttgaaaattttggagtagattgtggcggcgtagagaagccaaaattaccagtgaaatcattggagttgctgaagtagaacacttgctctgaagcgaagacaaaacttataactctcgaagtagattccatagaactcgttggctgatttgagagtcttgtatttgtatagcccccgactctttggttagttgggaaataactgaacatagagtcgagaactgcagcttcttgtcatcgagtagtcattgcaatcaaaagtgaagatgcatgttgaagatgtccgagtaaaaatattgaagatttgaacaccacttgttgtagtaaaataatacggcatcatatttggtgacgtatgccgaggtgtcgaagctcttgtagacgtcgtggctggtgaagtagcaaaacttgcgaagtagcggcaattgagttggccggtgccgaagataataaagatgaagtccctccaccatggtgacaaagttgcaaaggcgtgatgaagtgaacacgagtcaacagcaacataagcaaaccggtagcgaagacgcgtggttgtgaagataaaaacaccagttggcggcggcataaccagtcggcaacggaagaagtagaatgatgatgaaaacgaagacgttctttaacagcggcaaaataggccagccatgaaagtgaagacaccatgggtggcgccgaaggcaaaccggcgatgatgatgacgccagtcaatgatgacgaagacgcgcagccgtggaggtgaacaagccagtaggcgtcaaacaaggcggccagcaatgaaaacgatgacgtccatcagtagtggtagcaatataaaccagcagtggaggcgacgacactaatcagcagcagatgagacgaccggcggtgaagacgataaggccaatcaacactggaagaatcatgcagccatggaagtgaagaaaccggtcggcagcagacgcagacaacttgtgttgaagatgatgacacctattagcggtggcagcgacatggctggccgtgaagatatatcaccagttgtcgtcatacgaaggcaagccggtctgtgaagatgtagacacccaacaacggcggcataataggccagccgtgcaggcggtgacaccagtcggcagcggcgaaggcaagccggcggtgaagatgtagacgtctaacgacggtggtgtgaccaaccaaccgtatagacgaagacaccagtcggcggtgacgactgcaagcctgtggtgatgttctgactaatccattcctggagtgtaagagataagcttaaagccatgaatcctttttatgcatatctggatctggatcctgcagaacaaatatataggatgagtagtatctgatgcaaatataatactcgaggaaaatttaagtattttaaaatgtttataaatatatatttctcctattgtcaattttgatttccccgagcagatgactccttacgtttaaacactctgcccgactagtcatagcccccaaacattgggagtcggcctaggcacttcccaaacatgcatatgagtgacatgagttcgtcattagtggaacaaagtttcatggatcagagtttactacttaggtacttttgcaattattaagagtagaaaataaattatcttatctctatgcttttgatttcttccgagtaatacttagcaccttgcgttactcggtccattcaacgagcccccgggtgctaggaatcggcccaaaggcaactatccatcgacaaaccaaacggaaagtataggaagatagaactccataactcgataggcacttttgtactcagattatgtcgcaagcaatcaagataaatattatgaaaattgtttaaaaaatatgatataacatctatagccctcgactcactagtcaacggcgaaccagttgatatagtgaggcagaggaaaagaaaaatatcatataaagaaaattaatgatgacttagctttgtaatattccccttgatgatggcagaggtggccaatgtgggaacaaagtcgtccgtcaataacaatgaagacaccagtcggcggcgaaagaaggcggtcgacggtgaaagcgaagatgcccaccaacggcgtcataatagaccagccatgtaggcagagacaccagtcggtggcggcaaaggcaaaccggttggtgaagacgtagatgcccatgaacggtggtgtgaccaaccaaccgtataggcgaggacaccagtcggtggcgacagagacaggccggtgaagtcgtagacgcccaacaatggcggcataataggccagccgtgtaggcagaaacaccagtcggtggcgatggaggtaggctggcggtgaggtcatggacgcccaataacgacggcataataggccagccatgtaggcggagacaccaatcagcggcggcgaaggcaagccggttggtgaatatgtggacgcccaccaacagcggcataataggccagccgtgtaggcggagacaccaatcggcggcggcgaaggcaagccggttggtgaggatgtggacgcccaacaacagcggcataataggccagccgtgtaggcggaaacaccagtcggcagcggacgagacggccgggcggtgaagacgtagacgcccatcaacagcggcataatagaccagccgtgtaggtcgaggcaccagtcggcggcggcgaaggcaagccggctgtgaagatgaagatgcctagcaatggttggaaaatgctaggatatgtcctcacacatgtttgctcccaatctgctcgcacgcgtgtatatatgtgcatacggcagagtgcaaattatgagtgtgagcagctcgctccagccagatcagggcgacgtcagccggatggataggccaacgatgatctcacatgcaaaaaatacccaatatattaatcagactgattaggaatagcaattagcaataacgtatagatattatatgctatatatattgatgtatgcatgcagcatatacgcatactaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcatgcctgtccagatagcagtggtgactcccgtggccgacctccatgcagagcagtacgatcaagcagggttgtgcaggctggtagctggagacgtggccgatgatctcttggatacagatgattttttttggctacggactgtatagcagctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctagcgcgccaactgtcgaaacatgaattcaacaataataaaagggggtagcgcacgagatctaaaagtggatggatgcggagacaaaggatttagacaggttcagtccctctcaatgagaggtaataccctactcatgtttggggatttgaatccaccgggtgtattagatctgacgatcatatgtgctcatgccccctagagggccagaactttaggccgttccataatatacaagaaaacgtaatacccaagtcatgatctgttacatattctatagatataagttatcccctatatccagtcggataaccatgccgtgtgggtatggggtacccataatctccacaattcatgaaaaataatacggaaaggtaaaattccaaacttttgcatacacgggcaaaaacatccgtacaattcgacaaactaatttgtttcaaattgcaaacaatacgcaccaaatctgggtaaaaattacacataggacaaaaaaaaaagaaaagaggaaaagaaaggagctggcatggaggtctgccatcgacgaccaccgcccgacctcgctgccgcaggacacaccatccccgacctggcaacctcgatattgctgaatctgttcacaccgttgccgaaccagcggcttgtcgtcgtccccactaccaggcgcacctcgcctgccggacttgcagaccatatgcaaacccagccttcgttgccgccgtcgtcgcacttgtagaaggaaacatgggtgttttggtctttacagaaatacggtagataaaaacgcatcaaaatgtcaaaatgtgttgcagccgtatggcatggcagggataggattttggaaggtttaggtcttgttcggtttagagcggattgaagagaattggaggggattgagaggaaataattccacaccgcaatagatgtggaataaattcccttcaatcctccctcacagggatcaaccgaacaaggcccaaataatttataatattattatcaaaacagacaaatttgcagtggcattagagcaagtttaatagtatagcccactactaactccaaatcatttatagccaatgtaatagccaattcatacaatagttgttcactatactattaatacctggtccacctgtcatacacacgttacgtctttgagtccatactgcagttggctacagatctgtagctcgctgctcttttctcactctttctttatctctttaaaatatgtttatagctggtttatagcatgctattgtatctgctcttagtgcaattaacccaagaagagatgggagagattagggatgaaaacggagcggatagtttccgtccattctggagagaaacgaatacggataccttcagatcggatagttcggatacaaatacggatatttcctcccggatacggatatgaatatgatatcggggttttcgtcggatacgaatagtaatttggatatccagtgaacagtgctattcggatatctatagaagtcatgagacatacctcatttgtttacaactctagaccttcaatatacctttttagattttaatagtagttcatctcttaacactagcccacaatattaatattatttaaattttaaaaatatttataaattatactatattttatataaaatgaggtaattatatattttgatatttgtttctattagaagttgagttggtcttcgtgttccgagaaaaaaattgtttccatattcgtgtccgatcatattcgattcttattcttattcgagataatccatatttgtttccgtattcgagctatccgtattcgtttttgtatccggtaaaaaaaatatgaaaacgaatacagtatgagcattatccgttcgtatccgctccgttttcatccctaggagagatgggggtgccagtgcccggccaaagaggagaaagcagagaagaccgtgacgtgattttcttgttatcgcattgcatcgtgggctggattagagcgagcgactgatgtgtaacactgaaattttcgaatataaaactttagaataactaaaaacctttttcaaaatttgaataatgctgatattcactggattttcctttttctcttcctattgtgctagtgccaaaaattaaaataaataaattcaaaagaaattaaatccaaattttaagttcaaatattaaattcaaacgtcatttattaaagcacccgttatttaaattaaaatcctttagggaaatattatacagataaaaacaaaactagtttcaaagtctaaaccacaccttgtccaaacccttagcctatctctagtctagccgagcacccttatcttcttcctccatttaggccggcccatctagcagcccaacctaccggtgggcctgctctgtctcggcccagcctaccaagccagcctggcgagctgcgagatgagccaacccggccagccaccgtcgtccttccgccgctgtcgcgctgccggagtccggggtgccgctgccgacggaatctacccaacccgttgtacctcgccaccgccgccacgcgcccttgcgaacggtagatgaccgtccctccaccttttcccctggccgactcgccatgccgcgtctcgacggcgtccatcttgctgcaccaggagcacatacggcagcgcaggaaccgtgccgcatcacctgccacacgaaacatcaatttggcataaaaagatcaaccacacgaaagtacgaaactgctgctaatgataagattagtgtcactgtagcatacgcacattattctgcagcctatcttctccttacacaatacagtttcaggtgcaggttggttatctgaagacaaagtcggtgctgataaggtaggttgcagtgagcaaggcctcatccgaaaagcgaacgagaagagttagccaagtctctacaatgttgcaatgtgcatgtgggaacacaaacgatgtgcaatgccaagtttcagaatgaatttttgcaaccttcaagtcaacatcaaaccaatcagtctgattgagcagattttattatttggatatcgttgaacatatgattgaaactgaatgaacaaatgctccagtcttcaagagaacgatatacccatgtgaatctgttaaaatcatcaataacaatatgtttgcccctttctgttttattgtccactgaagtaaacagtcagtcaattacgcctgtgtcccggtagcacaacagtgtcttgtttgaaaatactgtaagcaactcatcagagatccaggaattagcatcagagaaggtatgctgcagatgtgtacggagaaaatgctcttaacatctactactaaatactaatacctcaaggcatgctgcagtcagccttgacatcttgacaaagttactagcagccttgcaaaacttcagtgagtgaacagattctgaaaaaaaaaaatcagcaaaaggtggagttattgggacaagttcaaggaatggatgatcttcattctgtacatttgcaatttgaagatcaattcctttcttttccacaagtttctgcattttcacctccctgtttcatttcttcagtcccaattcaaattgatgcagcagctggcattcggtcagagactgcaattcaagacattggcacttattgataaatagattactctatttatcttagtaacatccaaattcagaaaacaaaaaagacactgctccttcagtttgattgccttccaaaattaacaatactttgcccatcattttcttcttcttacaaaaaaattccttcaaaaataagaatgagtaggacaagcaacagtttaaatttctgatcgaattataaaactgatcaaaacaagttccaaatcaagctcgaaacactagttatctgaaaaaactatcacaaaaaagaagccccgctgctcgcgcgggagcacgcgtgagacatacgctgtctcacgctgacgtcggcgcgtccaataaattcaaatcccaccttactggaaatatcccacgcgcgcatcctccactcatctcctctcgaccaagatttcccccaaaaccctagaaatccccaggcggcggcgcggcgcgcgatcgggggatcgagccggcgatggcgggcgcggatgggctccttcccggcctcaggttcgaccctagcgacgacgagctcgtctcccgctaccttctccggcgcatccagcagaagcccctcccgctcgacggcgtcatcgtggatgccgatcccctgagcgtgccgccatggacgcttctcgcggatcacacccgaggcgacgaggccttcttcttcgcggaggcacgcgccaagaatggcaagggcaagcgacagaagcgaaccgtggagggcggagggttctggcaggggcagaggatggccgtggatggcgagcggctggtcgtcccaggcgacgatggaggcggcggcggcgacgaaggcctggagatcacgtggcgcaagtatgtgttgagcttcttcgccgagggtgaacggggcagctcgggctgggttatgcacgagtacgccgtgacgtcgccggctgacctcgcctcgtcgcagctccggctgtaccgcgtcaggttcagcggccacggcaagaagcgcaagagggagccgcagtgtctggactcccacgacgacgacgacggcggggatcaagaaagcgcgactcaccggcgcgccgtggctgagaccactctgttcgacggatacgtgcctcgtcctgcagccgacggcaccgaccagggcacctatggcgtgatcgacggcgaatcttcgctggcgtcacattgtcttcccgatcagatcgttcccccagcagaagaagctgatgccactgctggtgtagagaatcctctgctcgatgaggagcgctggtcaccaccacagcccgctctggtgaagcagaactcctacgacctaatggccatttcgtcactgctgttttctgatcttcccgacagaatcgatgacgatgacctgtctgtgtcgcaaacagagggcaccgatctgttcgagcagggctcctccggcgtgatcgacgacgattattgtcgggtgttccatggactgtccgacctgatcgcgct

SEQ ID NO: 37853 - DNA, 3153 bp, Oryza sativa
cagcagaggaagccgaattccaccggtggtgcagagagagaagagatcgctctgctcgacgaggagcgctgcccgcaaccacaagccgctcctcctactgcagctctagtgccaccactgcagggccagagctcctacgacttgatggctgattcgtcactgttatttgctgatcttcctgggagcatcgatgacgatgagctgcagcgatctctgcgtgcgtcggacatgcctgaccagttcttggcgcagacagaggaagccggtgccggtggtggtggtggcgcagcggcagcgctgaacaagcagagcaactcctcaccgttgggcgtcgaggtgccgatggcgttgtctgatcttgagtccccagagagcatgcctttgtctgatctagagttcccagagagcatcgatgaagtgcttagttacattgacttcaccacggatgatacgagctgcctcgatttcgacatggacgagctgttttccgacatgccagcagactagcgccctgcagagagcaagtgatcaacgctgacattgtcctcttaggaagagatcagagcaagtgatcaacgctgacattgtcctcttaggaagatatcagttcttcttcctctgtagcgcagtactgcagtctgtgcagcggccagaagtttaggagttttgtgtttctaccctggaattacatgtatttattagttcattggttcaattgaatgtaacatgtgatttattagttgaggttgctgttgatttctatgaattcaatgtaagtaataacatccatgtacaatgagtggtgcacattcaataaagctctgtcattcaaattcagaacagagtacattagtttatactgaaagtctgaaactctggttttgttttcttctctgcttccttttcagtttgcacacactgtatggataaaaaacgaccaaatgttgtgatccttcaggacacagcatggatgtaatctttaacaaattgacaacaggctccaaaaagagcattctcagattcaccatgactaatgcttataaaacatgcaccgttgttactgaattattgactggagtgatacacgcaccaaaaggctcatcctcacacatcacaggcattttggcctcaatggatgacatatgaataaatgatacgatttcagagaatatagaacaaacattcataccacatccttttttatttgcactgtgaatgtcacctacatgagtgccaccgacaccctagcacttttcttgcatacagttatagaaccaacatgctaggagctacaaaacagagctgcagttcccctaacttatgtcagtactaggatgtatactgacaagtacgtcctacatgatatttacatttactgaagattgtacaaaacaaaaacatggagcatcttcaagaatttgcaacaactttgttggctccaatgcaacacgatacaacgatgctgcaaaactgattaatggaatgattccttcaaaactgattaacagcaaactgaggtcctgtggaagtgcttgttcttgaaaaagagtgagcaaaagtcttgtagatcctagccagatgactatcctcccatcatctaatgccagcagcgctttacattgtactgggatactctccagttgacctcttgtatcttactagcagcactgtgtcgagtgacttccaccttccaccaagtttaatctcatcatcttttgcaagctgaagtatttcctgcaattaaactaatataaagccaaattgagggtaagacagtagacaaaaaaaaaagttagtatttgaacaaactgaactagggcagaataagccacacccccaataattcaattcactgataaaactgaagaatgtggttcatcttgctcactttgtggtatcatggaggatgagactatgatccatttagccaaagtgtgtcaattctttattcatacatggaatcgtatactcataagttggccttgatggaaacatccaattggcacaatctgtctaacaaagattggtggtatgcactgggaagggatcaatgcaaagaagatataagattaatgcatggatacctaattaggacctgacagaatgtatagcagggaagggaacgaataatgtttcaacaagaatcaagaactgacatgcaagtggcacatattatcagggaggagattagcccagggggaattcaaccaggaatagatagttctagctgttgttttcttagttgttgcattcgtttcttccaaattttggctgagaacatgtatgtatatttcttgtatatttctttctgtttttctcaattgaatagacagatctcctgcccttcttttattaaaaaaaatcacactcatgatttccaacaaaatcagtagcacagtaccaatgggcatcagcagagtagttaatattgaactaatctaaaatggccagattcaagtactcaacagatcaaaaagggtttattatgcatgagattaccaaattcaacattactagcgcacaatatagcaaggccaggttgtcctatggtaagctgagagggaaggggatgataactgctggagagcgccggtgttggggccattactggaaacctgccggagaccttgaagaggactgcgccaccggagacctgcttctagtcagtgccggttcttggatataatacttatgcacagagtcctataggtcctagccagatgactattctgtcatcaatcatataattctagcagtggctactcaatctctagttagcctcgtgtcccttgccagcagcacttgtgcagagtgacttccaccaatctcctcatcttttgaaaactttactctatataattaaacaaacataaaagcaaattgagggtaagcaattagacagaaacaatgttattagttaccagaatgaattgaacatctcaggcagaagaggccacactccactagttcaattcaacgataaaactagggttaactaaggaattacagttaacagttatagtagatagtactttcaggtttcaacattgtcagtaccaattagcacctcatcggtattgaagtaatttagacactactccgtttcataatataagtcattctagcatttgtttcataatgtaagtcattcta

SEQ ID NO: 37854 - DNA, 10342 bp, Oryza sativa
  unsure (1)..(10342): unsure at all n locations
gcggaaccggtcgccgccgacgcaccccacctcgccggccgccaccccgcctcccactccgccgcggcgccgccgcccgccggagtacacgacgccgaacctggagccgcgtgtgcaccatggtccggtacctgaactcgaacgcctggagctgcaccgtcgcgccggggaagaccactgacgggaacagcacgatggggatctccgccgcctgctcctgccgcggcgccctcgtccacgcagccgtgcaggttgctgccatggattgttagttgagatgatcacatctttcattgttagagataaaatagcatgtctatcccttttccatatatatcatatcagttatccccagctcctaggttttttctccagctatgatcaatgattcaaacgagtatactttgtccgatccacaggtctgaatattccatccgcagagaattctgagacgacgactacgaagaagaagaaccgatgatgctgcggttgatgggccttgcaaagctagatggaacttgtagagtcttgagcgccgtgttctcctcctcctccgcggcggcgggggcgggctgcgtcgagctcccgtccgcgtgcggctgcgactcggcgggcggcggagccaagcggagggcgccagcctcgtcgtcgacgtctttcaggtgcgcagcggtgcgaagccggcggggcggggcggggcggagcggggggtggacggcagcgcgaagccgacgcgacggactggggccgcgacgggcggacgtgcgggtggagtcttcttgaggtggtagtccccggcaccaggggtgccggacgcaggataaaaattgactgggggcatctgtggtatgtaaattatctaacttaactttataacttatatatagcaagttagaaaacccaagtaaattcacttattttgcagatcctacataaaaatgactatgacatattatattactccaaggaagcttgtctgaatcagtacttcagtaggttgaggggcttgaggcattgcaaaattttgtctagttattggttttgatgcatttacactagattccttccattagtgttcattattgctgttgttttttattacaaatatatgtcattatcttttcctaccaaatcattgatgagatgttgcattacgatattagtgctaccacaaactagaggagtacggctcaaaattttgaaagacaaaattgctaatgtaaacataaaaacataccgtggctacttaccaagggcaactagagagggtttcaggctgcaggtgcaccgggtgaggcttgccgacatggccgcatgggccgtggccatagcccatagagactgtccacgacttgcggcgtgacgcgattggcacgggagatgcattgttgggcagatagcgatggaaggacgccgacatcccgccatccgtggctctcgtgaagcctccaggcagtggtcgcgacggcctccttcggcgccggcacttgcaggctgtgggaaacggcgaactgcgggaagcaccagattttgatggcctcaatagctccggtaattacgatttgtagattgggatccagggaaggggagcggacggttcgagtcctcaatactgtcctcaccgcacgcacaaagattgcaaaggaaggaaaccagaagagtgggggccttcttgtcaggtgcagtgggggcctattggtaatatgattaggggtatgtgtaatatatgtaaaatttgagtggggtccagggcccccactgctaatacgctaaatccgtctctgcccgggcacagccgtgaccgtggccggagaggggagatggggagatggggagaggggaggaagaagaggtaggggggagtgacatgtggagcccacgtggacccccaccattttttttattactttgtgtctaaaactgacatgtgggtcccacggggtttaatatttttcatattgagttgccacgtcaccgccacgtcaatgccacgtgggatgaagacatagtcaaaagagccatgtaggcgccacatcggccaaaaccaccctccatactgccgagggatctcgtttgtctggttttcgtaagttgagggacgggtcgtatccggttttacggttaagggatgaaaatcggactgaccgacaaatagagggacctaaagtgaacttattccaaagagaaaagcccaagtaaatcactgcgcagtccgagtccgagcccaactaaaccacgttctaatctctcctcctccgagtcttttcggtttggctcgatccgctttgccgcaacacgagagaggaaggaatccctcacgccgttctcgtctcgccgtcggcgcggcgtgacggcgtcgcgatggaccccgccgccgctgccgccgccggcggcggcgccggtccaaaatctgatgcggccccttccgcaccggcgctgcacggcctgccggtggagatgacgacgggggagatggaggccgccatcgccgccctccccgcgaagaaggaggcgctgcgcgaggccttcgacgtcctcgccgcctgctcgcccttcccgctccccttcgcctggggcgacctcgactcctacatctcctcgctccagtcgtcgatcgaccggcggttcggccagctccgggtcctcgaggcggcccgccccgcgcttgcaggtcccgccgccgcctccacaagcgacggcgagaagggcgggaagcaggaagaggacagcgacgaggaggagaaagaggaggaggaggaagaggttgaggaggaagaagttgaggaagaggaggagattgaggaggaagaggtcgaggaggagattgaggaggaagaagaggagattgaggaggaggaagaggaagtcagagaagaggttcaggaggccggggaggaggtcgacgaggagcagcagggagccaacgaggagatgcagaagtccaaagaagatgctgatgagtcttccaagagtgcgattccagtgcagaaacaggaagaggatgaggcagagaaggagataattgaggccaaagatgaggagcaacatggggacaagctggcctctcaagaacacgacattggggagaatggggatgtggatgcccaaggggttcagcaggtggctgacggtgagacaatggaggccaaatcggaggagcaaaatgaggctaaggtgacatctatggagcatgacatcgaggagggcgacgagaaagcgtctcgagaacaaggcaatcgagctcttccaagttgcagcgatcatcttaggggagtgtgtgctggcatggacgtcagggggctgttgaaattggtgtgtaagaaccagagcatttgcctctggcatgagtaccccgtggtgatgcgccatgccccagatgctgctgcccttgtcctccaagtcgtccagggtttccttctcagcaagaagatgaagaccaccaaggtttggggtaactgtgttgggctgattcggtgcttacctgcagtgaatgcctcgctgtcctcagacacaatgaagcaggccaagcagctggcgaaggattggaaggagatgattgacagcactggaagcagcagggacgttttgaacctgtcctcctggggcctcctgtattttctcatttcttacaacattgtatcggagttttctgttgatgagatcttctgtatctttggtactctttcacgcaaacaacagaaaaagaactgcatcgaactctgcaaaggtcttgggcttgtcaataggatcactggtatggatgactctctcttcactcaaggatcatatgcgttcctgcacttttgtgctcaatgatagtatgttaatgccataaattttcattgccaccactgaacagtaaacatgtgcacttcatataatgctgctagcctttatctggcaccctgcaaacactcatcgaaatgtgtaattctctctttcaattgcagccactctgtccatgcacattatgctatagtttacagtatttcatctaggtctgttcgacccatttcattactgccaaatttcatagccaccactgaacagtgaacatgtgcactgcatataatgctgctagcctttaagataatcatcaatagtgaatcatccaataagagatgcataggtagagtactccttttcctggtagcaagaaatgttgcatgcaagcaggttgtgcttgtatagtagtcggagtgaaacatgtcgaactcatagtgtagtaaaaataatcttctaatctaatatctgttcaccatcgtttaacccagaatattctcttatgataaagcgtggttttttcacactacaaaagagaattttgggagtacaataaaaaaactaaaactgaaggtcaactggtcaaattctactattctgcttcatcttttgccacattttcaacatacctcagatgttcaggggcaattaatcattgaatcctataggaaaaccactgcacaacatagagaactagatggcacaactcgatctcttgtatttgcttctctgttctggcatatatctcactgcttttcataaccaatttaaccgtggctgctgaacaatacctgattgattattaactcttctagtctccaactcttgtaatgtaactgtatagatgtttatgatttaaaattaattacttaaacgatcaacatgaaaacatgtcttaatggactgttttattcaaaatgtactggctgcacattatttgatttcaagatacatcaattttcatttggagaagcagcttggagttccccaggcagtggatctcaatcattgtgatccttatgctgtgagcctgtgactatatcatgttgtacattgaaaatccacttgaaatctagattaagcgtgggttttggtcgatagcctttttaagcatgcgttgttttttttttttaactcttggggagggatcgtttcctcccctgttttttcttcttctcttcttaaagaaatgacacacaattctcttgcgtgttcaagaaaaaaaaatctagattaataacttgcttatttcatttgagttcctaataagcgttattttttgtggtatttgttcgatgaatacatatagatatgttgagctttttagggatgtgttcctcttctgatggtctaaatcagtcaatcattttgaacatcttgaaccattttgcatattccatgtatctccaggcattgaagggctattggcagtatatacaagtgacagctgaccaataatttgaacgataaaataaaaatcctttctaattggcatgctagtcttgagaacaaagtttcaattattattcacttgcttagttgctccacttgtgcaccttgaggccctgtttttgcacgaggtactttttcctgattcacagtaaaaaaaaatgttaattccataatggagtttcttcagtgtttgtagacgctgcgaccaaatgacatttttgtttatttgatagacctgttaatataagctcatgtaggatagtttatcatctgatattgatacatcacagatatacctggtaattgcttggtgcaatgtatactctgtagtaactagctgatgaaatttcaatttttgatactatgatgctgtgctacttgtagttaactagttatttcctttttatatatacatttcaacataattgtagacatttatctctttgataatttttattttgctggagcaatgtctgctgacatttttcttgttgtcatgtttttgcagacttaattgattatttgattggaaatggtcaacaactcgaagccttactgttaacacaagcttttaatttgatagacaaatatactccactttctcttctgaagggatatgttgaaagggcaaaacagaatgctctggatataattaatatgaattctccacgcaagtctctggtattgactactccataggaaatgattaaatgttggggtagtacttttctaatttatactgcaacgtgatctggcaccgatcgatgtcataaatcataagagtaaatagaaacttgaaatattgttatgcatggactattagagtgatcttttaccttgcaaaaattaagaaattggaaataagacattcttgtagtagtagtctggtagatgtttatgttacaaaaatttgttctctcctcgagctatttattttttgatggtttaaatatttgatgatggcacatttacttgtgagcagagtccacttataacgaaggaggtggatagtctaatggttgcacagaacatagttcaacagcagatcactgatttcaacgtgcgcagtggtatgctggcagaaatgaagaaattattagatcaatatgcaacgaagcgaagttcaggggatgcttgttctgcctcaacttcaaattcagagcagcagcagcagcagcagcaaaagcatacaaacaagaagcgcaagagagagcagctcgagcagcaacagcacaggggacaagagatccagcagcagaagcaacagattaaaccacaagggaagaaggggcagcagcaaactaagccagaacagaagaagcaacaacagctaaacacaaataagcctcaagagcaacaacaacagcagcagcagaagcaacaaattaagccgcaagagaagatggggaaggagcaaactaagccagaagagcagcagcagcaacaaaagacaaataggcctcaagaacaacagcataagaagccacagaaaaaacagcagcagcaacaacaacaacagcaaagtaagccacaagagaaacgcccaaggccatgcaccaccaagctgccaacaccatctatccctgcttccatatcacctatggttccgcatattgtgcaggttgattctgttgggcattcaccatatgctgcaatgcctatatctcacacttatgctgcccaactaggttggcctggaaatcagagcgctgcatttgcacaaaatgttggagtttctcaatttatgggtatgtttaatccccaacagcctaattatcccttctaccgtcatccaccgttctatcccaggtagcacttgctgcaatgggttgttgagtaaactagagaaagatatagatgcttacaggagttttcctcttgaattgtgttggctcaattgcctcatgttgtgttggacatttatttacattaacatgtatatacaattttggccattctctttgttgtaatagcttttcaatagttctgccctttgaaggtgcagcttgtcgatttaactgacagttgacatgctccttgtttcgtttgttattttaagtgtggacgtttgaggattatatgcaaaggcgtggaggtatgatggtgcggtttctgttcaacatgtctcgaagcacaaatgaatttcagtttaatgcttttggaggcaactccgtttcggacgtccgaatgtttggggaaaaatcgggtgctgacgtcagcatgacatgacgtcaacgcctgatttacgtgaaaaactattttaaactgatttttctcttaaattacttatccaaatcatgatttgattgcaccattaaattcgttgcaattaaatcttcaaaacaagaccacacatggatatattttaacaaaatttttttagcttattattgaattatttctaaatgttgcacgatgttccaccaggtatatcggaattgtttgactaaatagatcgaaaatgtttcacttgtttaaatcgggtgttgtttcaccttatataaaaataatgtttcagcaaatagcgaaataatgtttcagttcactgcaacatttaatccatacatagtgaaacattataagtacactacgtgaaatatttttttggggaacaataaataaaacgaatttccttaatagggggtttctaaaatatgtgggttttttttcaatgaaatatttcagttcactgcaacattagatctatacatagtaaaacattgtgagtacactaggtgaaatatttttggtggaacaaaaaaataaaccaaattcccttaatagggggtttccaaaatatatgggtgatttgttacaacggcgcgttccataatatcaaaatccactacaacatttgatccgtacatagtgaaacatcgtaagtacactagctgaaacatcataaaactaatagttgaaacatcgaaagagatcatatgcaatattcaaaaaaaaatatcaatagaaaagctaaaatatttttttatcgaaatataatcatgtgtgatcttgttgtaaagatttaattacaacgaatacaacaatgtgattggatcgtagattggataattagtttaagagaaaaatcgttttaaaaggagcggtaggaggcgcgggcgccacgaggcgtccgattttttccatgccatcgggcgcccaacgcgcagcattctcgaatgcttttgcgttaaactagcttgtgcattcaatttgatatttattatactaataaatattccacgtctaacattaataggctcacgtgagggtaaagtgttaaaatagttgattgagcatcttcctcaattattagcttaagttttttttattttgtttagtcggttcatgcaacttaataaggggttcatatagctcctaaattgcttcgtggcaaggatttccgcttccactaaacttacttagtagccccttatctgtttaatccccaccggccttgttagctgctagctagcgcgtgcgcgccagcagcgagcacctccctaactactttatagtattacctccctaactactctatagtattagttaacacccacttaacactaataacgagtaattatggaagattctcaagattttttttcttttttcgggagatttttttactaacagattgaaaatttttaagtcagatttgaaaacttttgatttaagatttaaattttaaagtcaaattttgaaaactttccactcagttttgaaaactttcaactcgagatttgaaaacgttcaactcagattcaaaaactttcaagtccagatttgaaagtttaaaactttcaacttgagatttgaaaacttttaactcagatttgaaaactttcaactcgagatttgaaaactttcaggtccagatttgaaaattttgaaaactttcaacttgagatttgaaaattttcaactcaagatttgaaaactttcgactcgattcaaaaactttcaagtccagatttgaaagttttgaaaactttcaacttgagatttgaaaactttcaactcgagatttgaaaattttaaagttaagatttaaaaattactagtaaactaatcattagtaaaaataggaaactaatctatccgtacggcgggaataacaaacagggaaaaaaaaggaaaaaaaagagagaaacacaagcgctagggatgtcaatttccccgacggggacgggtacccgccggggacccgaccctacggggccggggtcggggctatatttggccccgcgggtgcagcggggcggggccccgaaaatatgcggggacgggggcgggtctaggtttccacccgcgggtgacccatggggacccggaaatatggtacatgcgtagattgcaaattaaaaatgtggcccaaacaagcccatgttgtgaaataacttttcctatcccatcttatctaccccagccatacatacagttacggagccatccatccagatcgagtcaatgacctttcaaatcaaaagaataaaaaaagaaagatacagtcaacgagtagcgactgcatcggcgctaccgcagtcgttgcaagctgctgcgcctcgtcagctccctgcgaggctgcgcctctgcccaggccggctgctgcgcctccgtctcggccgcgggtcgccggccgttgcactttcgctgcgtctccgactgctgcaactccgccgcgtgtcgccggctgcttcgcctttgtcttcgtcgcgcgtcgccggcttctgcacctccgccaaatctccgcgatgctagccttctcgatgagccacttcatcttagctgctacaatcctggttttgtcctcttttctctatagcttgtggggcctcggtcggggtcggggacccgtagaggtcgggggcgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37855 - DNA, 703 bp, Oryza sativa
tgcaaaggcgtgatgaagtgaacacgagtcaacagcaacataagcaaaccggtagcgaagacgcgtggttgtgaagataaaaacaccagttggcggcggcataaccagtcggcaacggaagaagtagaatgatgatgaaaacgaagacgttctttaacagcggcaaaataggccagccatgaaagtgaagacaccatgggtggcgccgaaggcaaaccggcgatgatgatgacgccagtcaatgatgacgaagacgcgcagccgtggaggtgaacaagccagtaggcgtcaaacaaggcggccagcaatgaaaacgatgacgtccatcagtagtggtagcaatataaaccagcagtggaggcgacgacactaatcagcagcagatgagacgaccggcggtgaagacgataaggccaatcaacactggaagaatcatgcagccatggaagtgaagaaaccggtcggcagcagacgcagacaacttgtgttgaagatgatgacacctattagcggtggcagcgacatggctggccgtgaagacgatatcaccagttgtcgtcatacgaggcagctggtcggtgaagacgtagacgcccaacaacggcggcataataggccagccgtgcaggcggagaccccagtcggcggcagcgaaggcgagctggtcaatgaagtcgcagacgcccaacaacggtggcagaat

SEQ ID NO: 37856 - DNA, 300 bp, Oryza sativa
ctcgaacaggtcgtgcccagcgcccgccgcggtggacgaagtcgacagcggcggcgtcggcggcgtccccataggcgtggacgacgctcgctgctgctgctgcatcggcacgccgtgcgagtggtggaactgctgggacggtgatgagaaggagaagtcttcattcggccgcctctgcaggtcgcaaccgcggcctccgctcggcgtggcccgccccgccgctcgccgcagccgtcggcatccgctcggcatagcgcgccgcctccgctcgtcacaaccgcggcctccgctaggcgtgcc

SEQ ID NO: 37857 - DNA, 968 bp, Oryza sativa
cctggtcacgccgcggtagcaggaggtcctctggccggtgccctgcaccagcggcagcaccggcgacggcgagcgcacggcccgcgcggaggaggagccgccgccgccgccgtcgctgccccagctggtgggggtcatcacgctgccgtcggtggtggcgcccagagccaacgtgcgcggcgcaacggcgcccatgccgctgctggcgccgttgcaggtgcaggaggacggcggcggcaggaggaggaggggcgcggggtcggcgacggcgacggggagcggatgctgcggtgcggcggcgacagggaggacgaagtcgtcgtaggagaggccgtcgaacgggtagatcagcgcgtccgccggcagcggccccatgggcgggaacgcgagcgagatggcgccgttcgtcggcggcgacatcgtcgtagacctatcaacggcgcgtcgcggcggcggaagaagaggcggaggagtggaggaaaaaaaaacgaaaggagacgagacgaggcgaggcgggcggtaggagtatttataagggagggggtgaaaacgatggcgagaaggtgtgtgtgtcgcacttctcttggtgatctggtctccgcttcgcttcggcgcgggcctgggttggggtggggctaatggaaatgggaatggaatgtgtggtggtggggtaggtgggtcagggcgctgcgtcgtcctcttgtactacgatgcctgccacggccagtgtctcctctcttctcttctcgagttcgaacagtgagacagacacagagtggccctggcctttcagtccggtggttccggttctaaattatttgaaaatggaattggaactttggaagggcctgatagtggatatgtacagaagggagaagcaattttttaaaaaggagaaagctcggcttgtcttccaacctaaggaaaagggcaaagacatgtttttgtgtgggggtcaaagtccctta

SEQ ID NO: 37858 - DNA, 9496 bp, Oryza sativa
aggtttttgttgttgtgccatatgcatatgcatgtacttaatattcgcaaatagcaggatttaaatactagtggatggagtcatgcacctatgtcatcactaatgacaagtgcttcccctttttctttgtcatcatatcatgaatgctttacatcgaaacatcttgaagcgttctattgtattttgctgaccctttatttttttttcatttttaccatgaatataaggaacaagtagttttacgaaccgcaacaaatgtgtacattcatggacaaatgttttcccccggaatgtgtgatggaattttcagtatattttgcattgtgctactcctacatgataacatgttgtagtacgcaattaaccttgttctgcttcgtggtttggaacattggatattctcctgtgtaccgtggagcaaataaggtcgcgaccagctcggatttatctcaaaactgcagtgggtatgaaaccagaccagctcgcgcgatccacgaccctttttttttttttttgaaaactctccacgtctaaatccgattgactctttgtttcttcatagtagtgtcatgaacagtatgtcgtcttatcgggacaaaagcaatgcgggcggccggggccggtgctcatcttaaatgaatgatatcatagctatggactttataattcactgcatacagctcactgcaacaagttgtttcggttttatgtgcatgactgataagaaaatgatcgagtaagtgaataactttgttgccatttatgcatttcatagaaaatgatatactaaagaacatatcagatttaaacaaaaaactagtatacgaaatgtgatatactcttagcttttaattcaataaatatttttctaatatttatataacatattttaaatttaaattggacttgatatataatattagcttatatttttcatcgatgcaattgtattttctacgcaattatttctttaaaaatattattagatttcatatacatttcctgtgactcctttgaaaccaagtatttttcttaggaacttcatccaagaattgaaatcctataaaaatatttcctataaagccctcaaagaattgtatatataggaaggtattccaaaatttcaataggatttcttccattcatccacttggaggattccaaaatttatcaaaggtcgtgttttacatttccttcaaaaagtcgaaggcagcatgtccatatgatgcatctaaacatatcttttaccagattttgtgttttcccccatattgtgttttgcattttttttttatattcctacttttttttccaattttccattccaaagtagcccttaatttttttctagataaaatcataccttctatacaatcataataaaaaaataacatttcaattaatatgaaaatttctagtctcgagagtgaccatgtcaataccttctttttagccatccaagagagcaattcttatgacagtactactgttacatgaccacacatggtgcaaagctcccaccccatgagatatgttcatgcctcctttcaaatggggtaatttcaaagataagaaattcctatatttttttcgttccacaggaatcctcaaacttaggcgggggctttggagagtcaacaacaaattatcaagcgattttcacatttcgcatagtggtagatcagttttgtttcactaaaaactctagtagaagtaaataatcacatagaaacaaaatggatctacatcaggaagttacgtgatctttctttttaaaatacagctcaattaaacactatcattctcctatactgttttttttcttctcaattaaccacaatatttatctaattattcacacctacctttttttcatacacgtctgaacccaaaaatacggatcattgcaagcccctactgtacaattgcactccggattttgagtttttgcttacactatttgaccactcgtcttattaaaaaaaatttaaattattatttattttttgacttactttattataaaaatactttaagcataacttttcgttttttatatttgtacaaattttttaaataagatgagtgatcaaacagtaaaaaaaacttaaaatgcttggacggagggagtacatacactgcggacaccccgtgggtttcgggggttctcctgggctctcctgctgccgtgcacgtagtcggcgctaggcgcagccgcgcaggttagtcgaggtcgacccgtcccctcccccgcggggcccgccgccgtcgtcgtcgattgatggccgcacgccgacagggaggccgctcagtgaggagatgcgctgcatgcagccgcgacgtacgacgtgattgaggtgagagatcgtacgtgctatgctactcctcgatatcgcttcggacgcacggcggtagccgggggcgtgcagcggccaccgggaccggggtagcaagcgggggcttcttctcccggtcaaagggccactcaatcaagccggccgcctttcttttcttctcccttttcattactgcccccctcctcctctcctgccgttgtccagggcttttcgattagttgtttggcacgtgacacgagtttgctcttcttcccggctggatatgcagatcggcggcgattcactgtgtattgcactgcacggttatactatgggaaagcaaaatggtcgtttcatatccctaaatttttacgtaggctatatttagttcacaccaaacttttctccaaatctcaactttccatcacatcacatcacatctaaaactttcctacacacataaactcccaacttttttttccaaactaccaatttttcctaaacttctccccaatttcaaaaactaaacacagccacgaaaacgaaactcagtaaactttagttaaccggaaactgatcatccttaaatttccgataccgcgtttacttacataaataaagttcagggatgaaaagtgtcagatttccaagcttagagataatctttagactttcatggaaaatttagtgttgtaccttttcctatagaaaactaaaatttaagtttgtaatgataaaattttggcaatcaagcaatgttgctacaaattaacctttcggttagcctggttggtaggacagcattgtatttggtctgttaccaacaacaatggcagttatataatttgatattacatgggtttggtttaagaataattattataataaatagccttaccaaattttgattagcgttttcatttagccattatactagtatacatattatatataagagagaatcccttatatgtcactctaaattaactggctctcttatatgccacttcaaattggcttctcccttttatgccaccggttcaagtttctcctcccttttatgccattgccgtcagtccaccgtcagttaaccgttaacttcattgtaaaaatacgcatttgcccttgagaattagtatacaaccaataataggtattttagtactaatatagctactggatacaacatataaaaattgatttttttctgcatcacatgcaattttagccattaccatcacaaataaattttcaatataagcatgaaacatgcagttttccaacaatatttttaatataaagagcatttttcactggttctgacaaaattttgttcactcaaaaagaagtttacacattttttagttgagagggcatattggtcatttacgaaaaaaaactaacctttgactaacagtcaactaacattatagtggtgggagtggcataaaagggtagaaaaacttgaactagtggtatataagggagaagccaattttaagtggcatataaagaaactggtcaaattgtagtggcatataagtaattctctctatatataatatatgaatagtccgaatgacccattcggcacgacccatgctaacatcacaccatatgtatccctatctagtgacgtggttagagatgcgctcatttcctcattttcttttttaatatataggacatacctgcaagttaactaggccacaatatggcatatcttatcaacagctatagaactcgtgtaggcagaaatggtccattcagtgacgtccatgctaacatcatatagaacgttcctctaacactgctatagttgtctcaaaatctaaatattattttttttatttgatcatatactcatgttttgttttcctgtgttcaaaaccgaggataaacatacattataatattattataatattatgtaatcaaaagatgctaagacacacccactcgtgtgtgcaaggacagacccaggctcctgtgttacaataaaatattatcgtgtactttatccatcctaaaataaacaaatttagtacgagatgtgatatattttaataatacgaatctgagcatgcatttcgtgctagatcgatccatagtactatgatgggtggcatcatgtgctataccgggctcatgtcagaacactataggccaacataggtcttaggttagagtttttgtttttaaaactcaaaactttatttatatagatcaaggacagagtttaagggaaacaacatccccaatacattggcaacaaagatagaatatacataacaacaccattcaaacagaaggcaaagccgattgaactaagaagactgtcctccaagctaaacaaaacaatagtaattgatgagatcgatggggagctatggcattgccaaggccactacgtccacaagccactactaaagatgtgcacaccgctcgatagatcggcgaccccttcagttgcctccacgagaacttcgttgttcaaggtttaatgttgagccgtagatttttcttaggcttgatcggactcaacaatggtttgccaagaagttctctaccaaatctgaggagcactaactgtaatattatcaacaaaagtcgaacaaacagtccgcactcatccagaaacggagttctcatcttggatactgttgcaaggaaaattggaagacaatcccaaaccccagcctgccttaaacacaaaatgattaggaatggtagcaactgaacttaagccttggaacgattaagcgaaagcggaacacagtagcaacgatggaagagatgattcgatcaagcctccccaccatgcattccactctaaccttgcgactacagatcgctagatgaccactaccacgaagagcaatggtgtttccagaagtgacacccccatgaaccccagacactacaccaggcatcaagcaataagcccaccaaagacttacttgaagaaattgatgaacttattgagaggccacctcgcttgacatccagaaccacgagtacttgaggctggaggatcaagcgaactataccagctctaccttttaaataccaacaagtaggagccgagcacacccattttgccccacctccagccatcatcaccatggagaatgggctgaccaccctagatccgccatctctagctccgttcaccaggctgaccgacaagcaagatccggttgtgtcggatctagcccctccacctctcgtcgcaacgcaaatcacgccgaccctcctagatccgtccacactcatcgcggggaccattgatggggaggatgagcttgatgactgatgagaaccctcttcctagaggcaaagggacacccaaacctacaactacagctaccaacatcactttcttgacatggcaacttcaccaatgagacccaaaaataggatgaagtcgagttacaggatgacctgactacatgaggattttgacctaaactactctatattagtacagggaggaagcctcttccagccctcgtcagtggtaaaccaccagtgaaattggagggggcaggggtcaggatgtgggaaattaccgtaacttcttggtcgccctcgcactctcgagagataccctcaacaggacacttcatccatctaggtccatcccgcacttgtgtgggtatgtgcgatgtgtgtgggcatgataaatggtatgttttgccatatttactttcatatttagtacgatatattggtccttaaaaaagactaatccctccatcccaaaatacaataacttttaatgtttaaattgtgttcaaatataacaacatagtacttatgaaatgtgacttttgctactaattaaaccacatatacaacccctattacctcttagctttcttattgccacctagtcacctacccctagaagacaaccaagctttttttacctctatactaatagctaaaacttgctactccctacttttcaaaatataataagtttaaacattccacacgtatattaacgagaggaataaaaatattggttgtctcattgggatgagtgagatataagcgttctttttattaggatacatattttaccttgatatccgtttgcatgcttttcaaacggtatgttttatgcgaaaacttttatatagaaatcgttttaaaatatcaaataaatctatttttaaaaagtttgtaataattaaaatccgattaatcatgcactaattgtgttttggtgtatctggaatatttgtccttcaacagacactagaaagttacggcacctcacaaaagggaaaatggagttagaaaaggaaaaggttagatgagtattcaaatagtctgaagttcaaaaccaagactttccataatacttttacagaaacaatgacaaatgttactgaagcggaaacatgacactcaataaacagtaagctggcatcccatttcccatccaaggaagcaagaaatgtaagaaattggaatttataagccccagctagccagctttaaagtctcaaacaggtaaataatcagtgcaggtaatcagagaagcagggatataactcaaaactatgttgaacagagcccgagagaatgcatgacaatgttgagtacacaatggcaatgtttttttctttctctggatgacttgccacataagaatttttcggcagtacatgcaacagttttgcagcctacaacagtaagaatgactgacatccatcctaaacagtaaacactatcatatcgacctctgaatctggacccaacaacagttctaaccacaggtggcgatttacacaattttgctgctgggacagacattggacctacagtttataaaactttttatgcgctatacctctgttacatgtataccaatccccctatgctgtgtacatgaatatacatgtacctgcacaaaactcagaacagcaataagtagctcgattgagcttactttgccctagaagctcgacacgaaaaacccagctctcgccggccagctccaacaaagaaaaaaaaccctccatagtccttgtgacagaagcatcccaagcctcggtccaaaaaacagaagagattcggagtatctgatgatgttagcgtactcaacagcctgagtatcagatctctaactattctcaaacaggtatccgcagatgccgaacaaatttcagataataatggagtcctaacgcactgcattgcagtcctgattcatcagttggttgcccatcataaattgccgcggattctgtcgattctgtgagtaaactgagtgagcatacacacatttgggcaaatgggttggccagacaatggacatcgttatgtctgaatgggtgcacttctcctttccatagatgtcgttggtgacactcttcatgaagtcttctttcacagagtcgatgcagatgtttgtactcgttctatacatgagaccccagaaaaatacgacattaggctcaatcatgctatgatcggcttgttctgagggatctggatcacaatcaacaccaatgctttctaactgcagaacatcagtttggatatgttacaatcagaacttgcagctataaatgtgaagaaacaatgggcaggtgatgaaaaaaaaaccttgagaagaaggttgcgaaatcgtgatttcacccatccaacccaatcacgtaattcttcagccactggagcagaaagaactatacggagaaaatgtttgtatctcacagtatacggaaaaggtgcaaaaagctcagtccaattaatatcaccattcctatcaccctgttcaacagtgcaaacaccaagctagatgttagcagcagaaatttcaacgatgaaagcaaatgtcaccctaaagtccaccaaagtgcagatgactgacaagaacattatcgaggattctagcgttagcaaaagaccatgtaaggcaaaagcaccacttcctagctgtctgcttagttaaaaaacatacccatgaatagatccacctatataattgacataagttaaaaataggtcttcctcagcaaattacataatttgcaacagttgactaatagagggatctcactacccaaagcagatgaagtatacagataaattggaccttaattatttttcagtgaggtgtagagcagtgctacagttacgagcttcaaagttttttggtaagtcttcaaatacttctgtttttttaaaaaaaagataaaaatggcatagcaataataaaaacaaagaaaacaaaatttgtgggtcaatttgtttcatttgaatattcaatgctttttaaaaaagaaacggtaggtgctctgactactgcataaaaggagactggatattaaatgcttaaaatagagttaactgaagattcaagtaacaaattattcaaatataacagttcagcaaaaacaaaagaggaaggactgaccatatactagttgcactaagactagttactcattttctttttctgaacggaaagtgagagagtacaatgggttattagctaaatagtagttgataaagaataagcaattcaacataccttggtcaaagcaaaaccacgctgaagttcttctttgattttgttaaaggtacttcttgttatactagaggcacaaaattctggtggagaacagggcatcactatgggcatgaaagagcagcaatgaggtctccaaggagttggctgatcaagtaaactcactggaagaggccaatgccagtgagaaaatatatcaaagaatgagttgaacaaagagctgagagtagcatgtggatgcatgatacaaacaaatgctgcaagaatcgccaaatggatcccagcaaagaagccaagtagctgaaaataacaccataaaattaagtataacactgtaagaccaaaaaagaagacaaaaccataagctgtcattgataaagaaaacgtaagccacatacatggcaatgaagccctctttttctcgcccatagtttaaggcaccgcaaaagaatttgaaacttctgcattaaacgtcagaaaaaggaagcagttaaaaaaaagaaaaagactattagcaagaaaaatttagagagctcagcagataaaagattcaacatagaataagggaaccgtaatgcattattgttgcattaacaaaaaataaccaggaata

SEQ ID NO: 37859 - DNA, 3070 bp, Oryza sativa
gaactccagatagacatctccagcttggttcattaaccgccgctagcaagcgagggtcaaatgcatgtattgcctgcatcaccaaacaacttgtgagaacttgaattaaccaccacaatattgtgtttaacaatctgtgtgtgacaaaatggttcacagttagccttaattgataatgaacaacacatgtcaaaccagggaggcctaagaatggactagttgattatgtatcgtgttttaactgattttaattgcagaggccaagagcattctaaaacaaatgtagacagtcaaatggcaaactaaagctactgcctgaaaaaatggtgggggaaacctaatccattaataggcatataaaatacattattttcaaaaaatacattccataaaccaattaaatatatacatctatatatacacataaagacagtgaaggcgtcattccttataaatgctctgccatttaaactcatcaaacagagcacaagtaaatgtacaactcagttattgaaatgaagtcatggtgttatggtgaacattgactattacattcaaactaagcctgcaacagcagtggtgggactccagtatcgccgttgaatcaaagccagtgatactggagccccacaataacacatgacctcgaattcatttcatttttttctggggggatctaatccattaataggtacttaacaaggtagcatgcaatgctttcgaaaaatattatgcatgattgaatgcaattctgcaaaaaatgaaaccatatcatggtaaaatattgaaggaagttaaaaaataaagcctgcaaattagctccaggacatcaccagcaggttctatatcttcagtgaaaggtgttgttttaagaaaacttgactgaatcaacaattaatcatgggacaattataacacatatataaggtagtacagaacactaattatgatagcatgtaactatagtcatgtaatcaaaacaatcataagacataaggtacttgcctctgcagcattgataactggcaattggacatatgggaaatcaactaacatcccgttaaatttaaagcgcatcaatggaaccttagcattttcaatagaatgcaggtctgatacttctggcctctcttcaagcatttgtcgcaagacaatgaaaaaatggtgctatacaataacacacatacacactgagttaatttcgaaagctccaagctagtggacaaagggaaaactgaaagagatattcacctgtaacgatgcaatacaagggccaacacagactgcgtctatatcagattcaggtccatatgccttcaaagcagaacattttaggcaacgcttgtcacaataagatatattaaaaatctcaaaggggaattcctagttacgaggcaatgttatagacaagcaaaacaaagttaaaatactactattaacccagtctattttatcaacatgtaataaaagattaaccgagccaagattgtatgcataagtatatttccatccttaaaactctgcacaatgtcaacaatacaaatggatatttagtgagttctctaattccctgatttgcctaccatcagtctttcaagcatggatttaaacatcttacatgttatttacatgtagaatattgtccatgggaacagatgtcaagatttaatctttctatgtattccttaaccatataatcttatgtcaaatcaacaaacaccacattaagttgactatgcacaagcacaactaagaacatatgatctatccattcagaaactttattcgcttacactcactagtcactatggcatattctggctcatcaatccagaataaatcattaagtcaccaagaggcttagaaaaagaacaatgagcaagccaaagaaccaagtttctccttttttttctctctctctctctcaggttctggtcatcttctttagcacacaaaaactagagcagtaaattgtttccactcaaaaaaatgattgaaagattgtttgagctcacaaataaacatgctctgctaaaattaacatggcatacatgtaattccaaatattaaaacaacgagctatgtctagctcgtggcttctcctgtagcagctctaaaatgctcataaccaagagcagtggctgaaaatgactgggcaattgacgaattaatggtaacacttttaggttcaaaatgagcacaacatatgacagataactaaatgcattgcaaaataattatatcactccaacagtatacactataaaatcaatcggacattgcatcaacacaaaaaaaaaatcccagaaattgtgcacaaatcgaacatttcttgtttacccccaaagcatacgacccaaaggtcaacaccgtagctgttgtgttccaatattgttccctctggtcgtacgccaccctcttcgcccaacccatcactatctgcaaaaaccaccatcggatcaaggctctcagaccagtcagcatcgcaaactttaacctttaagctccgaaacccgaacgatcattaccttatcgagctcccgcaccaccacttgcctcttcaactcctcctccggcgagggcaaaacccccgtacgagaaatgaactaaacctcgtaaaaaaaaacaagaagatccccccaaaattagccacgagatcaaacaccataggaccatacgatgaagcgtacgaagcttaaacgcccccggtgctcacgttgaggagggatttgctccggaaagcgtcagtccgctcggcggccgcgggatcgagcccgcagatgatcaggtgctgcgggagccacggcgggggcggcgggaccccccggagatacatcaccgggaccgggggcatcggcgggggcggcggcgggcccatgggtggtggtggcgccacggggaaacccggtcgggccctggacgccatccgggtggccgacgaggccgactgcctgccgccgcggctgctgcgggacattgcccggggccggcgaggccacgccggtccgcgtcgccgcgcgcggtggtgttggccgcggccggggggacgtcgagagaaacccccgcgttt

SEQ ID NO: 37860 - DNA, 24661 bp, Oryza sativa
ctgcaacggtccctcattagcacgtcaagctgctctgttgtcgttgttagggtcttcaccaccatgggccacgcaaaccatcactacatacaaaattttcgttgagaccgtttgttctaagcagtgccaccgaggttgcactttaaccacatgcaccatccaaaccatcatatttgaagcggtagcaaggaggaggacaggaacgggacgttggatttgcagtggtggcaaggaggacgggaacgaacaataggaagggaggcatggtgatggtggtaggggaggaaggagattcggctaacgacaaccttcgtgcaactagagctgttcatgcatgatgcagcagcagtcactgtaatctacctcctcctcgaccattacaactagcgccctcaccaccttctctacttatttttcttagactccggcagtgtccttgccacccgtcttcatttgttttgccggtgtgggtggtggggaataaatgttggattaggttacgctacgttttttatattatttttttgttttatttgattttagtgtattttttaatttacatgtagattgaaatatacaagggctaaaattaaaaaaaaaacttctgaggtggacacttgaagccacttgtattgtgagagatgaactttttcaagtaaggttaaatccaatttacctcccaccccctcaactattataaaagcacaaattatccctcttaactccaataccatacattttatattctcaatttttcaaactagacaaaataccgccttaacctagcgaggaacaatatttttgtcctacttgacatacaagaggcaaccccatcaaaaaaacaaattaaaaaaatggttgaacccacgtgtcaatggtcgcctcatcttgatgcactcttcctctcttcgtcacttctctcccatctgccaaccaccggcgaatttgcctcctctccactgcccacgagcagtagcaaaggcgagctcgagctccaacaccgcatccgcctcctctgcagagatccatctccaccatgtgtgtttctaggagctttagcaccgcagcatctcatcacctcttctctttctccctttttgactggagcggtagggtgcggatcaattagagctagtggcagtgtgggcgaatgtggagctctaggcagggtctagtgaggtggaggatgaagtgacatcgacttcttccccctttatcttatctccctccctcacctcatctcgagcttagatatcgctggctgcctagcacatggataccaagaggagatgcatggttgtggctggctggctcaacaagggcaaaaacaactaacgtggatcgctggtcatggagtgcccggtgagctaggcgttggagctgagaaagggaaaggcacttacaatttagtcccaccattttttaaaaatgttgtttgactggattgctacttcagtgccaaaaccgcttgagaacaggaagggggcgccatgtgtccggattaaatactataggaggtcatttgtacttttgaaatcgtgaatgccctaaaagaaggaataagttcaccggaggtccctcaactcaacagcaagatttttcgaggtcccttaaccacaaaaccagaaatgtctacccctaaactcactcaaaccattcaccggaggtccctcggcagtattttcgcctgattttgctgacgtggcatcctagtcagcaaaaaaaaattaaaaaaacacgtggggctccacatttttttcttctcttttcttcttctctcctcttctccttcaggctgtgggcggaggaggagcagccgcgcgccgtggccgccgtcgtcgtcggctctccaccgtcgttgtcgccgtgagcgaggctacgcggcgcggccgtccggcggcgaagcagaggcagcggagcgcggcggcggagcggagcagccgcgcgccgtggccgccctcgtcgtcgtctctccaccgtcgtcgtcgccgtgggcgaggcctagagttacatgcatatatgcattcattcatgaatatatacatatacactttcaacccgtgcagcctgcaaatcaatcacaagctgcttttgctttggtctttttctctctattgcatgcatgtatccctcacttgagaacccatagctatcatgcatgcgttcacgggcttttggcctttcttctctcgtgcgcggagggacgccattgccgccgacaagctcgcgagtgaagctcggccggctctctctcctctctggcgagaagagcgccaaggccgccctgcccgacgacgacgattacgagccccctgcgccgccgctcccacccggggacggcgacgacgatgaggagcccatcaacctcgtcttcaagggcggagatgaggccagcgggagagggggtggcgctccgcatcggcgaagaggtcgccgccgaccgcctgccgccgctccgcagccacacttgccccccctccccgccgctcgccgaccaggccccccgctccgtcgtaatcgcccgctgccctccgcccaccgctgctccgtctaccgcgctcgtggaggtcaaccaacacgacgacgacaccggcggtgaagagctggagcatgacgagcgccgccgctccgctgccactctcacccgctgccctgcccgccgctcccgccgtcccagccgcctctctccccctctcccgccaccgctggcgcactcgctccacgccgcccgccgccgcgcccacttcctctcccctctctcgcttcttccccgcgcgccgctgtgcccgcaccgccgcctgtcgccacgccctcatctgcccggccgcctcactgaagaaaacgagaaaagaaaatgtgcagctgacatacatgtgggtcccatgtactttttaatttttttttgctgactaggatgccacgtcagcaaaaccgggcaaaaatactgccgagggacctccggtgaacggtttgagggagtttaggggtacacatttctggttttgtggttaagggatcacaaaaaatctcgctgttaagttgagggaccccctggtgaacttattccctaaaagaatgattgggctggtgattgggctcaggcaaggtgattgggctgggctgagaaagtccgggacagaagggaaatgtgccttggaagaaaagaacggtcatggtggcgcggtggcatcgcccacttgttgggggtgttggaatctatcggttcgccacttcgccgtccatctcccccggaaaaatttccccctccccttaaaccctacgaatcatttcctatccatctcctccgccctcctttcttctccggccgcgcgccgcacggcccacctgcagccacccagcaaagccgccgcgcgcgtccttctcgctctagggttttcccacacgacaaccccccaagcatgtcggcgccgccgttgctgaaggctccggccgccgccgccgcctccctcgtcgcggcggccgcggcccaccgcgctacggccgccgccgccgccccgtccggtgcgtcccgcgtcccgccgcgacgcttgcgctgctctgcatcaggcgccgccgccgtcgaggtgagcagagactcttcccgtgcaaactctgaactcccgcttgagtagttgtcgttccttacggggggggggggggggggctgtttggttaggtgcgtgctccgatggattgggcgacgaggtcgctggaggagatgcagcgggcagaggacttcgactctttctgcctgatggggctttcgccgctggatgggcggtacgagcgctttaccagggacctgaaacccttcttcagtgagttcggcctcatcagataccgggtcatcgttgaggtatcatttatttggattcctttgcactcgtatcatttgtagtgtatttcatcatttcctcacataaactaggatgcttgattcatgtgttaaatacagaaactggggcatgatgctagtgttataatcaatgttgcttatctgaagtgacttctggctctgtaggtaaagtggctactgaaactctcccaaatccctgagatcaatgaggtgcctccattcgcaaggaggcccagttattcctggatgcgattatccaggatttcagtgttgctgatgcaaaagaagtgaaaaagattgagaaaacaaccaaccatgatgtgaaggctgttgagtactttctcaagcaaaaatgcagctcaaatccagagattgcaaaggtatgtcagccttctgtgtgaaccaatacctgaacatactattacttcgttgctagctgttgagtgtatctttgtccccaggtgttggagttcttccattttggatgtacttctgaagatatcaacaacttgtcacatgcattagctctaaaagagggggtaaatacagttatgttccctgttatgatggacatatgcaaagcaatgtgctccttggcaacacaaaattcaaccatccctatgctgtcgcgaactcatggacaggtacgagaaccacctctgaagtatactcagtaatatatgcttgtactgtcgtacatatgtacacagagtcactgtaatcgatgctatatgcttagaagttataacgctagcttagatttccactttcctgcttgtagccagcatcgccaacaactctgggaaaagagatggcgaattttgcggccagattgtcaagcataggaaatagtttttctgaggtcaagatactagggaaattcgctggagctgtcggaaattacaacgctgatgttgttgcatatccagaagttgactggcctaaggttgcagaagattttgtcaaatcgttgggcttggagttcaatccttatgttacccaggtggtttatattcattattttgatatccagttgtttcatttgtattcccagttcagtgctttattggagttattattcttgaactatggtggtgtggagaatttcctattaatacactttccatttatctaactgcgctgtaaattctaaagtcatatgatactctttggtctgacgcagttttaacttttttttacagattgagccacatgactatatctcgaagctcttcaatctatttgttcagtttaacaatgtcttgactgatttcgatagagacatgtggacctatatatcactaggctacttcaagcaggtaatactaacatgcaaggactgttctttaaggtttggttgaattcgtttagtacatagtgggaaaaacttagtggtctacagttttagattctgtttgaacttactgcatccttccaaatgttgttccagatagtaaaggctggtgaagttggatcttccacaatgcctcacaaagtcaatcccattgatttcgaaaatagtgacggcaatttgactatagccaatggtacattgtcttctttaagcatgaagctaccaatttctcggatgcaggtataatactgtctgtactcttcaatttccacttttactatctccagttgtgaaaaaggggtagtacatcatccattgttgatgcacatgcaagaacagacgcctaacttgccacaaatggtgttcttaagtttggctttattaggctatagtccatggatttctgtcgaactcgtggcacacgctacactttcttacctctgcacaatttaatgctttcttacctcatttttcaatgcaaccgcaattttggtcaaccaatgtgcatgcaaaaattgtagcttgccactgatgtaaaatacagcaagcagtcagacatgcctaactatttacttaagattgaactaatgagcaaccatgtctctctgtcagcgtgatctcacagactcgactgttttgagaaatttgggtgttggattagggcattcactcttggcttacaaagctacattgcgaggaatcaataaggttcaggtaggtggccacaatcctcctcttgtttgatttggttgtttcttgaattattcttgtatagataattttatcattgtccaagtattgaactagcatattttgtatttgaagtctttctatgcatgctgtgatgctgaatggttgatgcccaagcatgcacatccacccacccacactttatgtttttggactaagtgaactataaagtgatggatgtggctaggtcttaccccaactattatttgtatctactcaatatgcacaggaaggacctcagtcagggtatctgtcgtactagaaacaagatattcctttgtgcactacacataatttcattttcggactattggaattttagacatttagtctgttttgtaattgaccttaactttgttaagtttactagccaaaatgtaactatgacacttcgttgtatttatgctgaattttgcctgttgttaggtgaatgaatcccggttatctgaagacttggatcaaacatgggaggtccttgcagagccaatacagacagtaagaccattctttttgtcctctatatggtttctggttgttttcacaatggtatgcttccatggaggagttgtattggtttgtcctagaaatttgtgcgcctcttcagatgctttcaaattgtcgaaagtgtcttttggatgcttgttttgtgattttgcattgcccttaatgctttgttaggtaggatttttacgtttttagccaggtgtattcatggtgaattttgatactgagaatggttagtttaattgcttttgtttggttcgaaaacgacatattctcctacatcgtacaatattttgaaaatttctcagaacttataagtttgatattgggggtaatttcacctattggcattttcaccagatacatcaactgtattcatcatcatttgtctgtcgtctttcaagctcagatgcatatcatacattattatatcatctttgtaggtgatgcgaaggtatggaatccctgaaccttatgagaagctgaaggaaatgaccagagggcaggctgtcaccaaggacagcatacggcaattcattgaagatctagacttgccagaggcggcacgatcgtcgcttctgaagctaacaccacattcttatatcggagaggcagaatttttggctagaaatatcgaagaggtggttgatctaaaatctggatttaagatcgagtgagcacccgttccggaactcggtaatccccccaaattttttaccaggacaggaagaataacgggcgaaaatcttcaaagctgagggtgaacaccgaattgtgtcctgacctttaacaacttccggttacgctaattcagctgtgctgattgaaaggcttttggatgcacgcaaaatgcatccgtggaatttgtgccatgcgtgtttcggaataaaatcagaagcaggataaatcttgctcgcctgtctttttcaatcgcaagtggccttgctacagtcttcattaatgcagcattcgcctttgcatcgagcaggctacgaaattgagaccgcatatcatattctgctgagttttgattcgtccgaaaaacgtggttacgtttgcaaggcaataacaggcgacagtgacccttcgagtagaggagttttaaccgtagacgctcaaagaaagaaggaagcccgggatgctcgtccttatccgaccctcgctgagaacggattcgtggtgcacggcacggacggaacaccgcgcgcggtaaattcttctcgcgaccggaccaaccaaccaaatggcgttaagctccggctccggcgctgcagcttacaatcctggcacgtgagagacaagagcgaccacgtcacactctcccacctgagaataataagaacccttcgaatcacaggaaaaaaaaataaaaaaaaataggattctaacataatattctcaaccctttaaatcacaggaataaaaaaagagaaataaaaaaataggattctaacataaatgcaagtgtaaaacaaattattgtaacacaaaaatataggaatgaccgtttgatttggatgtaggaaaaaccataagaatttgagaagagataaaaactcaagggattattttcatgaggtcctacctcacgttaaatttccttcaaaactcgtatagaagtggcattccataggaattccatacgatttcatagggttcattacttcgattcaaagggctatgttggaaaattttctataagaataaaatcctctgaattcctataaattttctttgaattaaaggggatatgagtttatctgttctcatgtactactgccctctaacgtgggttattcgtatataaagatcacaaactgtaggacccacgcgtcagccgctcaaaataagatggctgaccgggaccgacgggctccgttgtttttcgtccgcgcagcacgaggtgtcgagcggacgggtcgtttttagttttgtttgtatcattgtgtggacgagagccggggcgactctctactggcgcgctttggtgctgctacacgtggggcaatgggggctaacgtctgtctgctgttcagttgttgagctctcgcttactcaggccttttcattttaatgtcattttcaacattatcaaattttgataaatttattaaaaaagtggatatatttagtttgctgtcaaattgccaaaattttggcaggcaattatgccaaaattactaaaatttaataaggtttttttcatcaaagtaaacatgccctcaatctcattaataaacgttgccattgcgagcagcagatatccacagaagatattaggaggctgtttaaaatacctacttaataaaaaggatttcgttatccagagaagatattaggagtctgtttataaaatactagtaataaaagagaattatgtaatcttgcggggatactcgacacatcaagtgtcgaagctatctcaaatggtaaatttttctacagtatatcgttacttcacgattttaattgtaaaacacaacacaaagtgacttttaggagtaaatactctataaacgtggtaatttgacagtggacatcgcacctattaaaataataatttctggttggagaggagcgaaaaatcacttgaaatattaaaattactcttaaaattaccccctggatccacatgtcagttctttcatctcttttctctctctatcccgtccgttggtgccatgggggtcatcgccgtcgatgggaagcagcgcgtgggcagcagaggaaggcgacgcttcgtccgacgagtttagctaaaaccgacgatttcctatagtaaaatttgtcatcttaaattgtggcggttcgctcattagcttcagaaagacaccatttcattcgaacactctacggtaacagtcgaaataaatttcaaagcgtagataatcttttatgagcatatacagttatacacacgttgatgccgccaaattgcctgttgaagccaggccgtgttatgcgacgtccgaaagcatcacagctctctgaacaaaagggccgtgttagtaggaatgaagccggattttggtcagtcatcggatcatggttttaacctgtaaatggtcctgactgcaacagtggcgcttcacgaggtcctaggacagaacgacaacaccgaaacgtgacatgcaatcagcgactcatcagtgcactgtctacaacagctactgcctactggtattaactacaccttcagttccaaacttccaataccctagtactacgtgtgtactataaatctgaacaattcaatcatatcctataatattccttcaatcttaaataacaaatatataattggatgtgacatgttatgatactattaatctaaaaatatgtgttacttccggtaggttagttttcttaagtgacggagtgagtaagtgcacttatatgagacaagggagtaaaaaaagaattttatatattcctcagttaataatatttgtcatatcagactattgttaaactttaaaaactttgactataaataacatctaaaatatttataaaatatgatgattaaaaattacttccataaaatcataatacagttattgatattttaatacagttattaatatttttatatattataataaaaaatatagtggtcgaagttattttgttatatttttatgacgagtataatcaggtaggaaatagtagtttcatggactcgccacgattaagaaaatcataagatatttcgagggttggactcacccccgttccgaccgcgcacccgcaccaactagtccaaccgaatctcactcaatccctctccccaaacatttcatcacccaaaactatcaatggtgcttgctgttcttctgcctcactgctctgcacatacatcagacaagcaaaatccagtaacaaatctacgcactaagcaccagtacaatacaattagcggcatctaaattaatttgccatgaagcatgaacacagtgaataaccgacaacaaaatggagaatcatctgaaaaaaaaaatcaatcaaaaacagttgggagattcagagcagagctaggaagcgatcatatacaattatgcatacgtacgtacgtacgcgcgccctatatggtgggggagtggcaccgatcatagcgtgcagccgcagaagaggaagaagcagcacaccatggagaagagcgcgacggactcgatggcggtgacgaggccccagagcacggcgtccacgacgggggaaaagtcctgcacgagctccggccaccgccgcaccgccgagccgagccgctccggccaccagtgctgccagtgccacccgcggagggccggcgcgcccgcgtagtggccggccgccgacgacggcagcagcgccgccaggctcggcacgccgaggtccggcggccaccgcagcatggacaccaggctgccccccatatcgtcgatcgagcggccgctaattaacctgctcttcccggcgaggccgcgacggccggtcgccgccgagtgtttctcccgctgtgtgggcttatgctttgacgggttggggcctggggggatgccggtgtaacgtgttacttactgctgctttgctattagctagtagtcgcgtgtggaatgtagttgtacccgcgcgtctcttctcgtgctctcgtggtgcatagcaccggtgtccggtgtcacgatgtggcggagacgcggggtcatgggcggtttgggtcttttcttttttttctcggcaaagtgctgggactgggagttgtagccctgtaggtcgtcatgcgactatgcttcgcactcaggcatatgccgcacatggcggtgagtgggtttaacggacgggcgttcgcgcgtctagatcatgcacgcgcgtgagagtgtgagatacttgaaatgattctggcttagcctatggatccatccgtagctttcgattatgcaacatctaacaggtaggggtgaaaacggtacggaaactttccggattcgaacctatttttcgaaaacggaatatgtcggtcggaattttttcggaaacggaaataaattcggaaatattttctcggaaacggaatcggaaatgataagggcagtttctgtcggaactcggaatcggtcggaaattttctcggaattaccagaaattttgtgaaagaaataccctggattctttttttaagcactgaatagtgaataccatggtgtttggctattttttttaaaaaaatatttgttatgcaaactaaaattacataagaatatttttttgtcctacatggggatttatcaacaacattactcttttaaacatacataatttattcaattggatttatcagtttgagggagtttttattccgataaattttcgttaccgtattcgcgccggtttgttttcgctccgttttcagtttcgataatattcgattccattttcgtatccggggtttccgattccgattccgaataaaatatgaaaacgaaaacgataaagatggtttccgtccgtttctgtaccgttttcacccctactaacaggtatgtctaagtagggttcacaactctgacgaaaaccagtcgaattctgcgaaatttaaaggtttcgacaaggctcgaaaataaaagccgtttgagatttcgataagtttcatccaaattcaaatttgaattgataaaaaagaaaaaaaaataaaaaaactaataaatagtatgatattcatagaacctattgggatataaatttttgaaaaaaattaatgtatttcgtgtatttactgaaatttacaataggaaagaaaagaataatgaattaaaaaaggaaaacaatttcagtttacctctttttctagttaccgattgaaattttgatgatttcgctcagaattttgtcaaagccgaccggtttttgtgagcttatcggtaaaatcagggaatttatatttaaattttggtttatgaaatttgttcggaatttatcggctctccaccagatttcgcgaaaaccgtcattccactagagcctaaaacggaaagccatctcggaatcgtaaaccctgggtctaacacgtgaatgttcacgcgtttggtctgttgaacactcgttttccttatttgcatccacatgattttttttatcaagtttatacacatctcaattattcatatgaactttgttgtcgaattacaactgctcatgtcgaaggacgtggttcacacagtggaaaagtaaagcatatgtgttggaggcttgccatggaaggccttcggccgaacctgccgaaaccgaaaagttcaagtatcaggctcacaccaaaggacaagagcgaagccatatgggcgaaagccgtgattgtgggtaacaccaccttcgtcaagtggagttctcgacagaaggcggaacgagcgaagatgatgtggcgaaagcctcggcacacgggcacaggtttcgccatagcaccaaaacccgttaacgggagacttggcgggccgctatgccctcgggggatttcgcaagatagataggccgagctgtttaggcccagtaggggcccgtgtgtgtgtaaaggacacaatgtgcccttcataatgtccctatcataagggtaaccatgtaaattcccctgtataacctaaaccctagtagtgggaatctgtaatggggctataaatagccccctagggccatgtaatagggggatcccgagaaaaattcttaatttaatacactttactgttttccaaccactgttgagtaaccacgtctttcgacgtatgcggttgtcgtttcgacaacaatatgtattaatgatgaaaattattgggatcctccatttcatgcccctagggggttatttatagtcttagtagaagctcatgcatcctagtcctagagttaatgtgtacatgaacatttatgagggtaactagtgtctaatatctattttgccttgggccccttaatgggcttcactatgggccctcaagtggcgaaaggccattttaagccttataacttctttggttcagtggcgaagacgttcgaggcgaaaaccttagtcttctcagctggcgtttcacccaagcccatctggtttcggcagcctcggtcgaaggccctcgtgacatgctttcaacaactttatatgtagaaactttatacatgtatttttggggggcaattgtaaatttgccactaatttaaatcgttatcataatacgaccactacgaaattgcaaaaatatcactataactttcatttaagtagcatccttgtaaaattaaaaaaaaatagtggcagatttgtaaatgccctaatttttatgtataaagctttatctataaatcagacatcatgcacatgaaaattgaagtaggagggtgtccacgcgggcgtacacgcacaagcccttcaaaagatacgtttccgtggatccgttgatgaatgtcgtttgtgtagctaataacgggtaggtttaacgcgtggatgttcgtgcgcctaacccctacgaagcactcgttttccatttttgcatttgcgtggtttctttttcatttttaagtttatgaacccaaactcaatgtatatactgtaaactttacaagccgaaactttatacatataaacctacaagtagaaactttatgaaactattatatgtaaaatcacttgattcgaattagaaccagatataaagttttagtatataaaattggggaaagtccattttacaccctcgaacttttaacttgtctaaaatatacccctgaactacgaaaccgggtataatacaccctctgaactgtcaatatttgatatttgacccccttgggctgtttatgatggtttttgcacacgtggatgatacgttggatgccacatcaacccttcgccacgtcagcgcatatgattatatggggcaagcccatattgcttggttgttttgaccttaattttcaggagcggcggcggtagaggcactgcgaaggcagggttgagcggtcagtgccgcgtatctccgacaagcagctgcggtcgtcggcggagaaggtgtcgcaggaaagtagcatatccaagccgctgcgcgcggtcatcggcggaagccgcgcacgacccgcatatatggctaagcagggagcagggaagaagctgctccgacacaagcacgatatagacctcgacctgtctcttgtgacctgtgtgtatgcttctcctgtctgaaaaaaatttgaaaatatactgttcataaatatttttttcataaatataccagatgttggtcgacttacacaaatatactattgaaatcgcgggaggaaagcgcgataccgaggttcgcaagaggattgagagataccgacacggtatcacaatatcaataagcgaaagcgtgacgtcagctccggtatcgcttattgggtaagcgataccgatgcagtatcgcttttcccttgagcgagagcaccacgtagagatgacctaatccggtcttgcgatttgggagagagagcaggaatggacccaacggtctcgctgattgccctcgcgagaccgggatcggtatcgctttttcaatgcgcgagaggagtagcgttgtggggcccgtggtgtggcattactggcgcgcgagagatgtgcgtgagacccatggtctcgcatgcctgaagcgcgagagcggcctcggcaccgcgctttcgtagcacgagagccactgtggagtgggtcccatggtgattttctggttggtgcttagtccggcacggtttcgcacattagcaatgcaacaacgcgcgtggagccagcgatctcgatcgcttgttagaattgcgagaccggtaaattttatattttgaacaagacaacggcctcttccgtgaagcaaagctacatggtccttagggcaaacaacaaatataaaatatgaaattaataaatataaaatattaataatgtatagtatattattattaagtaggataataataacagaggtagtttctgttatatgggttagagtcggttcgggtttaaaaattagatagacataattaatttatatggtaaaaaaaattaaattaaagttacaattaatttgtactaattgtaagttacaattaatttgtagctcatgtgattttttattttatatagatggccaatgttgtgtctaacaaatgaaaagtttaaataatggtagttatatttctagtacatatacagaaggtttctcatatatatttactaacgagccttaaaacaaatgttattatcacatgttgttaattcatgcaaatataaaattgtaattaacttaataatcagtacattactgattccgtctggctaatttggaaagcgaagcgcggtctcgcaaatcagacaagcgacagcgctgtcacatcgctcgtgttcggcgcaggggcgagcctgtgctgtgcactatcgcattcccattccgcgagaccgccgcgtggcgctatcgcattcccaccgcgcgagactgcgcggcgctttcgcattaccttcgtgcgagaacgcgcgtcccgtcgttgctttcataggcccgcggcacccgctcgctctcgcacttcccaggcgcgagaccgccgccgctctcacgtttcggcgccgcgaaactggtagcaacgctggccccatcgcactcgctaacgcatactgcgagagtgctgacgctctcgttactccaagccgcgagaccgccggcacttcgtcctcgcttatctaaacagcgataccgctctcgttctcgcacatcccccgtgcgacgccgcgttctcgctaaaccaaaccgcgacagtggtatatttttataaaggaaaagtctatacgtactaaatttttcttacaaaatgtttacaaactctgatttgtcaagctatgagtaaatctagatttcttacaactttcatctagttaaatcaaacggttgagaaatttattagtaaaagttttgtaagaaaattttagtacgtgtaacagtactcttttgtaaatcgtcttatattcagcattttcatgcaaattccacggaaaaaaacgtatatttttaaattatttcctctcctgtctatcacaactactcatactactattagggtgtgtttaaggagagggggattgaggagattgggaagatacgcaaaacgaggtgagtcattagctcatgattaattgagtattaaatattttaaattttaaaaatggattaatatgattttttaaagcaactttcctatagaaattttttttaaaaacgcaccgtttagtagtttaggaagcgtgcgtgccgaaaacggggtgctttctccctcaatgtactccaaacaaacgctgccttactaatctcggcaagctagtactttgtgctgctagctgcccatctttgcagtcattagcatgtcaatcccaaggctaaagctcttcggcctccacgcctctgagcaggagacgacggattagcacaagcacgagcaggagcaggggtagtactcgactgagccagagaacggaccggtctgcggcaacagaacggagctcgcagaggaggagctaggcggccaacgatgacagagctagctcgtagacgccggtcgcaccgaccacagtctgatggaggcgagcccgctgctcattgagtaaagcttgagcttgcttccgccaagctcagcggatgggtgcgccaaactcgcggtggtcatggcgctcgagctcatccccgcgcatgtatcttcggcgagctccacctctccactcggagctacttcgtccctgcgcctctgccttcgctggagaacgccgcccccattgccgcctccaccaccaccgccgtaggtgctggagctcgatttggttgcggctgtcatcctctgtggcggtggaatgggcattagaggacggtgtttgcaggcggcgaatctgcagctctgtaccgtcgcagcgagtttgtcgatgggtgtgtggcggtcctcgctaggcagagggataagccatgcgcgcatgccgaaggggagagagagtatggggaggagggagaaggagaaccggactgacatgtggggctagctaatctatacaggtggcatcctagtgcacaaaaacagtgtagaaaaccacaccaggtggtcttttgcacggtattaaaagttgtagggggtcagatgtccggttttaaaattgtgaggtgtgttttagacaaactaaagacttagagggtgtaaaatagacttatctctactattataaaagtttaagatgtttttgccgtagtttttcatcagtcattgtgtgttcagattggatcaggattaagtcattgtgtgttggagctcgatttggttgcggctgttatcctccacggtggtggaatgggcattggaggacggtgtttgcaggcggcgaatttgcagctccgcaagggatgagataggaccgtcgcagcgagcttgtcgatgggtgtgcggcggtcctcgctaggcagagggataatccatgcgcgcatgccgaaggggggagagagtggggaggagaaagaaggagaaccggactgacatgtggggctagctaatctatacaggtggcatcctagtgcacaaaaacagtgtagaaaaccacaccaggtggttttttgcacggtattaaaagttgtaggggtcagatgtccggttttaaagttgtgaggtgtgttttagacaaactaaagacttagagggtgtaaaatggacttatctctactattataaaagtttaagatgtttttgccgtagtttttcgtcagtcattgtgtgtccagattggatcaggattcaggagtttggtgtttcgtaggttcggccggtcgataggcattgaaagagcatctatgcccttagtgggttttggtaaattgatgacaagcgattaagggactaatgcgcttattgagtgtataagcaaatgattagtccgatgaagaagctaggaaatgtacttatagatggatgagaattaaagagaagatattgaagatgcgggtatgaagtgactacctatggcaagacggtgaagcgcaagtgacgctcagctgcgatggaccatgcggtggtgaagggcaagcaaggggcttggggccgatgaaccgaaaccggtggtgaagggcgagtgaagactgtgtcgtgatgaaccgtgcgaggccatttgaagccatggattatccgcatcaatcatttgagaaatagaagatgaaatgtcaaagatcaagaagatgagatcttcccgatgatcaaatggccttgacgttggtaaccctccaagtgaagaaacaatatgatgtgaaggtactcctattggtttaactttgctttttaaatttgagtttaggaagccgtactattaagagcgttgagctttgtgctaagtgctttggatttttgagctctctccctctctatctcaaatctcccttgttctttgtgacttggatctttgtgtgtgaatttggagtttgggagcctagtatgtgtttctcttaatcttgagcactaggatttgtccaagagttgtgtggtgtttattactcttggaggttgagaactcctagacggctaggtgtcgttcttgggccaccgatctacgtgtggttggccaagagaagtttgtgaaggccggatctcacctccgcaaggaaagagatacccttagtggaaggaggagtgcatttgtgcaacctcacgaggatagggttgaaaaagacccggctctttgcgagcccctcaacggagactagaatcccctcaaggatttgaactccgggaaatacatcggagcataaacctcggtgatatcctcactttctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagtttagactatctgatcacataggactatccgacctgatatcagacaatccgaccctgttttgttttagcttccgcatttatttttaaaaccgcctacttgcaatcttgtttttgctaaaagtgagattttacctcaaatctaaatctattgagtttttgaaaaagttgcctatttaaaacttttagggttggtcatttcaaacatatctttagttcaaagcttttgtaaaagaccaaccattctaatgttgcagccttacaaagttcatcaaaaatcttgatttgaccatatttggccaaaacttgcatatggtgggttgaacaatttgagccaaaattctttgtgaataatggcatgaattagtatctctaacccatctaaggctttccaaatgtcaaacttcataaaaatcttatttggatgtgatttgacactttggttgagatttattgacttgaatggcctacaaaactctctttgacatttctcttgaaagaaaaatcttttttgagaaattctttttggaaaattttctattaagtgaaaagatcatttctgcaaggtttcgatttaaattggaaagaatttgactttttctcaccttgctcaagttgctgaaattttcagaaaattcatggtttttgactgatttgtgatttttacatctcaaaataggttgcaaactggaatgagtttatataatgacttttgttcctctatggttggacttcacatctaaatttacttggatttttctatagtcatttgaatatttttatgatgccctttccaagctctttttgagttccaaattctgaaaatcctgaaactttcagttttctaaatttttgtgtttttttgtggcttctaattgtttgagaattgggtaaaactcccaaaatgaaaaatatgcaatgttctatgacctatctacaagatttattgcagattttatagtggaaccaaaggcttcggtaagaccgctcggtttgcaatcaagctcatctatcaccatgcattcgagcccggaggctctgggtacataccccggagactccgggaagatgtgcctttctccaaaatataggctacactccccatttgtttttcattaaacacatgcatttctacaagtaattcaaatactttgaagcacacatttagggggagtatatcctatgttttgtgtttttgagactaacttgttatcaagtgtatttttgtgattagtctcataggagatcaaaaacatcttcgaagatagtttggaaggtgagaccacaataagtccatgatgaccaaggtggactacttgatcaacctcaatcaactcaagtcaacctaccgcaattgtctatgaagaacatgaagacatgtttccggcacaaatggatgggattgataccaagggcaactcaagagcaaagttacaccatacaagctcaagtcccatcggtgtaccatccaagaattcaccacatcattcaacgagatcatctccacaatatcctcgatgatatacaaaaagggagtagctattcattctcaatctgcaaatttgtgaatgttactctctcttgttgtatttggactattagaaggaagatggtgcaaatgctaaaccggatcgggtcatggccttacaagaagagcacaagcactatcaggacgtagactgtgatcaaggagttaaacatgttcatgatggaaaagcttaagttctttctcgggattggaatcaagcaaatcaaggaagagatttcatcaagcccatcaaggtgccaaattcaaattgggttcaagatatcaattttattgaatgggcatctcaaaaatcgacaaggaaggtaacttgatgatccatagcttgttatttaaattggtatgattggatcacttgccttgtctgggcatctaggccaagtttcatttcttgctaattagcctaatttgcaaaatgttgtgacgacatgcttgtttagtcattaagcgagtattaatcacaaagttgttctaagtgaatcaatgtttatgtgaatttttggtcttagcacaaactatgagattcatacatgcgaaactcatttgtgaaatgttttgtgaaaatcttaggtgagattctttttcatctatgctttaaaccctttgcatgtgagctttctatgcgcaaaatttgtatctcaatgcttattgattttcttgtgatctttatgtgaaattgcttcatttcctaatcacaagtgatgaaatataaaattgagaggtaagtactcgatgatccctcatcaaggatccctttgcttttctttccctacttatgccctttttggtgttagatgtcaaagggggagaagtatactaaaggggataaagaaaatattgatcaaagggtgagatatttgtgagaaattatcaaaatgaatgctttaaagatgccaaagagtaaatgagaaagggggagagaatatttgaaagtgtttatcaattggtgtgaatgcttattatttgatcaccatgccacatgcaattaagattatcttttgatacttgaaattgtctacaaaacttgattactcatgctttctcaatcggtaccggaatcaattggcatagaatcaagtttttgcaattggcatcaataatttcatttgatacattttgaattggtgccaagaatttgagttgtgtgtgttgttttaattttggtatctccttcacacacaatacaccccacggatgcaaagagttagggggagctctcacattttcaaaaatatgtgcatgtgtgttcacttcataaacttgtatgcacacatttaggggagctcaaactaacctttggattcaaaatcatttattatcaatcttttgtaagctttaatcgtgttgtcattaatcaccaaaaagggggagattgaaagagcatctatgcccttagtgggttttggttaattgatgacaagcgattaagggactaatgcgcttattgagtgtataagcaaatgattagtccgatgaagaagctaggaaatggacttatagatggatgagaattaaagagaaaatattgaagatgcgggtatgaagtgactacctatggcaagacggtgaagcgcaagtgacgctcagctgcgatggaccatgcggtggtgaagggcaagcaaggggcttggggccgacgaaccgaaaccggtggtgaagggtgagtgaagactgtgtcgtgatgaaccgtgcgaggccatttgaagccatggattatccgcatcaatcatttgagaaatgaaagatgaaatgtcaaagatcaagaagatgagatcttcccgataatcaattgaccttgacgttggtaaccctccaagtgaagaaacaatatggtgtgaaggtactcctattggtttaactttgctttttaaatttgagtttaggatgccgtactattaagagggataccacatgcatataattggttgaacactagtgctcaaaatgcttcatctttgtgtgagttgaaaaactaagccaaaatttcaattccgagttgtttcacttatcacaacacttacaccgggtttctttgcaagtttttcataatctcttaaaggttttggaccatgttttatgttgggtttgatagcccatgaaactagctttccatagagtccaagatcttcgaaatcggagttcggagtaaaaagttattgcatttttacttgagcaacatcagactatccgatttttcacagaacttcactctctgtctttgtttgaaaaatcctttcgagtgagtttttctaagtgtcggagtatccgatgttggatcagatagtccgatgatacagagactccgaaatttcatagaacttgagtctctgtttgaggacgaagtttttgcttctaaaatatcacatactccgatttaacatcagatagtccgatgtctcggaaagtccgaaatttcatggaacttcattctctatttctcgttgccttggaggtttaaaatatcggactatccgatctcgtatcggactatccgacgtgggctgaaagattcccctccaacggtcacattttggggatctatataaaccccccaccaacccttttctagggctgcccaaactgattacattcctatcttgctttgggttgagctttgtgctaagtgctttggatttttgagctctctccctctctatctcaaatcccccttgttctttatgacttggatctttgtgtgtgaatttggagtttgggagcctagtgtgtgtttctcttaatcttgagcactaggatttgtccaagagttgtgtggtgtttattactcttggaggttgaggactcctagacggctaggtgtcgttcttgggccaccgatctacgtgtggttggccaagagaagtttgtgaaggccggatcttgcctccgcaaggaaagagatacccttagtggaaggaggagtgcatttgtgcaacctcacgaggatagggttgaaaaagatccggctctttgcgagcccctcaacggagactagaatcccctcaaggatttgaactccgggaaatacatcggcggataaacctcggtgatatcctcactctctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagttcagactatctgatcacataggactatccgacctgatatcagacaatccgaccctattttgttttagcttccgcatttatttttaaaaccgactattcacccccccctctaggcgacatcaaggtcctttcaggcgtgcacgttgatccgtcagcttcgcctcgtcctttcctgtctgtcccgtcccatgcttttccgactcgatctcgtcgtctcctctttctcaattcgaactgatctctagcgtctcactgcctccacgtaacaacgcccaaatcagggttgtttcattaatcgcacggtctcttttcatgtttggccaaggaggacgaggccggggaactgttttaaacactcgggtggacgtttacccttttcttgcatgtcatctaaatagttatgaaaactttaaaaaaaatacaagataggttaatatgtaatatatcacttcacaaacatgcaagttcaaattcgacttctac

SEQ ID NO: 37861 - DNA, 3787 bp, Oryza sativa
cgccgttgatgtagaaggagcaagtattaagatctcataagatacgcacatggagagcaataacatcattttaggtgaaggacggatgcaagtccttagtcgatatgagatcgcaatatccccaaagaccaccttcatttggagtttgtgtagaaggtgcctttgataaggagtggttcatcttcatctctccattctattctctactttatcatttaatcatgtgatgccttaggaccagtgcttaaaaccttattaaacttactttaacatacatttcgacttgtactcatatccatatcatatacaaatgttaatgaatatgttctgatttgtatttgatcccatatattatgactctcgactaggggtgaaaatggggcgggtatttcccgattgcccgcccgacccaaggctcgtaggagtaatatgggagaaaaaaatgggatacccgatactatccgagttcgaatccgaattcgttagaaatatgggttaggatacgggaagacatgtatccgcccgcatgtcccatattataaaatatgtatgaaaaatctattataaatccacctacaaacatgataaaagattggttaatcactattttacgagctcacatgtaatattgtataatttttttcttgatatatctcttttaatactttaattatcttattatatttaatatatatgaattagagatacaatatatatccatttccgaatctgattcgaatgaaataatatgggataggacacaggatgagcgatatcttattcggcactagccatacctgcctccgaatttaaagaaaaatataggttaggatataggaatgccaatccgaccgtatccgcccgttttcacccgactacctatcagtgactcgcacccgatcaaaaaaagcatatgaaataaaaaaaacaccagtaacaaaaagaaaaagtgttgacgacacgagacaacatgcgtataactgaagtagctaaaactatacaattcaactaggaattgaacacatgagacaatttataatttgacgaggctatgcaatataattttctcttgtgcaatttgcactgttaatcgcaccaatactttccaagcaaggaaaaaacaaagagaaaaggaaccaacaccaacttgaccactttgaaacgagactcgcatggccatgagcacagaagcatgttttcgtggcatgtcagatagctttgaagataaattgtatagatgtagtgacgtttatctaaagtatggaaccacataaccccatactcaaactggagggattaaaacagcgacatgtgtatgtaattgattatgataaatcagccaaaattttagcaaaaattagagaaacatgcgtttgccgggagtcgaacccgggtctattgcttggaaggcaattatcctaaccgttggactacaaacgcaattttgattatttatattctccaaaaatctaaagtttggaaacgtacaaaatgttgatatgaatatcatagatatactggtcaagaagttttccttttcacatgacatgtaatacaattgaaattttccagtgggacatgaatgtattttgtaggacttctgtgtgtttgtagatcttctagtgtcaaatatttgcattccgatggtgcccttaaagtttttcattctgccaagagtgtaaagtacatatagggtgtgtttggcaaatagaatataggagatgggattgggaaagggaaatggatgagtggctaggattaaatgatgtgtgaagaatgaatggctaggatgcaatattgccctttggagtgtgggtcccaatcccatttgctaaacaaaaccatataaatgtaacagcaaagaaagagaccaagccatcttgcgaaactcctaaattggtgcctttttccatcccatttcaccttcgaaaccatttaattttgcaattatattttcatgtatacattatagagaatgtgaagtaaaaaggaattgaagccttcagaggaatcaaaccgtggctatttagttaggagaactcttgtctcccttttttatttccctacatagagctgctgctgttgttgttatgagtaaaatctatcaccggtccctaaacttgtagcgttgggtcatcccggtccctaaactcgcaaatcgaccgttcaggtcctcaaacttgtttgactgtgtcatcccaatccctaaacttgcagatcactcgtttaggtcctccaacttgttcagttgtgtcaccccggtccctaaacaggatggtctaaaaactttatatcaaaaaataattcataacttttttatgtgaactctaatgaagacaaacttgatatcaaaattgtagccctcgatgcgacctacaactttgtagttgaaaagtttttgaattaaaactgtttagggtcccaaaatattgttgcatgtttatagattttgaaattttaattttaaaattacattttgggacaaaaaattacttaaaataaaaaaaaattcaacaacaaagttgtagatcgcgtcttgggctacaagtttgatataaagtttgtctttattagagttcacatgaaaaagttatgaattatttttaaatataaagtatttagatcgtcctatttgacccagatgatattcaaattcaagtttagggaccggggtgacacaactgaacaagttggaggacctaaacgagtaatctgcaagtttagggatcgagatgatacaatcgaacaagtttgagaatctaaacgatcgatttgcgagtttaggtaccgagatgacacagcagtataagtttagggacaggtgacggactttactctattattattattattattattattattattattattattattattatttcttacaagttacaatcgaaccgtaattgtaaagaaaaatatcattttaaaaatcttaaaaattcaatagaaaaaaataaataaaaaaacctagatatatattattgccttaatgtctatttagcaacagtttaactcttgattcttgttccttagagttagaattgaagatagagctaaactaaactttactatctttttcaatcttatatgagtgaaatagatggatttgctaaaaaaatattaaaaaatcgagctaactttttataagggcatccacattgttgctttttagccggtaataagcaatacatgctctcttcctacccggtaggaagcattgtgagagtggcaaagagttaaaacctggtcatacagctactaccgatgaacaagagataaacaatattatttgtacagtgtttctgacagaactcgtgggaaggagtcatgcagcagtcacgggaattttactatcggtgatttttttttagctgggcccatcttattcctctccaacgcgcataaacaatgtgaagggtgcgatggtttaataccgtctgacctcttagcccacagtattgccgaagtcggcagctaacattgtgcttgccttaaccccaactatatacgagtttataccggactccacgtaaagagccaggtagaaatgtagaatatgactacaacacgtatactgagtaaaaggaaatacgccttctgaaccggttaacggaaaagaagcccgttcgcggttcgccccttccaaaccgacttccaatcgcgcaattcccaaatataaatctggcgaccccaacagagccgagctagggtttcgcctcccccgccccgcctcctcctcctccgcaccgcgcgaaccgacccgacccccacttcgccg

SEQ ID NO: 37862 - DNA, 10279 bp, Oryza sativa
ggttgctatatgggtgccttattgatgatttgttcttggggattaattcgttttctgttgatcagattccccaattcgtgctcgaggctgaaggcttgagcaaccgctcaatggttgcttgcacccagccgcggagggtggcagctatgtcagtttcccggcgtgttgcggaggagatggatgttactatcggggaggaagttggttacagcatccgttttgaggattgcagcagtcacaaaacagttctcaagtaagccttagtttgtttatgtttaatggaagaacatgattagttgcacatcctttggcagattgatatggtgcggatgtttctttcttttttaggtattctgatctaatcatgttgtgttgaacactattgcttcctatcagatatttgacagatggtatgcttctgagagaagctatggcagacccacttttagagaggtacaaggtgattgttcttgatgaggcccatgagcggacattagcaacagatgttctgtttgggcttctgaaggaggttctaaagaacagacctgatttgaagcttgttgttatgagtgctacccttgaggctgagaaatttcagacctatttcagtggtgcaccgttgatgaaggtgcctgggagacttcatccggttgagatcttctatacacaagaaccagaaagggactacctggaagctgctatcaggacagttgttcagatacatatgtgtgaacctgctggagatatccttgttttccttactggagaggaggagattgaggatgcctgtcggaagataaataaggaaattaataacatgggggatcaggttggcccagttaaagttgtgcctttgtattctacgctgcctccagcaatgcagcagaagatttttgaacctgctccagccccatcaagagagggaggcccagctggaaggaaaattgttgtgtccacaaatattgctgagacatccctaaccatagatggtatagtgtatgtgatagacccagggttttccaaacagaaggtttacaatccaaggataagggtggagtcccttctggtgtcgccaatttcaaaggcaagtgcacatcagagagctggtcgtgctggaagaacgcaacctgggaagtgtttcaggttatatacagagaagagttttaacgatgatttacagccacagacatacccagaaattcttaggtcaaatctggcgaatacggttcttaccttgaagaagcttggaattgatgatttagtgcattttgactttatggatcctcctgcaccagaaactttgatgagggccttggaagttttgaactacttaggggcacttgatgatgatggaaacctcacgcctttaggtgaaacaatgagtgaatttcctctagatccccagatgtcaaagatgcttgtcatcagtccaaaatacaactgttcaaatgagatcctttcaatatctgccatgctgtcaggtatgtcaaacaaaacttcatgtcgccatatggtttgtcagctaaattatatagtgcgtaataataacacccgcacaattttgcttgcatcaattgcacattgtagaaagcttacaagcttcttatcatgagagtttgcatccactttagtgcatttgctcttccaatatgctttattaattctttcagagctgtaatcagcaactgtcgtgcacctagcttcttgagctattgatcaaaatgatcatacagtttaggctgatgcagatagttgctgtttgttgagttattctgacaaagcaaatggtatcgtctcgcctctttgcatctgctgaccaccatggacttcgtctgttattgccgtattctttctctagtacccaattgctttctccggcctagggaggcacagaaggctgctgatgaagcgaaggctcgatttggccacattgacggggaccacctgacacttctgaatgtataccatgcatacaagcagaacagtaagttcatgaccattttcgttcaatctacactgatatccatttcattgcctaacagttgtcttttcgacaatgcagatgaagatccccagtggtgttatgagaacttcatcaatgccagagctctaaagtcagctgataatgtcagacaacagcttgttcgcatcatgaccagatttaacctcaagatgtgcagcacagacttcaatagtcgggagtactacgtcaatatcaggaaagccatgcttgcagggtacttcatgcaggttgctcacctggagcgaacaggacattacctgaccgtcaaagataaccaggttggtattaattttctgatgcccagtctctttgtgtacaggatgatgaaattgcagatttcttactctttgttgtgctcaggttgtccatcttcacccctcgaactgtctagaccataagccggagtgggtcatctacaatgagtatgttttgaccaccagaaatttcatccgcacggtcatggatatccgtggtgattggttagtcattatctggcagacagctagtccttttatgagtattgaagatttgaaagaatttctgacatgtttgtccttcatgtgcaggctgattgatgtggctccacactattatgatcttagtaatttcccctcgtgcgaggcaaagcgcgtccttgagaggctgtacaacaagcgggagagggaaagagctgctaataggaactgaagttgatggcgttttccccttgcgctagccttccactcgagaagattcgggtatatcagcttgtcgtgccggcgccaacaatggatgcttcctcatcctatcgtatgatttggcttgatggatgctcgtcactacgtatgacatgccaaatgctgctctctagccgtacaatctaccagcaatggcctaggatcatatttttgtttcttttagaagttgtagcctgtgacgcaggatattatgtaccggtctcccatattttgatggttctggcacccttttatttcggcatatttgtttcgtgtttggttagtcttaaaagtgaaatgtgcatcattgctaccttagcccgactttctttcgatagtgtcaaatcaaaggaaattttactttaggtcgcattttattaccgatgtttcattttgaatcacctttaaactaatatttttacttgattgggttttcactttggaccaggtaattttatctttgttacactttgcagccaactacaacccggaacacagatttcaaaacgctgagtgtatgatagatacatatttcaaaacgctgagtgtatgatagatgagatcatgtattaatgatgtaggagatatattagttatagatgatttggagttgatagttgactgtaccattcaatttgctctaaagagaatcaagatatgctgcttgttgctttattaccacattagagaagcggaacagcgcaagatgaaaatgtgttttcagaagtaaaatcatgttaataaaaaaacaaaaatgttaatagtagaaatcgtagaaataatagcttgtcagcatgcgaatattcatgagctttattaccacattagagaagcggaaccgcgcaagatgaaaatgttttttcagaagtaaaatcatgttaataaaaaaaatgttaatagtagaaatcgtagaaataatagcttgtcagcatgcgaatattcatgaggaaggaggaaggattgaatagttttcaggctcccctctgtcttaaatttcccaatagaagtatagtttggacgtttggtacgagacgaaatatttggttatcatgtgtacatgattcaatacaaaataacaactcaaaacgcaggcgaacaaaatatttacccagcttgcaccaagctaacaacgttatttcgagaagggtcaaaagaataatattcttacatgtttccactatcctatttcaaatctcaatctcaacgggccaagaggccaagagagagaagtttctatagccaacgagctcgcttacatatgcatttcaattttcaacggctatacaggcatatatctacttcattatattcccatttggggtttaatgctacatgttacactctccctgatcattttttgttctgcatcccgactccttttcaccatgtaacactcataaaaaacgaagctcagggtgaaacaatggaagtctccaagccgtgaaggtaatcaaatcagctttgcagatgccacataaggccaactataggacttgctagtatcctgcaacgccaactataagaaatgataaagaatatagcgccactgaaattgcaattcccgccacaaaattgtacgagaggcgcttgttgtcacgactaggcacaaatgcgatcttcaaggtgttagtcaactcaaatagcctatgggagacctgtaggaataagttataacataagcaggttgcctgtaaggtctaaactcttcaaagtcacagggaagatctacttactgcaacatatatagcagttgtgagcatgaaattcagcattgggtaatttgggattattgtcaatagccatttaggttgcccattgggcacttttgatctgcaggagtaaagacaattttcagtcattgacaagaacaagaggaacttctagtggcacgaaccacggaggtaatattgtagagacagcagctggttacctgagccaaatatggaactgtgatatgtacgtttctaaggtaatctttccgagccagctagcacagatgaagagtacattaattgcatattcacaatatcgcattacagtaagataaagtccaacataaaagtggaacatgcttcacaaacacaaaacttacgcaaatagtgtgagagagcagcaccggaattcttgagtgaagttgcgtaagcagatgtacacacttttgagtacaataagcattgagcaatcagttattgcagtacaccaaggatttttttttataaaaaaaatcgatatggaaaaaatacatacgttatggggatccaggatgtatagggatggtatttgttgtaggtaatcttgtctagcttataaatgtactcgtaccacaaacaaccagcctgtgatcacagtaaagcaaggtggtcttaccaaaagatggatatgcaacaataagtggcttattcagttatttgataattaccgttaaagcaattgaaactatcaaggccttaatatagagtttagttttcgtttcagcttcttcaagcttctccatccacttctcaacctgcaacacaaacaaatgatttattgatgtaaaatactattctctcgtatgcccacaattttacaaatgactcaacaccctcaaaactgaaagaaccagaaaatttatatcagcacatttctctcacacatgcatatgcgcaggcgcgcagagacatgcactcatacaaacaacttttatgcgatttatgaaatttgataaaactaaagaaatagaacatctataactgaacactatgtaaaagtatagcacagttggcaggaaacatacagttggatggtaataagcataaatcatccccacaatccatatgtagcgatccagtccagatcggaaatgccactcatgcaatcgagggagatcaggtttagatggatcagtatagcctgcacacaaggtaaattacattgatcatccttactaaaaatatatatataaactatcaaactcactaaaagtttacagagaaaacttaccgagaagaaacgtgaatgggctccagacaatctcgaagactcctgggatttcccatatcaggataaccaccaaaaagcaggcaacaaactttatagccatcactgatccaatctcgttatacttatttagtattccaagagcaccataaaccataagggtaaaaagtgtgtgcatagggcaaatataatagagggtgtagtcattatttagcacaatacaacagaatgccacgaaaaaattgaggcgccacatcatctgtcaaggtgaaaacatgtcaggaaggtcctacttatggaagaaagaatgaaggggaatgaagggtctaagaatgaacctgagcaaatcgtgcaaggctgaaatccttccgcacataataataggagaagttaccaaatccagtcatccagacatatgcagcaatgaacacacgaattgcattgtatatctctttagcattgaagtagtggtacatcaaaaacagcacctgaatgagggaaatcaatgctgaaaacaagtgatatgcatgcacttgaacatagatgaaaaacttactaaccacacatgtatgctattgaggcattgagcattgactaattaacttactaaaactaagagaggttcattaatgaagactaggtaagcatacatgtagaacaatatgacaaaagatgtttaataatgaacacatttatatcctctttgcatagttctgagttctgagttctgataaattagtattatgcacaaacggaaaccaacaatatgacaaaagatgtttaatactgaatgcatttataccctctttgcatagttctgacttatgataaattagtgttatgcacaaacagaagccaactagtataagataccccataaatatatgaaaaggaagacggagttttttttccccaaaaaagatacctgcatccaacccttccattcctcagtttggtgcctattcagatacagtatagatttccccgtgaatgacgacttgtcttggtggaccttgaaagaagtcatagctgctacgataataagaagaaagtaaaggaaaaggaacatatctcggctgtaattctgcagatacaggataacagaaaaggtcagaacaaaaaatgtcccattgaaagaacagcacattatataggcactttccatgaaatattagtaaggcttagaatgtattcgtaaaagatatctcaactagatacaatatttttgcaactacttttcaaacgtgaaatcaggcttgtaataaacatcaatgtaatagcaccttcgcagactctcccagtagatttgtgcgatcacatatgtaaaagtaaagcagatgacctccaaactcagatctgaaaaaataataactgctcagccaaataatgcaacatagaagaacacgtgaatgcaagatgcagctgtagcttacattgctctcaacgtcaatcgattctctagaataagtgcctggtccaacaagaaaagtctgtgcaacagattatctttgtcagtgccttagtaatgttgatatctcaacgtttatatacaacatgaaggagaaatcatacatcacaaacaacctgaacatttgtgatgtgagagaagcataaactggcttttgcactggtgcttggacaccctcctccaataacatcacttgatcctctcctttgtttgagctagaatccattactgctaaatttacatccgagtgtctactaacaaagataaagaaacagaaattccaataagtggtacatttcaagcaaaataatggtgcagcacacattcagtccagacgaagtacgactcttgagttatgcttcttgtaacataagtagatatttcaatctcagtggcaacatgagagtatatcacttagcatatacgaaaattaaaatgcatggataccagaactgtaaatatagctgtcacaattacttacgctttaatagaagcagcattcttcctataatagagaacctccgcatatgcccaggcggtgaaaacccaaagaaatcccagaagagcagagacctgtcagaaagttgccagctatctcagatccagtgattgaggacccccaaaacaaaatcctactattagaagaatatcactcagtcatctgtatagtagacaatagttctacggctttcaagttgcaatcaaacactgtaattgtgttatttgaacttgtggggtaaaagtagctcatcatagtccggattcttgcaatccacaccaatatgtatttctgcaactaaattactatctagttttagtatttttaccaacctgaacttcctaacaactaccaaagtaaggaacaaccgtgcgctagaaaatcaagcagattgacaccaattctaacaggttggtcagcacatcgatactgctaccatctcttagaaaatataacagaatagcccatgctgccagatcttaatgacggtcttactctaacatccaatacctccagatctgaaaccgcagccacttacgaatttccaaccttaaaccctacatataagctattatatcgccaattttccaacagctcggatgaatgaaacctccaccatatatttggtgctactagcctaccatacaaaagcacagctatgacctgatgatttacaccctttgatccacatccctgaaaccagccacaaattcaaatcccgcatcagccaaaatagttagcctcctatccgaataccaccgaatcctaaaacctagcactaatacttgtcgtatcaacaaaaaagcaaaccagacaaccaaccgatatccacaaccatctcaccgatcatcacccaatcccgccaatttagccaacagcagcgttaaagcaacacaagctcccgccagagattccacgcgcatgccatcatctccagcgcgcttcctcccagtcccagccacctaaacccaaaacccaagccgcacttccgcggccgcggccgcgcccggcgcccggcacacgggcgatgccttcccattccccccgacgaaatccttgagccacctcgccaaccgcggattcccccgacgaaatcgcctagggggcagcaaatgccgcgcggtccccgcacccgcaccaacaacagagcagcagcccccccctccccggatcgacggtgcgatttagggctcacctggcccggcgtgagggaggtcgaggcggccatggcgatcccacccgcggacgcgatcgcctccgccattctctctacagcatccgccccgcctccttcctgcgccgctcggatccagccgcgtacaggagccgagcagagaagagaagagaagaagagagggagaggacgaagaaaattaggtgcgaagaaaaaaaaaaagagaagcgcggtttaaagcggcgggtggatgtgcgcgtcgtacgagggagcgcgagcttgccgacgctgccatgtgggaccgagcaagagattccacggtcactgacagtgggggcagtgaggcatttcagagcttgtgggccccacacgccatcggatttgcgagtgacggtgtaactaaacggatgcttagtttggtcgatttaggtgagaagaagaagaaagaaatatttccgtttttattatttctctctttacacgaaaattgcagctttgtagattacaggattgcccctgtcggtcggcgagatcttgttgcacttgcacccctcactcactctgctagtcttcttaattccttcgcgtttagtacttgtgtttgcgtttttcgatgattatcactaacttaatctccccgcaaagaaaggcactaactttaatcggtagtactgctccgtttcttggatttcgatgcacatcaattcgtcagagcatcctgtctgtagtgaatagctcgccttaattaagaatcaaattcggaatttgagatggttagcagcgcagatgcccaactggaagtcaactacggcaacagatggtgattttctcgatcaaaagcccatagttgtaattgacgtgtgttgagcggtttatgcgatctgaatcaaagcgataagctgataacaatggcctctttttttctcatagttggcttgtaatatgcgtctacgtggagtatacaaaacgccattaatcggctttttttcacctgggaagtgggaacatgtttgcccaggggaacaggaaataggatttttatgttcagtgcgagagtcactagtctcgtcggtagttggtatgcgccctaacccaccaactaggatgcatgtcatacagatgcaatggagctagcttagtacaggacttcggctgcgttcgatcgtcgcttttagatgttagttttgctgtcacgtgaaattagatgtgtgattagcatataattaatcgagtattaattgttactccctccgtcccataatataagggaatttgagtttttacttgcaacgtttgaccactcgtcttatttaattttttttaaaattattatttattttatttgtgacttactttattatgcataactttttgttttttatatttgcaaaaaaaagtttgaataagacgaatggtcaaa

SEQ ID NO: 37863 - DNA, 5788 bp, Oryza sativa
  unsure (1)..(5788): unsure at all n locations
aaatcccttatattgtgggacggagggagtcaaacttagaagtatttttttaaaaataacttctatataaaaaaactttcacaaaaatacgcaatttgataaacatgctaacagaaaaaacgagtaagttgtagtttagatttggagctttagaacgggaccttcgtctatttgtggtgatgcagtgccaaacaagtattttccctccatgtcaaaataagtagctgtataattcaaatttaaactacacaactagatttatttttggatagaggtagcatgatggtaacctgatggtgatagtaaaaaagagagaaaatgacttgtgtgaatattcctttgaacttgtattcgtggatacaatttatataattgatcaattgttgataatgaaacttaattagtgcttcttagcaataatatacttggcatgagcatgtgtatgccactcttctccaaaagaaaaaaaaaagaaaaacctcaaaagtcatacccacacaaaacaaaccttttaaagtacagaaatttaaaatgattttcatgaaaattagttagaaaagtgtgaatccacgtaaaagagaataaagggcctatagccaagtggttaaaagagtctcagtagtaccttaggtcctgggttcgactctccatgagagtgattttttcaggatttaacggcttttgtgctttcagtggtaggcgacgcccagtcttcgaagatgctcataggggtagggatcaccagtgacaagttcttcctatgagacggaggtgattagggagttgatgtgcggtaggcgcaacatgccgccaataaccaacccaaagctacctcgccacgagctcgtccccaaccatcccctccgcaatgccatccacaagttacatctccgtcacgccatgcgaaacaagtagcccgttggcggccacccttttccccacctctcattaccctctcgttattgctcggaggcctagtgacagataggaaagataggaagatgaggaataataccacttacgaccctttcagtttgcaatggtcgttgccctttctaatctaccgtggcctcatcccatcgatcgccacccctctccaagtcgttgccctttctaatctaccgtggcctcatcccatcgatcgccacccctctccaagtcggtgactgtccttcttcccaccacttgtcgcctcctcacagggccagctctaggtctagacaagttgtgcaaccgactaggacccagagtgaatggggcctatcctaatgtaatgtaggtcaagagtaaatagctgagcagtgtgccttcaatcaactgatgtatggacttcttgatgacctatcccattccagtcgtctcatcccgaggccaaaggcgtcgagcgggagcaactcgccgtcatcgccgacgactccttttcgacagacaacagtaaatgtgtctcttcctttgatcaacaattcatctcagttctctcttctactcttgcctggaccgtacgctcgtagcaggcagcagtgtggcacccagccggccaggccaaagagcgcaggaagcaaagtagcggcagccttgattgaagactatgtgcataggtacatttacatactagcagtagattttatttctcaatttataaataatcatagaagatgatatatcctactccctctggtttcattttaattgacgttttggagaatgacacagtctatagtttatatgtttgaccttatttttctattataatatatatataataaataaatatatgcttacttttattatagtcctttgaaagagaaatctatatacgttattctagtttctttaaactaaatatttttaaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattggacacgtcagtcaaaatcgggtattataaacctcggatacactgttttgcaagttaagagacgtgctacaattggtatcgcggtacaagaatgtaacttgaactcggcgtcaagataagggacctaatatgaacttattccaccataaaaaaaagaacttattccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctcggcgcgccacctcctccagatccacgcccagttcgtcgcgtccggtctcctcgccgacgccttcgccgccagccgcctcatcctcttcaccacctccacccgcctcctcccgctcccgttccaccactcgctccgcctcctccacgtcgtccaccgccccaacgccttctcctgcaacatggtcctcaaggcggcccgcgagcatgggctgccgcacctgtgcctcccgctctacgcgtccatgtccgcggcccccgactgctacacccataccatcctcgccgccgcctgcgccaccaggagggccatcgaagaaggccgccaggtgcactgccacgccgtcaggcacgggttcgggcgcaacctgtacctcgcgaacgcgctgatgagtatgtactccgcgtgtgggtgcctcggcgacgcgcgcaaggtgttcgacgcgggtcctgtttgggacgccgtttcttggaacacgatcctggccgcgtacgtgcaggctgaggatgtggaccaggcggttggggtgtttgcacggatgcctgaacggggtgctgcggcggtgagttcgatggtgtcgctgtttgggaggagaggaatggtggacgaggcgaggaaggtgtttgatgtggtggagcgcaaggatgttttcacgtggactgcgatgatttcttgctttcagcggaatggcaagtttgcagaggcgttggctttgttctcagatatgcgtggggaggggtggcctgtggatgaggcagtcatggtctgtgttgtcgctgcctgtgcacggttggaggtaactcggaatggggagatgtgtcatgggctggctttcagagctggccttggctcgaggttgaacgtccagaacgcattgatccacatgtactcaagttttctgaatgttgttgcggcacgaagattgtttgacagtggccagtgtttggaccagttctcttggaactcgatgatagctggctatcttaagaatggctctgtcaaggatgcaaaggaattgttcactgtaatgcctgacaaagataatgtttcttggactacaatgatatctggttgtgtgcaaaatgaccagtcctcagaggcactcactattttcaacaacatgcaagcccaaggaatcaagccagatgaggttacgcttgtaagcgtcatctctgcatgtactaatatgtcttctctcgagcaaggcaagtcaatgcatgagtacataagggaacaccaatataccatcacagtcatacttgggactagcctcattgacatgtacatgaagtgtgggtgcttagaatctgcattagaagtcttcgatacaatggaagaaagaggaacaccttgctggaatgctgtcattgtggggctggccatgaatggtctggtgatgaagtcccttgacatgttttcggagatggaatcatctagcactgccactccaaatgagataactttcactggagttttgagtgcttgcagacatgctggcctagttgaggagggccaacatttcttcaagttgatgcagcacaagtatcacattatcccaaacatcagacattatggatgcatggtggatcttcttggacgtgctggatatgtcaaagaggcagagaatctgattgagagcatgcccatgtcaccagatgttccagcatggggtgctttgcttggttcctgctggaaacatggtgataatgaggttggagaaagggtggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 37864 - DNA, 25943 bp, Oryza sativa
gcaggcacaggtggacggggcgatacgaggcgcacctgtgggacaacacgtgccggcgagaaggccagaagcgcaagggccgccaaggtaatttactaattaaaattaccgctaatcaccattagtccattaccctttctgtaccgtcatttttctgtcaccgatcgaggaggcctcgccggcggggaggggtatcgacggcggcgaggggacggtgatgagttcgccgtgatgggatgggatgggatggggtgccggcgccgtttcggggggagatcgagagacgggtcgcgtcggccatcgtgtgcatcaagttgaggtgacattagcatctccgttagactcgcaacagttcccggattctctgcggtgccgggccccggtgggtcacccctctttgaccgtgcaaccgtaggtagggggtattgtagccgctgcctagtatacctctgtgttctgtctactactagtagtatctcttttttttttaatctttcttgtggccatttctctgatgcaatagatcggctagagcctaaagcgatttagcaaggcgatttatgttggttaatcttgtaggcgtggagattaactggtcccgtggttggtagagtgacgtcgtgtatctgtatgacagctttgccatggcaggactgctgctgtggtgcatgcagcttttgcttttttcctggttttagtagtagttcatgggtgatgtactgcatgtttagatggttttatttgggtcagtttctttcttccttctattgcaagtctttcttttctccttttttgttttcttctgcattacacacggcgagagtttttgtttctgaaaaatttattacgagtcgcaactttgcaacgctaccagggttgtgtaggggacagctaaggtgtgaccaaaagtggttttggaacgcacgtttgaattttattttatttttgctttgccagttacgactccagtagagttgtttctactgtccgtccttgttgattggcatttggcaacaaacttttgtactttactcgatacgcttgcagagttgcacaggtagacatgcgtgctactggtgtctacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatattaatgcctactatatgagacacccagaaatcagaattccacggatcaatttactgttggatatatagctacatgtaatggtatattttactgtcagatggtacatatatgctgggatatcagtaaaaaaaaatctatcggttgatccgatcatccgaggatagctactctaaaatcacgtgcatagtgcaaaatgcaatttcatcaagtgaacattgcatattctgctgtttggttttgaactgcattatgtaataagtaatacgtattacacaaataactccttacacatgctgatgcattcatatgtgcagattctatcgttagatttgagccacccttgcctcttttgcatcgtgcaagcaaaactccagttctgaggagaaaaatcattgcatgcaattaaagattccatacatataattgcatttgggaaataatatatattaacaggatgaatcacgtgaatagaaatgttgggggcattctttgttgtgtggagagatacattgctttcgagttatgtaagctagcatcctcttgttgctgtccttattatatttggaagatatagttatcttaatttttgaaaaagaaaaaaagaatcatgccttataagttatatgttgataaaggaggagagtttgtgtgagatatgtacaatggggttttggggatcccgtaaacctggggggaaaatgttatcttaatttgcatttgatgtaaatgacatgctattttttttttctgaaccagtgcagtggttccttttttttttttaagaaaggactaccagtggttccatgatagtgatactatgacatgctgcttctttgcattcagtgagtataattttgttaggatatctcaatgtttgaatggaagggacatttgtatacagtgaatgttttctcactgaggaagtcaggaagttgtgtgctaaactgttatccctgtattttttaatatataatcttgtttatttgttggaactaacctggtttataatgtctactctgtatgtgctttttatcctgccaactgcatgggggccttcttcagtttacttgggtatgagcaactaagtcctgtcttatgtatcatttcgtatgccttttcctgggtaagtaaaggtaaataaacatgtggtaaattgcaggtggctatgacatagaagataaggctgctagggcatatgaccttgctgctctgaaatattggggtgctaatgctaccactaacttccctgtaagtgtcacgctttcctgatttcctaaacagccccccatagttactgcaaatatcctactgaggtcatataagcagtttttttgtgcctcctaaaatgtgtgcccttatcccgcacctcatattgtagtgatcttagtgtacttctaatgtcttatttacagttaatccatagccttaaaatttgagatctttgtcaaccttcaactgttcatttggattcatttatgctggttgtggactgagacatactcatgtattcttaatagaaagatacacatcattatcgtcgcaaaagaaaaaaggaaaaaaaaacacatcactatgtgctcacctttatgtggagctgtgtgcttagattggtctctttattttaggatgcattcagaactattatcatgtattgctatagttggtcatgatgcaactgaaatggaacttgttctcttcttagaaagaaagttacgtgaaagagattgaggagatgcaaaagatgagcaagcaggagcttgtagcctcactaaggaggtttgtatttaaaaccacgttcttttgctgtgctacaaccacaggaagttcaggcttatatacgtgtttacaactttctcaattctcatgcaaatctgcaggaagagcagtggcttttctagaggtgcatcgatctacagaggtgtaacaaggtaattttcaactacatgaaccaatcaaccaatggtcatcttctttgtcagttacaatctgctcaacttcctgctattttccccaggcaccaccaacatggccgctggcaggcaagaattggtcgtgttgcaggcaacaaggacttgtatctcggcacctttggtaggagcctgttgttctgatgccccttatatcgaaaaagtagtatgacagtatgctttttttcttaagaaagtatgctcatagtcatatatggacaagtgaccatattatagtcttaagtagttaagttatatggcagaatagtcatagataccttactgtttcttgaagtgctgttaatgctttgttgttccctttcaaataagttactgtcatcttgacacaattattatcatctgtgtaccatttcatttgttactggttttacagataatctacaagctatgcactattcaatctcgctctaattcccttactgtggcgacattcagaaaccactatattttgcactctgtgatgcatactaaaccagcatacttgcacattccttgcagcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatagctttctaccatgttgtatcctttttaagttcgcgagtaattctgcgacaccggatggcctcgacctgctcatctatgggttcgtggcgcggcaacctatcccgtggctgctgcttcgagcagacctgcttttgttctatcagccggagcctagaacatcaaagctttcatttgcactggctgtaacgagcagcaaatctgagcaacaacgcttcagagcttgccgggacagtactgcagattagaagcacaggaaagacagtgatgggtacaaaagaatcgcacgattttagagcacatcaagcagtccgtagataacagtaaaacgtttgcttttcgtcaccatagattaatacagagaaaaagaaaatgatgtccacagtatcaaatatcacacatttcactgtgtggaagcactcagtttaaacacattctttgtagtgctcggtagaactttattctgcttggaacaaccaagcaaatattgctggcaaagaacacatgaaactaatctatagtctactccacgcagcaaaatggtgcaaatggtagatcttggagagttcacgtctttatggtttcacttgaggaggagactcaccctgcagagcaggatcagatttgacagcatctagtgtcttgaagaactcctcagggagtgcaacaggccgatgctgcggaacatgtttcgggataagtgtgtcatcttcaataccctcgcattcatagtcatcaggaacaccccatgggtcccattctgccatccattaaaacattgtatattaaacaactgaggctgtaaggatttatatcaacaaacagaacaaacatgtccatatacttaaggtaaaagcctaaagcatccccataaaagaaaagttgtgctgtatgcaatatttgcagagttcagacacagacactgtcagagatcttaatcaaggcgttacagttttacttgcttgtcaagccatccttgtgatattttcagaacagacatttaagttgattaaggatgccaatctagtgttatagttttgataatttagcaagctattgataaaaaagacaaatgatagtagacttgcatttgaaaatcatgttttagccaaatggtgcttttctttaaaaaataaaaaccattctggcagttctacaggcaaacatatggatgacagattgaaatgcacaagacaatgtatgcaatgcacatcaaaattgccaaacaaactattcctcataaccaattttgcttctaatattctacacattattcagttgatcgacaaggtctatatgctacaattctctatgtccttcatacgggtgagcttggtcattggaaacaaactgaaccatacatataatgcaacagttcagaatatcacagagcaggctaaacagacttaagaaaaaaatgtttctgcaaagcgcttaactcatgcacccaatctgtatcagttgctaatggcagcaacaggactgatctagacagctatagttgtgcaccttatgtcgtaatcttattagatactcagtgtaaagggtagtggcatggttacgtgaattcttaatcactattaagttgctaatgccatgcaaattataatatacttcctccgtttcagattgtaagtcattctagcatttttcacattcatattgatgttaatgaatctagatagatatatatgtctagattcattaacatcaatatgaatgtgggaaatgctagaatgacttacattgtgaaacggagggagtagttacattcattcatagttctatacaaaaaacaatacactgtattgagatttgagagagcatcgatcagtgagagtgctctggattggtaagatgtgcatgggacatgggtgagtgattatttggttcagcctttttttccccagtcgttcggcatggtatttgtaaagtttatttcaattaggtgtgatgaatagactttagatagaagagaaatgctctacaattacgaagattgtggagcatatttcttcttactcacgcaagtaacatcaccatattcctaattccctctctatgccatatcatgtaaaatggaaacctatgtatttcatttgaattttcacaaaacaaatattacactgactcactgggattctagcaaagaagaaattttaaagcactgaagtaatacaccagtacattactacatgcaatgcatagcaccagcccaacgcctgaactagattccagaccagccagattttacatacatggcactccaccagacatacacaaagcaacagtatggtgaatatggcaatgaacacactctggttaagttacaagcaccagtcagttcacaaaaaatcttaggttagtgaccaaaaggtaaaatggaacatccatgatccttaaataagcgctgaaaaataattaaggcattttactaataggcagcacagcagacaacctaaaaagcattccatccccccccctccccaatcaacaaactggcaaacaccatactgtcaacgctgataatttgccctaccagtgctattaaagggagccaaaagaaaatcaaataccaatcgctacgatgttattgtccacggatcagttgtatatcggatcaaataactggttgaatcaaagaaatgggtagccagtggccacatctacacatcaactaccctgattcttgtcgacagatcagtaggaggaataaggaattaatacaagaagtaactaaataagcgacaggaatggagatggggcgtaggggagggggagaaatgcggaccgatcatcttggcgatgagcttgagctcgtcctgggcctcctcgatgagctcctcgacctggccgcagccgatgcggtcctcgatgcgcttccagtcgtcctcctcctggcagatctggaggcggtggcgggtgaaggactcgacggccttgcggtagccctcgtccttggggacggcctcgatctccttgagggtgcgggtgtagaggccgacgagcacctcccgcgcgttgggcaccacctccagccccacgatccccgtcgtctccttcacggcgcgcgccgcccgcagcgccgccacccctcccccgccgctcaggatccgccgcaggaacatcccgccaccaccgccgtcgtctctctctctacctggtgaggtgcgggaggggtcgcgaccgtgcgaggatgctggtgtggtacgtgcgactgatgagcagcggatggggaattgggggagagaggatggagtgggctgtgggctgtggagtgtgtgtgtggatcatgggctgcagaagcagtaggccgcaatgttgaaatcctgccgagcgaattgcgaattcgagggccgcgcaagagcacccgcaacggtaaagtaatgtgctctttataaaacatgtacatctcagcaatagactgattaatagtaaaccacctcaatagtatgtctacataggtatctatagctctctcatcaattgcctctttttatctatagactatctccaagttagtagatagttttactctctctcttttcatttaatctcttccaagtaggaaaatatgctgacatggatcttttatagaaagcttatagataaccattgcgggtgccctaagggagatttttcaccagaattagaagtttttttaaacagttcaacctatcgttccgattcttagaacctataaaatgaactagaaactcagaaggtagaaaattcagctttttcatattctcagaagctgactactgaccaactggttcttaaaatacctatttattagagttacaacttctaaatttagtttcaaaagttaaatctagagtgaagtagtggagcagcctaaatctagctccacctctttagttcattttgtgagagctttacccaggcacccagctcaactgagtgaagctagctagtctcctttataagagcatctccaagagaatgggtaagtgactctccaagccaaattttagccatagcagagaaaaaatagcctccaacagcatctccatcccactggctaagctatatggttagccaaacactccccccaactagctaaatctagccagccacaaccacatccccaaggctggccaaatgctctccccgctacctcttccgatgcaacggcgaggagtagcagcgttgccatccgttgcagcaccgccgtccctccgagtagcctcactctctctctctttagcactgccctccgccgcctcgaacaggtcgtgcccagcgcccgccgcggtggacgaagtcgacagcggcggcgtcggcggcgtccccataggcgtggacgacgctcgctgctgctgctgcatcggcacgccgtgcgagtggtggaactgctgggacggtgatgagaaggagaagtcttcattcggccgcctctgcaggtcgcaaccgcggcctccgctcggcgtggcccgccccgccgctcgccgcagccgccggcatccgcttggcgcagcgcgccgcctctgctcgttgcaaccgcggcctccgctcgccgctgcctgtcgcctcgccgctgctcgctgaagcccgtcccgcacacccgtcgccgcagcatcagaggcaagtccagtaggaggaggaaggtttatgtatgagtggggaaaatgggtggaagaggaggaagaaggttatagagactgacatatgggtcccattggttatagacttgtaatggagagggtagatagggaggctgttgaagcgagcaacaactttaacttgctaaatcaaatgggtagctggctatatggatgtttggagagtctattttagagaagctgttggagatgctctaagagatggagctaaaactagagttgtgacaaacaaaccctcaagttggctagtctactatgtttaagtttgcatttgtaccatacgatgcacgatagttttcatgcagtagtaatacttcttcagtaactagcaaattacccatgtcatctaatggtataaaaacaaaccggtttgccgtgtttttaagtaggcagttagtttttactctctccgtttcacaatgtatttatattgatgttaatgaatctatatatatatatatatatatatatatatatattcattaacattattattattatgaatatagaaaatgttagaatgacttacattgtgaaacagagggagtagtttctaaaaaacattggctggtttttctagagaaactgttcgttttttttccctggaaggacagggcgaacgatcaattttctagtagcagttacgtgggtgggggaaccactcccttctatgcagagaagagaagataaaccatcgccgccctgcaggttttgtttattcttcttgtagaaaacaaactcgcagataattcttctgctactgcctactggtggagtggtggttctttcccaatctgctaaggtagattgagatccgctaagagcatctttaacagcctccttatcccactttccaagttatattatagcaattttggctcaaatttgcactccaacagcctggctggccaaagtcgctcgcgctggctaaatcgtgggccccacctctattctctctccctcctgtagcctctctcctcctcccaaatccagtgccgcccgtagcattctctccgccgacgccgcccatccgcgccacccctccgccggcgaagagagctccctccctgtgccggcgaagagagctccctccctgcctgccccaccatctgcccagtgccgacgtcgtcgtcctcccggctccgtcgtcgttgtcgccctcacagcgccgccgccgtcgtcctcccagtgtcagccgccctagcgccgccattgtggccttccctcgccgtcgcctcgagcctgccttgcgtgcgcacggatttgccgccaagagcggcaccgacgggtggagcctgagcagcggcggcggcggatggggacacagcccgagcggcggtggggatggggatggggcggcggcggcagatgagagagggaaggggggtttggagagaatgggagaaagatgagggagaaggaggtgtagagactgacatgtgagcccaattgtaataaactcaaaatatagaggacgaatagagtggctgttggagtaaaagacaatttgacttgctaaattaaatggagagttggccaaatagacatttggacagtcaaatttggatagactgttagagatgctctaacctacttatatttaacttatatcattgatatgtggaccctctacccaataaactcacgtatcagtgactcaaagtcagaaggaagaaagtcagagggtcctcttccggctaaggttatatggaactacaaccgaacagatttttagctttccttctctcgccaagaatttgcgatgaactttgggcattgcagctgtaggaaacagaagttcaatatcaagttttatagaatcgtggcatacattgccgacatgagcatacgagattgacccagagaagagtcgatttacagactagcaatcagccacccctactgatatgatattgacaatttcatttccgttttaatcacctggaaagaaacaccaggcatgactaggttctcctaaacaccgtcaagtaaacgctacgttcagtcacctgcaagacaaagtaagaacatcagatggaattaaagaatcttaaaactgaaaaccggctgttaaaacatctacatcttgtcaaaaaaagcaatgcacactcctaaaagaaattttcttgtgcataaccactataggattaatacttctcatcactcagaagctcaactcatatatgctcccatttcaacatgaggtgtctatttaatttctaggagagcttcgaatgcatagagttctctgctcaatctaaagacatgtttcatttccaatagcttgaccagtcaaagagagcggtaaataggctgagtcattcaaaccaaaggtagctagctagctccctgccttctcatcactaaataggctgtattatacactcatttttctttgttatatgcagcatgagttaatttctccttggtcttggtgacaaaagtaataggtctaacacatttggatcgagggagtacttacgttgtatgccaggctctcctatgtgtcatcactcatttgctcctatggcatgaaccgcacctggctcatcccacctgttgggtttaaaacatgtccgtgctgtcagctcctttacaattgacggtttatttaagcctctattatcttatcttattattatagtaccaatatatgaatactgtcacatgtacaatataatctgttttttcaagtgaaaatttcatattgctcagcatcctaccttttttccccctagagttacattgttttgaatgtgatccaggactaaagagatctgacaatgcaaatgatcctacaagatatctacaacgtttaatgctcatgaagttacttgccattttgcatagttttagtttctataattattgaagagatatgaaccttttgactgttgactgatttacattttaattacaggacacccttggaactgtaaatcctttcatctcaaataattttatgtaacgaacaagttggctttgagtgtttcatctacctatatgctttgaggtgatagttgagtgtctttcaagaagagattgttgggttaagcaaaatgctcaaggtagtggacacaaagaacaaaggtgtaatgttagaagataaagcgattgccggcagctactcgaggtctcacgaagacgtgactagagtgacgaatgtagcataatcatggttaattgtttgttattaggatagtattgtttatttcagaacaataaattgtaggcaaattttgctacaggacatcacgattttatggttttagctataggacaccgcacaaacttacttttagggaaaaacactctctaaatgtggttatttgccagtggacaccgcgtccattataataatgtattcgtgctgacgaggcaataggggacccaaaagtttacgcggagtgaccaaactgcccctgcgcgttcaggtgatgtttggcagcagcttcttcccttcctctctctacagctacccaagaacatcttctctcttcctgtctgtttctctctctaagctagctatattcaaatcaaatatcagatttgatccacgataattgatccacaggattgaaaaaaaatcagattcgatcaagtctttcatcctgcagaaaaaaatcacagaggaaaaagaaaaagaaaaagaaatgacgatggagctcgctgccatctccaacacctcatcgtcgctgtcgaatctgctttgcgacatatgcttgcctccgccgcgaggagctcgcctccgccacctttcacttgcttcgccgacgtcccgccggcactctgcgaccagctccactgtagccgttgctcgctccgtcaatcatcgagaacctgcttgctccatcgctactgctgctcccctcgccgacgccctcagtgccgctgctcgctttgctaccgtggcttgtgcgctgggtagggcttggagctgctgtatttggggctgatttgaagctgtgcataccagcggtgcctcctctaactctaggaggcgcgggtggtccggcggcgccccggcatattcctgcggccgtggcactagatgtcgccgtgctccacctcctccgcctcctcgtcatggtcttgctggaaacggttgaggaggataaagggaggacttcccctcaactaattttactcgagagcaaaaggagcagccggatttggcggtcaagcggcgacgactccgactctgccccgaccagaggtagaagataagcctgacagatggggcccctatcgccaggggtagtttggtactccgtgtaaaatttttgggccccaatcgccatgtcggcacaaatatattattttaatggccatggtgtccactggcaaataaacacacttagagagtgtttttccccaaaagtgagtacgtgcggtgttctacagctataatcacaaagttgcaatgtcctgtagcaaaatttgcctaaattgtaactacacttcgtaccacatatttgctttataaacctatttacaatattactagaaatcacacatttaaaaattaacaaagatggaggtgatagtcacgcaaaagcacgataaattattagttgtcctgataatactgttaattacaaatcaagataaatttgttaacgttgtagttacacttcctgacaagtatgttctataattgtatatttgcgtgttttgttattgcaaatttaagctaattgctgcaaacatgtaagcatattcaataaagagggaggttatagccacacaaaagaacgactctataggctagttattacatattaagtgcaagaaactatatgtagatgagtgcacaagcttttcatgaggcatggcaatcatccatgtgtatgcaatactattagttgctaaaagactataaattgcaggttcaaatgaataactagatagtaacagcgattaacattcaaagcaaaatgacattcaagtatctggaacagagaaacaccatactcagattaataaatttaatagagctctgcaagtgagtacattagggtaactcagattccagcggagcaatattttaataccttataagccaaaatgctccacttcttcatcttccccttcatcctcatcctcatcctcatcatcctcagaaatcctgaaatcttctaatgccgcctcctcttcctcctcatcagcatcatccatcatatccgtagcacgatttttgtccttcaaaccagtgctgagcacaacagtctgtcctttagagttttccatgtctctttgcaacctttccatgttctccttcctacgctcagcctctaacctctctttttcagcaatcctcttgtcaagatcagccctgaaaagtttttttataacaaccacttatataatttttgctatgcatatatcagtcagagatagcagcactacatcgcaagttaaaacacctgtaattctccatgtattctttggcacttgcttcaatagcttcaaaaaatgaattgactccagcgccagatacggcagatactccaacagaccgcagatttttgtaaaactcatccaggacaagagagaggcttcgggtaaatgtagaggagtatgatgagtcagaatccaaggcggtctgaaacgcctcaaagtcttccatccactgataaaataaacaacataatctctggttacagaagatgtagggaaaaaaacagataagacaattaactaacaggcccaatcaaatttgagcaaatatcaatcaagtgcaacagtttcaacttgataaataccaaagagagtcgttgcataatgccgataccgcattactgaaatgcaacacttatggtgtccagaatcaacaacaaaggaattagatattcatagatggcaaacatacctcaagagcaaactcatgcttggcaacatcaaccttattaaatgtcagaatcatcggtaagcgggtcttgtacagaatactgcaggcataaagcatgttgctcatgaaagtaacagggctcgttgatctgggggtgtcaacaacatatgcgacaactgttggaaatgtcgatgcaaaagcttctgttatgatagctcctgaagccgaccaagtgaagatttcaatctgccctggcgtgtccaccaggacataatccagctggtcggctcgtctttcaataacagatataacctgtaaagacaattattaggtgttacatatgatcattagcagaattgcatcatgtgtcaaccaaatttatctgtacactgcagtaagcaaaaagcaagctcgctttctgaaccactttacatggaattgtggaaatattatcccatcaacatgataagcagactgcattcctttaacaaatttactagactagtcatcaacccgtgcatctgcacgggctaggggcatattttctacccttatgtttattttatatcattattgacatatttgttaaacattataattttatattatgttgaccatccaacagtatcaataagctagtttgttgagaaatgaccattatttagtgtttccctacacacattccatacagctattagaaccataattagacactgtgcaagcatctccaggtaagaattgaaaagttacctatgcagaaccaattagtagcatacatgcacgataatcttcctataaaccaaattaaattagcattcattacattgtatcttttaagggaacaggactcaatctaggcaagtttatttgggaatctctatgtgctgcatgacaataacacttctaattgaatattacgcgtgtatatgtgaaatcttgaactatttagaaactattaatgaaattgaactgtcgaaacttatcgctgaactcttcactgtccatttctgttgctccctaactaactatcgttgcatacaaactaccattgaagtgattaaattgcctaagtattgcctaacttggtattgaagtacttcctgatagtgtgcattcaagtaacccaatcctaacaaccacttgatctaaacacatacggagatgaaatatatgatgatcgaaaagcacacctcgtcaaacttggtggagaataggttgagagaggtgaggataccgccattggggccaagaccatactccttcatcacctccttgtaccgaacggtatcacggatatctatgttggccccaaacggcagcgtcatcaccgcagggtcaaggttgagcacataacccctcatgtttgaagcctgggtgtggcataccagtcggtgcataaaagttgtcttccccgtccctacatcacataaaccgagacccttgaggcctgagctcccaatcccaaaattactcaacaagagctcattgtatgacaggttggttgccactaaacatcaaaggatgaaccaatcagcatgcgaaatcgatgtaccggccatgccgatgacgatgatgatcaccggcttcttcttgaaattggtgcgctccgggccgatggagaggctcccgatggagtccgcgagctcctcgctcttccccttccccttcgcgtcagtctgcacagggtccatcatcaggggcaaaaaaaaaacagtcacaatcaaaaactgaaggtagaatccccgtggggaggagtcgggcggcggcggcggcggcatgcctggtcctcgaggtccatctgggtgggcttgcccgcggcggctgggtcggagtcgacgtccatcggcggtggcgcggggagaaggcggcggccacgcggcgagcgggtggaggacaaccgcccgctaaaaccctagagactactgcgctgcgactgcgaggagaggagagagagcttgagaaaggaggaagtggccgaacgtggatgggaagggagatggtcagtactcggcagtgtgaacatgctttaaggttttggacttaccgactttagttgacccatgctggcccatcaaattttgcgggctgacccacaaggtttcgtgccggcccatcatctgaagcgccggcccaagcacggtagtggcaaatgagccgtgccggcatgacccacaggctggcgtaccgtgccgtgccgtgcctgggcctaggcatgagggctgaggcaccccggggaattccggcggaaaaagtacaccgaaggtccctcaacttgtcatcggatacaaaaacatcctcaaaccgcaaaaccagatatgaggtgtcccttaactatacaaaaccagtcacccgagatcctttagtggttttgaccctgttttagcctacgtggcgcgtgggacccacatgtgggcttgccacgtcaattcccctttcccctcttcttctctcccttcctcccccctctctctcgcactcttctcttgcaggctggccgacgggtagggagcagacgaccggacggcgaggggggttgagcggcggacggcggaggcagcgtgtgagcgcgcggcggccggcgaagcggaggcgcggagctgcggtggccggcggatggggagcggcgccgggacgtcgtcgacaggcgaggatcggcggggagaaggggtgccaggacgggaggcagctgatggggaggacaaccgacgagcagcggccgacggggagacgggacggcgtgcatgcctatccgggctgccaaatattcgaagcaatggtacctgcggaagatgagataggcaatcaaccattcaattcaccgcaccgaacactgttgtttccaccgacaaaactcgcatggcccggagatcgctgatgcacagaactgtggcttccctagcatgaatttccatgtaacttgggacaggatgattgttgttagcttgcttgacaccggagttggctgacggatgcctggtttcggtctggccacagctgttgcgctatcgaaatctcctactccatgcagtagctggtgtggcacatgtgagtgacttcaggaaaggaggacatggacggaggcgatcttggtggcggcgcaaacggggcaagcgtcaacggcggcctcgcaggcgccgcacaggcacaggcggcagcacggacgcctccgtgacacggcaggccttgcacgacgtcgccccggacaccgcgtcggtggcagtggcggcggcgccgccgcctggggtctcgaagcagcacgactgcgcatcctcggcgtcgccctcccccgcggtggcggcgacggcatagggggactggaggagctagtcgagcatcgcgcggaggccggcggcgacagcctcgtggctcttggcaacgcccatccacgcctgcccttccgcgctcatctggcggagcttctcctccagctccgcgttgcggcagcgtgcgcgatccagcttggcctccgccgcacgcgtcctccctgttgtggcgcgcgccgcggccgccaccagcgcccggacgtgccgtcgctgcgcttcctccaaccccgcgtgcatccgctcggcttgcacggcatccaccaaacaccgacaccgattaaacaccactcaccaaacacaaacagaggaggccggcggcgtgagcgggtgcgtggcctcgtcgtaggtgaagaagagcgaggcgttggttgtcgggatgggaggcctgttcccacgtcgccgccgccaccgcgtcgcctgtcgccagcctagagagaggtaaagtgagacagagagtaaggacgaagggaaagagagagatagtgatgacgtggcacgctgacatatggggcccacgtgggtctcacgcgctacgtaggccaaacccggggacaaaaccactgaagcaactcgggtgaccggttttgtatagttaagggatctcgcatatttgtttttgtggtttgaggacgtttgttaatcccgatgataagttgagggaccttcggtgtactttttccaattccggcaccccggttctgttcccgtatggggccgacgaactgagcggatctgccgggaagaatcgttgggcttgatcagacgaagaaggcccaaaatggaatggccgggcccgtcaggaggaaataaaagagacatggaaaagttcgagtaggccccgcatatgctcgccgaaataggaataagttcacttcatgaccctcaaatgtgatcgaaccctaaaccacaaaaccggatatctcgacccccaaactcctaaaaccggtgtaatttaaccacctcgacggttttgttaacgtggcgtctacgtggcgatattggtcttcgttccatgtggcgttgacatggcacttatgtgacagtagaattaaaaaatatatatggaaccattagtcattcaaaaaaaataaatgtgggcccactgacatttgcttcgttcttcctcctccctctctcccttctctttctttctctccccttcttccccttcggccggcgggcgggagggcaacgagagcgagcggcggcgggcggcgacgaacgcgcacggcatcattatctgactgctccccaccacgcgcacgtcgccggcggcctcgcatgtgtcggagcggcggctcgtctcgtagcacaccggcttggccccatcgccgccgcccggtgggcttcgccggagcggcgacctcctccgctgcagcatcacgaggagaatcagtttaattagatctggtcgcggaatctcgcagccgaatccacgccattctttagcgcaaaactccagaaagcccaagaaataaattatgaaccaggatagcaactcgccgggagaaaaaaattcaagaaataaattatggatgcttcgattccttttcctttttttcttctcctctagtccttgtttgaactaaagccaaatcgaaagaacggatatgaaatcgccaagaacgaatcagccaagccagctcaagcaatgcgctgcactgcgccgctcacgcgcgagcagatccaagaaacacatctcgtaattaccagctgccgacgacaacgacgaggactagtcgccggattcggtgttgacgacgacgtgattggtggtgacgacgagcttggattcgtcggccacgagcttgagggcctcgcctccatcactagctgcgaaggagaacctccaaatcagctctcgcctctcgccatagcagcatccaacaaaacaattaacagcggcggcggcggcggcgagaggaagaagaggaggatgggggagaacctggcgcggatgatggagagcgcgatgagggaggagagcatgagtgccaggacagccgcattcctcagcctcctcctcggctcccctcctcacctcgccgagctcctcggcttcttcttcttgcctccctttctccctctcctcagttgccgagctgggaagctgagctgagctgagcaggtgggtatggggattagtagcagcaccggcgagaagctctcctcctccgggcggtggtggtggcgggcgccggagatggggagtaggattccgggctcccagccctcgcctgccctcccgcctgccgccgcagttccggcctcgccgcccgccgccgctcgttctcactgccctcccgcccgccggccgaaggggaagaaggggagagaaagagagagaagggagagagggaggaggaagaaggaaagcactgccacgtgggccccacatatcagtgggcccatatttctttttgtgtgaatgactaatgggtcccactcatattttttaattctactgccacgtaagtgccacgaggaacaaagactcggtcaatattgccatgtaggcgccacgtcagcgaaaccgccctccaaaaccgccgagggagtcaaattgcaccggttttaagagtttgggggggggggtcaagatatccggttttctgatttagggccatggattagatttcgatcacttttgagggtcacaaagtgaacttattccgccgaaataatactgttgttccggggtaccacgcgctgtctccagaatcgctaattctctcacgcgcgtatcaggcccagaaggcccagtgccggcccgctagcgcacgcctcccacgtcttttttttaccgatatttttcttttttacccacttttttctgaatatttttttaatcttttagcatgttttgagtttgaaagtttttaaattttgagctgaaagtttttaaatctcgacttgaaagttttcaaatctcaagttgacagttttcaaaattttcaaatctggacttaaaagttttcgaatatcgagttgaaagttttcaaatttcgagttgaaaatttttaaatctcaaattgaaagttttcaatttttcaaatctggacttgaaagtttttgaatctcaattctcgagttgaaagttttcaaaatttgactttagaatttaaaacttaaatcgaaagttttcaaatctaacttaaaaaattttcaatatgttagtaaaaaaatctccaaaaaaaaatctccagaatctttcctaattactatcattagtgttaagtatattactaatagaggtagttaagacttaagaggggagtgctcgctagcgacacgcacgcgctagctaggagccccccgctgtctcgccatttcatggcttagtaacatctaagaaatatcggagtgatcgtgatcggcgtcgaaccaacatctcatgaatttttgcaaatcatgaaactttaagcatgcctttaagcattcccatcgacgtaagatcagattaaggagttaattactactagcaaatagtattaggaatgacctaatattaaataattaaaaggggtgagactttaaacccaggtcgtctttaaacccaggtcgtctagcccatcaccttatgaagctagccagaagactaatggacgtttttcggagttaattagtgctagagtgcttaaagttctaaaagtttaatatgatcttacatcaaaattttatgaccaaagggttcgttgtggttggaggaagtttgtaggacggattaagggtgtctttggcacccctttttctcaacccatctctctcgttttccacgcgcacgcttttcaaactattaaacggtgtactttttgcaaaaaagtttctatacaaatgttgcttaaaaatcatattaattcattttttaaaaaaatagcaaatacttaattaattacgtgctaatggactgctctgtttttcgtgttactattccgggttgggaaccaacatatgcgaacacaccctaagagttcaaagggatgggactattaatgattctgtttggttaggagacttgagagttttggtaggataagatagagaattgagggagtagggatggtaattggaagcaaaatccttaaatctcaaccattcattttttatttaaaatttaatcttcaataaacttcttatcgagtcccgccacctctattaaagaagaggttgagactaaaaattaaattttcatgttaatctcactggtcactatcaatttttggaatgattactggctgctaaacaagcctctctgctaacaatttcaagccctgcattttcactctatgcacaaacttgtctctgttgtagtgacaattcaaatggggctgagcgaatcctcggtgccacgcctttcttcggctgtagagcagcaattgacacgccgcccaaaccctgacagatcaacaagatctcaaaaaatagctgtccccgatagatttactggagctctcaccaccaagcaagcctatgagctcctgctaccttcatctcaaatggacaagaactgccccccccccccccacccccgaagatacatttttttgttggcttctatcaaaagagcgcctaccaacaaaacaaaaaagaacctgcatgctaagacaattgtctcatccccaacttgtgatatctgtggactcaacgatggaacggccagccaccttatacctgctgtgccctttcacctgcaacttctgggcagccctctttattgaccctggaatctctgatgtacgagatgtcggctgcatttgccccctgcaactgcaaccataccggtggcgcaccatcggaccttcttttttttttttttgagaaccatcggaccttcttcttgctctgctggtggtgtatgtggaaccgctgacacgatgtcatcttcagaaatgagcaaccttccctacgactactccttcaacgctgttttgatgaagctaacttgtgggctgagcgtatccggcgccctgatcagattgtagtttcagcctggaaagaaattttctcccgtcctatgcaactccaacatatgtaatggcaacggcactgtcgttctgcccgtcccatataaccctctttgtaatgaaacctcttatcaaaaaaaaattcaagtggggaattctcctatccggtgattatccaaaaaagataagtgatcactatcaattttcttccctcatgttaccaaacaaatccggaatttctctttctacacaactgtttgcgtcaacatatagatttacggtcaataattctaggcagcaagcaaccagccaccaccagcagcatcagcagctagcaagttcgcgatattcgcaagcctgccagataatcgtgcccacgctgccggcgaatggacatgcatcccttgtggcaaattcggcgtgcagtggatatggatttgcccacaatctctgaatgcaaccacctgaacagtcaaataaggtctgcaagcaagaacaaagattctttgcggccggcgaacgactttcgacggcccggcgagaaataaaagaacaaggattttgatactacgctcctgttttggctagctgtttcccctgcaagcacatctctccttccccatccactcatctttataagctccaaccagcgaaccgaagacacaacacgcatctaacatctgtacagctactcgtactagctaataacttgtctgtgtaattggcgctatggcgttaagcaggagaacgcgccattgcctggtattactacttgtctccttggcattgctcccactgggcatggctacggatcccattggcggctactgctcggagtcggggacgagcgatgctgaaattaacggcaagacgaggcggcgcagcatcaactccgtcgtctccgacctcgtcgccaaggcggcctccaacggtggctttgccacgtcctccgccggcaagggcaacaacgtcttctacggcctcgcgcagtgccgcggcgacgtctccgccagcgactgcaaggcatgcctcgtcgaagccgccaattacaccctctccttctgccactatgcatcggactccaggatgtggtatgcagctacgctagctacggtccagtgcgtcaatattcgacagattttattccacttaagatacaaattttacatcagttttcatcaacatgttttttaaacggttgaatgatatattttatgaaaatcttttctatataaaaagttgcttgaaatattaaataaattaaccatgtgtcaattggtttcgttatttttcatgccctaacattgggccggttcattttgatgacattttcaaccttatcaaattttggtaatgttgtcaaaaagtggctacatttagggcttgtttggttctttaccctaccaattcattggtagtaccaaagtctaggcaaattttggcactaccaaaatattggtagggccaattatttagctaacatttggattgctatcaatttaaagccaaattcttatagcatagtgaagaaacttctagactatgaccaaatattttaggggcactatcaaatatttggtctcaatccaaactaacacacaaactattcaatttgccaataaattggtagggtatgtttttggcatcaaaccaaaacggcccctagtttgctgccaaattttgataactatataaaaaatcctgccaaaattttgacaagttaccaaaattttggcattatcaaaatttggtaaggttttttttttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtgcgtgaaggaataccgagagccccccgcg
